United States Patent 7,868,149 (PLANT GENOME SEQUENCE AND USES THEREOF) - sequence listing, part 23

SEQ ID NO: 11214 - DNA, 22822 bp, Oryza sativa
  unsure (1)..(22822): unsure at all n locations
ggaaggctgccgttcgacaggacctgtcgcacagcccccgttcgacaggaagggctgtgtcgaactgcccctgttcgataggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacagaaatgactaaaagtttaatacaaatagataagtcaaggacgatcagtgcccttcgcacgcttgctaggtcctcccttcttcctatgcctaatctgctcagtgggatatgtcaaattatcaggggggagcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatgacgtagttagtaacgatacatataattagaaactaaagcgtgtctatcatcatctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttagtctgttttcaacaacacacattttaatgtgccgcaaaaaccatagccagcttgatgtgttcttgctttcaacaaatgcaaaagcaacaggaacgacatggctatccgtgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaatattctccccatattcattcacctcatcgagaatagccatgtgtgtgcccgggtttcttgcctgcatcacctccaatagtgggggaagattgtgataagaatcctcatgagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaataaacacgtatgttgctcaaccctcgaacctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccacctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccattcatgttgacccctcactggccacacggtatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattataacttatactatattgccgtgtactaatttacaactattagtaacaaacaactagtttaataatccaaataaaatataacacctttgtatctattttaacacacaacatatcaataatatgtactaactaagaactaatttaaccgtacaattacttaaatacctctaccaacatttagcaataacaaatatgtgctaaccatacatactaacatcgaacaatacgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaaacaaatcgaactcgcggcctgggtggacggggctttaaaccggcttgtcgaatgcccattgttcgacagggtcggtggagggccctgtcgaacgcccccggttcgacaggcctcgcggcgccgggtggtgggccctgtcgaactccctccgttcgacaggtgagcgtgtcgaacgccagccgttcgacatgcctttgtcgactgcccgtcgttcgataggtgccctatcgaattgcacccgttcgacagggacctactttcgcgattttccccggttggccactacttttgcgattttccataaaaataatattaattctcaacaaaattcgaggtttttggcatacgaagcggcgaggataagaaaacgaagcgcatatgcgagatgtgtcgggtgctgcctttgaagtacgacgatgataatttttggttttctacaatacgtcgattatttttaatcgaaacagagggaataaatcagtactaatagggtgacactcttatcaacactcctaaatgttgtgttaggcccctttttagcattacgtttgaattgaacaagcattaacaagttggttaatctgaattcaattaaaaacgtttgttcacgttcgcctcaatctgatgaatgcgggcttttccggaaaagccctgttcctgttactctgttaacagcaggagtcagggaccttacttacatcctgccatgcacgttgaccgtaagaccacatgcaaacaggtagtagtcgttctacgctggccaaaaggtctcacggtcaaccaattagcgcagaacagagttgtgaaacaaataaatagggattcactatgcatcctttcaaaacaagcttgggaactaacagtgctactgcctcactcgtctagcacaagcatcgtcagatcacatgaattgttgcatgctcagtggactctagcacgggcacagcagtatctcacaaaagcagattaaagcatccaaagcttaatatatgattgcagagcgatgaagcatcaaagcgcattaagaaaaacaatccaagaatggtttgcgtactcagttggagctccagtttcatagcatcgttctacaagggagcacccatccctaccgtcataacgtaaaatgttttcttcagttcaccagatccataaaagacgggatgcaacagagaaaggaattatgtagaggggccttcgattgctctaacttgtctcggctttagcgtccgactcctgggattttccggcttcagcagccttctctgcgtcttgaggtttagacacttcttctaaacaagggagcaacaaagtcaaaaaagatggcatgaggacttttaccaagcaagattacaattaaaaggttctaagatatataaaaaaacaaaagataactggcactcttatatcaacttaattgacataacatagttgtttaaattgcttataattgatgcctagatgtacttaaagtctgcaatttcttgggaggtacttcaaatctctagatttatgtgcaatatgatgaatacaaactgatttgcaatttcttgggaatgtgcttcagttctctagacgtaagtacaatatgatgaatacgagtacacgcgacactaaccttaatctgcacctagtgacactaactttacatgcatcaaaaagtttcctaaccagtatgtaagtataatggttaagaaacttttgatgcatgtgattaaggttagtatcatacctatcacaaaatcaatgcaagtaagaaacatatcagactaattaccaccataatagttacagcatgaacaacataattcgggccaaactattccaaaatgtgcaggagaaccattaaatagcacttttacttctacaatcacaatatcaagaaacagtcctgtatgatgaaaaaaatagctttatcctattgagttgcatttatatgtgccaagcatgaaaggtgcaatattttgatcactgctgttaagagtacgaatcacacaattgcagatttttcaagaattggcctttcaattaatggcatttgtcacgtgcatgagtcatatcactcatctggtcaggcagttcaaactaaaccatactaatcttaccaaactgcaaaaataatgcttccttaatttatattttcacagaatcatattatgctatcatatagctaatagaaacaagtggatattaatgagaatctgtggacacaataaaggaagacaaaccttcatcgtcactctcgtcctcgaactcatcnnnnnnnnnnnnnnnnnnnnnnnnnnnnnnnnnacccatgccacccatcatctcagccatgccacccatgccacccataccacccatgccacccatcatatcacccattccgcccattccacccattccacccatgccaccaaaattctataaaaaaagacataaagaaaaacattagtttaaaaaacaatatatgcatgagcaaaaaggaaatctaggaataaacatgaaatctgaaaagaactaattaccgaaaagtccattccatccacgttgacatcagcacctaaaaaataaaatatatgcatatcaaaacgttggataaggaacaagggcttatttacattaataaggccagattaaatttcctggaatatctatataattaagttaaaaaataatatattataagagcagattaggtccctaaactgatattagttttggggcttgaatgtggaatctaaacgagtgagacaatgtaggtttatatccaacataacgagtaataacagtttgtcctgcgcatgatttttttttaccatgaccagttgaaaaacaaatggaatgccttaaagagaaacatatatggaacattcttcaaattcaaacatgtcattatgtgctatgatcaaatgatactccattctaacatgttaggcgcacttgcttcatctcacttgttctcattatgctgctactagttgcgtcaaacatgagaaaacaagtccacagtttatcaccgcaaaagaagtgcatagcttaccatcatcatcttcatcaacccatttgtcccagtcaactttcacaaagtgtggtgccttttgatcatctcgaacaagcttcttccaccatttggcctcagctttttctacaatacagaatatggacctaacacctacacttattttgctctcctgtagaatcaaaacaaataaacacgggataaggaaccacgcattttaatatagaggaaactgcagtcatatagctattgcacgagcatgtattacctcaacatttactttgtcgttcaactctagctttgattcgtataagttcccatcagttccagctgtagcagagaaagagaatacaccttctggttccagattgaccttagcatccttagcatcagctaattgtacagttatgtaaaccttgtcaatcctctgagcccacttcacttcagggtgccgactacaggaaacaaaaagaaaaccataaaaaaaattcaattctgagcaccttacaagaagcaaaagaatgagggttagatccctttgaggttaaactccaatacaaatacatcagcagcctacaaaaatccacaagtttactgtgtgccagtaatatccatgctatatgaacaagtgacaagtactccctccgtatcatatttgactttttttctagtcaaatttctttaggtatgaccaaatttatagaaaaatttagcaacatctacagcaccaaattagtttcactaaaatgtaatgctgaatatattttggtaatatgtttgtcttgtgttggaaatattgccatatttttctataaacttggacgaactttaaaaaaaattgactggaaaagaagtcaaaacgacttataatgtgaaacacagggagtattatacaaaatactgataaaaatgaaagttttcttaatgaatataaaatggtggtgtctggtaatcctatcataaagcaaaaccaacaaagaatccttagagaataccgagacacaattgccattggcatcagtatcagagttacctacaactgaacatgaactaacacttacaatgagaaagcactaatgcaaaaatgtattacaaaccagatttcaatctcttaaaaatatcacaatcgatagacaaaactacaaaggcacagaaatatctactaataagagatatctaggaataagagataaactaattgcctcctaacagttatcagaagctgcacgcaccatggcatgaaccaacttagagcaagtttaataataaagccaactatgaacttatagcacatattagagttgacatgcatagtagataagctataagcttatctatatttttcttctcctctctatctcatctatacaattaacttatccatcttaaagtatgtgaatggttagctcttacatgagactgagacccaaccctcttcatttttcaaactctctcttccacataagcttacatttggctacttggcttatagcccactattaaacttgagcttattattactttattattaaactcctggtcgtcagtgcgaagttatcctcgttaactataggactatacgagcagatgatcacctccaattaaccaaataaaaccctggctagctcaataaaccacacgagctacacctaaacagtagctgccgcacaagcataattaaccaacccgacacagtgggaaaccaaagcagagagatctaccaacacaccgatagctgggggcaacccgcgcacgtgcgcggggacatggccgtgaactgaggcgcaccaccaaaaaccatctaaacttcctacggccaacccccaaccccccaaccctagcaacaaacagatcccacagaaatcaaaacacgacgaaccctagcgtcaagcccacgcccgcggaagggaccccacgggccctctcgcgctgccggggatcttccccccgcgtgcacagcggctgccccctccagatctaaccgctcccggcgctggacggcgcgtgcgggcggcgcggagtatgggtttctccgccgaatcgggagccgaagtgatgatgggagaggaggaggaggaggaggggagcaatcgctcacctcatgctgccgtttaccggtgaaggcgacggcggcggcggcgggtgaggcccgagggttttgcgaggttttttggggaatggaagatggagaatgaaggagtggagaggaagtgtcttgaagtagggaaacggaggcggtgctgcgagggggatgggctgggcttggctgggttctcgtgggccttgacttcgctgcaaccgaaagaaggaaaaagtccacaaggactccctcgaatataggatgaatctgattcgtatcccttacccataataccagatatcttgaccctcttagctattaaaactgatgcaatatgaatcctttggtggttttgaaggtggttttcgttgatgtagcatctaagtatcgcattgacttagtcttcgtcatctacgtggcattaaaaaaataaaacataatgtgtggggcccatgggtcagacgacggcgtgaaaccaacgggaccaaggcggcacctagcgaaagaagagcataaggcggcagctacctcgtcagcgggggaagtgctggccacgcacggccggaatcatctaggcgtcgttggtcttgccttggccacggtggggaggcgagagaggacgacggtagggaggactaaccgatggtggttggggaaacgaggatgatagcaaggaggccaaggcaaggggtgagaagggtatgcaacagcaaggaatgctatgatttcccagcggcgtttgcggtgttatcttctccaaagcccatggccgcggctgcggcgtgctcaacaaagagccacttgggcatcgactggagaaggaacaacggaagttgtacccaagggggacaaagggctccgagcgtcatcgtcgtccgtgatttggctcccagggtgctcgacattgcgaatggcaatggcattcgccgagcttgatatctcccccagcaccaaacccttcctcctagcaccaatgcagatttggcaggcgagcgagcgatcccgtccttcctgctagtcctggggcctcgcggaccgcagacaagctcaccaccacctccaatttctcttccacagggcactagtgcggtgccaacactcctctacctatcgtcgtcctctccagcctccctgctgcctactcgtccttcttgctcctcccaagggctctccaactactgtagcgtccctttctaccgatgaggtctgtcggtgaaatgggcccaagggtacacacagtaaagggaaatatctttcccatctagtcgcgtggccacgcggcctcgtttccccccgcccctcgggtagcgaggtggctagggggcctcggggtgcggtggccaaggggcctcggggtgccacgccacacccctcgggctttatggggcgtgctaccccggggccctcgcccggccaccacatggtggggagagaaggcgaggctaaagacgatgctccgcgcctttaatgcgcggcgccccaaccgtcccgcaccgcattcaatgcggcgtggggggacgtgcggccccgctcgattgacccatgtcaatcgagcatgaccggcttgtgactggtcacaggcgacgggacggggggcagtgcccccatgttctgctctgtgtcaggcggagtgggggcatgtgtgccctgtcccgtcggcacgctgctaggggcgccccacgcgcgtgatgaaccgccgaagtcttcatgcaattaatagggaatgacagggatgtcccccgtgtcaggcagaggacagcgctgggccccacctgaagataggcgaccatgttgcttccggttgaagcaaaggatagcggtatgattaggaccatgtgggtcccccctttccgtggaggggtaagtgcaaacggtgcatgtggtatccccttgaactataaaaggaggaccgttaccactaggaaaaaggacgattggaggagaactcaagctcgaaggaagaacaactaggttcccatcggagcttgaaatcccttgtaaaaactcaccataatcccacacacaggagtagggtattacgctcggtagcggcccgaacctgtataatcctcgatctcccacacagtcccgacagcgatcgagcaactagactgcaagcggaagtaggctcctgtcatcgtgccatttcccccggccgaactcacaaggggggggggtctcacgaccacctgctagggaggatcactcctcgacaaggtcgctgctgcctccggttcctctttcgtcaggcatcgcgcatggcgccaccactccctcccctgtcgtcatcctctccagcctccccgctacctacccatccttcctggtgctccaaggggctaaccggccccgctgcattccttctcgtttacgaggtcaccaccacttccggcctcttctgccgggcattggtgcactgcccttggtcccgccaaggcgccaatcgtcgccctgaccacaagagagtgggagggaaaaagaggaagaaaaatacaattgttgacctatgagtcccatggttttaatgttttttttttttattataacatgtcaatgcaacacatggacgtcatgtcagcaatacaactctcactattaccttaggagtaattttgtacaagttttaatagctgagggagtcattataccttgtttgacggttgagggatataaatcaaattcgatatatatatatatatatatatatatatatatatatttaatgtagtcaaagtggactttttccgtgaaagaatggcataggcctactcgtgctacaccaaggctccgtttagtggaaacatataacacaaacttcgcatgtatactccctgcacacaaactactaaatgtcacttacgattctcgaaaagtttacgcatataatttctaatagggttacacctatgtgtaactcaaactcattatattttagcctaaaaaatctgatgtttttaagaatataaatatttagaatttctctctgtatatatgatgaatttaataataaagtttacacgttgatgtaatagtattgaaaatacatgtgcatttttttctagagttttatgtgaacacgatatatacacgtgaaaacttgtgtgcatataacaaatttgctataataaaatggtaaaagttgaaagtataagggtgatataattacgtttatacgagtttaacaggctaacttgcgagtagagccaaacttagttccttaaggttaaaagagttgaaccgagcaggctcgttttgattttttttattttaagaataaatttcacttcgggccactttttattactgatgtttcactttggaccaccctttaagcaatattttcactttggagtgggtaaacctgcctttgtttcactttggaccacccgactctcttctcaagcatatgaacgatctcgattacatcatctcctactcgtcaatgaactgccacagctatatgtaagactatttcttcgacatattaaaaattggatgtagatcgataaaagagtaagggtggtccaaagtgaaataaaggtaaaaatacccggtccaaagtgaaaacattagtcctaaggtggtccaaagcgaaacatcggtaataaaaggtggtaaaattaactcttttatttattaaaatatttacataaataattttctatttgaaaattttacaaaactagtcgccctcgccgcccttttacaaaacttagtcacccaccgcccatcgctcgttccatgagttcagatcacctcactaatgtatgcataaataagtgagtaggcgatgacgaatgacctttagataaccttattcatgtatgcataaatgtgtagatgatgaaagactaataagcgcttcatgcgtgcctgcgatgtacacatttatatggatgaatacaattcataatagaagattccgttctacatatggatatggtctgttgcatccatgaatttcgaagtatttgaagatgcaccctcagtgagttgataaccaccattcacatggttcaaaaacacgagtgcatttgaagggagccacaaagatgatactacagttacacaacataaaagaaaatcccgaaaaagtgtccatttattgcagaagaggagtctatgtttatgatttgctagcagcttctgcctgttgaactgtggcaccaggttgagcagaaactgctgctgcagcagctgatggagaatacaccttagctctacgaagaatctcggcaacaacccagtgcttccttttgctcaagggcctagaaggatcaagcttaacctggagagaaattatccagtcatcatcaaaaaggtttttcttggagataaaaaattaatgcgctcttaggtcgcactttgtgaactacaaaagggggagattagtctccagcaagctgataaaatagaaaagtgcagtaggacagctcaagatcactaatatattcgtcataagagcaaatatgttagtcccaacatatttttttttctaaaaaaaaaatccctgtcacaaactcacagggtaaagttgaacttttatgctgtctttttatttatttatttatttattttaacaataggtggtgcaatcaatagtcagaacataaaagtttctgttaaatccagtcccttggtaatgtggatcttcgggcgcacaaaacaaattaatttgaataggcaaaatcttatgatgtgaatatgttaacactgttatcacatttgcataaagcaaaactaattagaaagtggcatgttaacattataactatgctttgcaacaaattatctttcagacctccgtccatgctttgccaagttgccatatcacataagatatgagaaaattcagaggcaaaagattatgccactattaaaatctagtacaaccatcattgtcaaaattctcatggaaagattgttttgcatctgatgaagtaactagcttactgaagttcagagcccccaaaaggggcctctcttgtctggagttgacactcctgattaaagggttggcttactgtttagtgtatcaattacgccaagaattaaacttcagattgtgccttaactttcagttgctaatgttatagattgaggctataaatacttgacatatcaaaaagctctggtcaagaactattatgtgcttatgattaaccctcaaatttctgaactatatgaaacaatgtacataactaacaccaaaatcaaattacaagaacacaatatttaagataacttatcacggtggaaaaaaaacacaaactgtaactcaaagagtaccactatgcagtagtgccctagtagctcatatatgaacatcataaatagaaagcagtagcatataatccaaacagttgttcactgccgagagtagtaaaatacaaaactaatactaattgaagttgttttcagaaatactatcatggcattgttaacgagcagatatgcaagcagacagagaaatgtcaactcttaaggattaggtgccatgacatgtaatgatgtcaaccatatggttgcaacctccctacaggcatcaatttaacagctggaactatacagaataggataacaatccacaatactgtaacaactagttttgttacaagtcaaactccttcaagtttaaccaagttcatagaaaaatgtatcatcatttccaataccaaacaaatatattataaaaatatgttcaatggcggatataatgaaattaatttggtgttataaatgttgccacattttcctaaatgtttggtcacaattaaagaagcttgacttaggacgaaatgaaaacatcttacatcctgaaacggagggagtagattataaaaatagctcaaaaagaaggcatcatgtgcactctatatattatattaccacattaattgaaggaaaaagtaaatatttacaccattagattgttatgagtccagagtataacggtgtagattgattattggatattataggcatttgagtcgttgacataatacaactctattctatgtaggcaaaatctggtcaagaaatacaatagaatccaactccagttccaaagcaattaggagtagttgttaaaacagatcagtagtcagtattcatgtactgattttctctttcctttgaaaggattcactcagggatgctcagaagcatacaaattaaaaaaaaaaaggtctctgacccggttcaaacaaactggctggctagacaacatcacttccatgtacatacatggtggttctggacttccagcagccatgcacattgagagaacagagaaaggcaggctagatatttaacaaatgaaaaaaagtttctgttgacatttaatcaaattttgctaaatggcacaatcaaattccagcttcaaacatagtagtacaactaaattttattcatgcaacaagcataatgaaaggcccgctgctaaactggccaatgccgcaaacatgagaattgtgttatttttgtgcaaatatagttcaagacataagcatgacaggtgcaatggtgagctatgcaggtaacctactgatcagttagttgagcagcttaaatatacagttgaaactgaagagaaacccccaacccaatctaaaagtacaatgcttcaaaaattcaagttataactagcagcattctggatggtgcttttgaggagtgacgagcaacatgacaagtagcaatttaagctaccaaggcatcaattactgtgttaactagacacagctatcaagatagcaacctcctagaagtagaaaaacatatacataaaaacacatggctcaggcagataatgcaatcagagcaaggcagggcaagcaacacatattttgttggctccaagtgatgcaacaacagatttgacactttaaagcaactacagcatgactcgagtcaaaagacaattcaatagctggattactgggcaagaggtgatcagtaggcctctggtggtacaattgccttcggaagttatatataatcatgtagaattcttggatcaaactcgcatttatatttgtaagttacaatacgccatttgtgatttcatattttcatgtatttcttatcttccaaaaccgggatagaaattgacttgaacatttctcagtattgtgcgaaaaaaaggcaagatctttcatttactcctttcacttctctgtgcataagggaataaagaaattttataagtcaatggtggtggcagtgaatcagccaccacaccaactctacagtagatccttttatcaacacattcctgaagttctttagtattacaaaacagtctttctacatatcttattccgcctctaaaatacaaatttataattcgaagctttacgataatgaaattgtcgcatatatatgcagtataaaagtaattttatgaccagagtaatgtaaaagttgtcaagtgcttcatgtaacttaaatgacaagttatatataaatgaagggtgtgttcaatgaaaaaaaaactcacaatcatttgtttgaaacaatattacgagcatttagctggtgaatgaataaattttagatgatatagcattatagccaaatgaacgacatcacaccagagaaatcaaatgctcgcatcacaaatcagcatggattaaaaaaaaagaaaaaagctgaaacagagagagggggagtggagaggggagctcggttaccgacccggtcgccgatgttacagtcctcggtctcatcgtgcgccatgaacttggaggtgcgcttgacgtagcggttgtacatcttgtggtggaagaggcggtcgacggccaccaccaccgacttctgcatcttgttcgacaccacgatccccaccaccggcttcatcgtccgtcccgcccccaccccacccgcggggagaccgcccgccgactggcgatgggatcggccggggactggcggcagagagggcggaggaggccgccggcgcggagaggggggcggcggctgcggctcgccggctgcgcaccgggagcggagacgataggcaagcacgacagtgagtgaggaggggggcgaatcggttcgattgattccaagggagaagctagggtttatgacttgggcccaggatgctccgatgttgggattttaagttgggtggcccgcgggcttagatgttgttctaaggggcccaattggggaacgaagcctgggcgcctccgccctttgtgctgttcgccgtacatgaaccagaatagatttctagatcatactcctccgttcctaaatatgttctagatcatacgccattgattttttaaaatatatttaatcattcgtctttttttaaaaacttttttgaataatattcaaaagcttgagtagtagtattatatttaacaataaatcaaatgatagaaaaagaattaataattacttaaattttttaaataagacgaacaatcaaacatgttttaaaaagttaacggcatcaaatatttagggacggagagagtatatattttgatttttcatctgtaaaatattgcattgcatcaaagatttgtgtacatgtagatttaacttgtagttatacccaattacattgcatttatacttagttacataaaacttatattagttatagtgcatcaaaattatgtttttgacaactattttttctctagatttatgatttttatgtgtttatccttttttttcattcaaaatgggttctatacattagttcaatattctgcaagatttagagttccaaatttgttgaaagatcaatagattagtctctttccagaatggtacaccaacttcttgcaaaggaaggaacactactgatctttcaatatatatgggcaaaatagaagtactcaacactttatcggctgcatttggcaaaatccttttttttttcttccgagaaatatggtacaaacatatacaaacacaagtacacaacatatgcgctcttaccctaaatgcaaacactcacaccctagtcatacaagtaccttcgaaagaccgaccgatatatcttgagattgacgaaaccacggacgactcactatcgacgggtatgtcgtttaccattataaaataataagctattcccatcaaataataataaaaactataaatatgagcacccatgtcaagtctataacttcaattgggtagattggtctaaaaaaaaacctaatcgattgaattacgcttactttgcaaaatctttttttttacttgcaaaataattaagggaacatcaacgtcttgcaagtgggacctccttagttgacatttgccatagtcaaacaaaaaggatctcacgtatacaacacgcaccgattttttattgaaaattataccacgtacgtagtcatctaagcaacttgggcctccttcataacaaaaggaaatttataagtttttgctactttggaatcagggtaaaactctaaacaatttttgggacatactaggatttttatcattttttgtaaaatcgctcgatttccaaggagcaatttttttttttacaaacggtaccacgagtctacgtagtgaattaaggactagcctagatgctttgcgccgtgaaattttttaccataataacgtggaataagtaataacacgatgctagtacaatttggagagagatggtgctgttggtgtttaggatgaaaatggtcggaaaaaccctctaccatttttatttctatatttctttttttccgaaaacggaatcgaaacggtataaaaaaacgataacgatatcagtatattggaaatggaaacgtcgaaacagaacctagcgatgttggttggaagaaaattcatattggaaacaacaaagtgaggcataatcacatatttaattatacatgaagataactttataactttattcttacatcattacactccacataataccattatatgatgattaatgatatgataatatgttcgacgaataatataaacaaagttcaataatactttaacatcgataagttgaagagaccaaagttcaacaaagcccacatgccacgccctagggttaaccgtgttttcccctagccacttcccttttctaatgggctacaagtccgccaggcttccaacattcatgagcttccgatgggttggactagctgagccgttggagaactttcagaattttctcagaattttgacggaaattaccggataaatacgattaccaataaaaacggttgaaaaaacctccatcccacttccgctatcatttccagaagatattaccatttctatttccaacactgataattgccgataccgactaaaacggtaggtgcagaccagaaatgatagccggaaatttccatactgttttcaaccatagggcatttgggtgaggggactaaggtgcatttaggagaagagaaaaagataatgcacgcaaaatgaggtatatcgttagcgtgtgattaactattttaaactagaaaatgactaatatagttttttgcaaaaaaattctatatttttttttttcaaaaaacactgattagcagttcaaaatgcacgcgcgtgaaaaacgaggaactttctctcctctgtttaacacaccgatgttagacttacagtatcagtttagaataggctgaacctttatatatctggtattcgaaagaaaaaaccacatgctcagttgtagtcatcttaagtcgtggatttgataaggatctataccatattctttacccccatctttctaacttctactcacttgttttatacgcacatccttctcaaaccactaaagggcgtgttttttttaagaatatatagaaaaattactttaaaaattatagtaatctattttcaggttttttaaactaatacttaattaattatgcgccaatgtataatacttaattaattatgcgccaatgtatatttcattttacatgatggagagaaggggttccgaacacaactttaattgtccgacaccaattatttttcttggttgtccaagtactctggctttccattctaaaatataaaatataaagacactattatttttctccatgtcttataatatatggcacgcagtcatgtatatagtactaactagctcatttaaatttgctttgttttaaatcatctaccatcaaacttccaatcacataattatttacatgtttcgaggtgatccaattgatgaggtgattaaatttactttttgtttttgtgttagtggtggttattttttatattttgggataaaaggagtatttgttttttttttgaaaaaaaatacactctagatccaggggcttagcccccggtacttttgttatagccaaccatttctcttggcttctctcttgaattcgcctttaacaaaagatggtccagtacaggtgatgagagtgtgaagagatctatccttttccttaaaaagaaagaaaagaaaagaaaaacaaagaaagaaagagtggatgcccccaacccaaccaagcacgtgccagccacgccgccccctcaccccatcacccatcaccggtcgctctccacgccagtacacatgaatcctcttcctcactcctcattgctgctgttcacccagactcgcacagttcatgctcatgcgtggaggaacggtcgttttcttttgctccttttgatagaggcgctaccgctaccttacccttacctagctaagctagggtctcccttcagtgacaatgatcaacgatggagtaattccaacgccatgagatccgtgctgttttgggtggtataattggacgtgtttggttgcctacaaaagcttttatcccgtttatgtttctatcttgttttgtaattatatgaataggaaatgcatgtgaaaataaaaaacggttttgttatatatttatcagcaaattttctaaaaacatattgtaacttgcatgtaattatagagtaaatttcacgaaaatagtacttcaaccaaaatattagaaaactacagatttaaggtcttctatcataaaactacaaatttagtgcagttagccgatgcttatttctcggatactgtcattgtcattgttcttctctgagaaaagaagttgacgacccgtgggctttcacctccacatgacattgctccatcaggctttcacccattgcagatgcttctctcatgatacaatccgcttcctgctgagcctcctttcttcttgatccacagaaaaaaaaatggagaactagcgctgacaatttatcgcggaagaaacaactcaccgaaccgagaacactaactaatagaatagtactactaacttgtactaatagatcccgcagaaaaaaaaacttatactaatagatatcaagaaatagaaacaaactacaagtctatataacatagaaaaccaagcagccatgatgggtacgtgtgcgatgaatcccgttccccctcctgatcttcctcttcatgcctgactcgttttcatcacctgaagctaaaatttctcacaaaactatagatttaggatggagtgtaaaaaaaactaagcagcaattttatcacaaaactataggtttagtgctaatttatcccaaaactataacatttatagctccaacataaagtttgcaatagggatttaaactctagaatttgtatccttgtgataacttcaatatgaaatatgtacttttaagataacttataatataaaatctatagttttgtggtacttggtcttaaatatatagttttgtgataattttaccgctaagtctgtagttttttgatacaacatctcaaatatgtagttttgcgtagtttggtcaaaatatctatagctttgtgaaatttactctatttataatgtagcttgtatgcaaatttcatatattttgaaccattagatttactctaagattcatgctagtgggaaagagaaaatcgtaacacacacgggtgaggggatttggtcccatgacttccgctttgcagaaatagctccacatggtgggatttttcaaagttatatccaagttatactatagttttatattataattatactataattacatttgataaattttgataaaaaaattgtcaataaatatatatatagataatcccaataaaaaaatacctctactaagttaaaaacggagtcgtcctccttccatcccctcctcccaccaccacggtgtgtccgtacgctgaaagtaaacacgacatccaatgttttatctttaatcacccttctagcttatctctatttatatgagcctggcccattacaattgttacaaaatactccatcatagcatatccctatttgttcggtttggccatgatattatcgttactagtttaaaaaaacttaggttccatgaatatctcacgtttggccggaactatctagaggtttaggccctgtttctttcagcttgggattattataatctagattattgagtcagattactataagctagattgttataatctgtagtagaataagcggttagttgtttctttcctagattattagagcctagattattgggtttgcaagtctaaagagggagtggggtggtattgtgggtaatttttcacccaataatctggaaaaagctcacctaaatgagcttatcagattataataagctgggttccagattataataagctacttcaataagttgtctgtttcttaatcccaagctgaaagaaacagggccttatatatgttctcttttagaaaagtttgtcatttttagccttttaaagtccatatatataaacgaacttttttttactacataattataatcagcttttgtttaattaacaaatttagctacaccccaaaacctatgttacaatgacactcttttgtaactgtggagagagaatattaactacctccgctctaaaaaaggtaaagtttttaatgtattattatcagatgtcaatatcttaaatcattgatagatgacaaaaataatattagtattaaaaatgtgaaagttaaattagtattttttttatgaaaaactctgtcatattatttatattttaaatattttctatagatatatagtttgaaaaaaaaaatcaaaaaatcgtgaaatatatagtagtagtatgctatatatatgtacctagagatcaagtaataaagtaatgaatgatggatagagtagtacggtgccatctcgaataagaacaaggtaggctcaaatttgcccgagagctttagccaattcagtggcacgacatcaagattgaagagatacaacaccttaatactccctccgtttcacaatgtaagtcattctagcatttcccacattcatattgatgttaataaatctagacatatatatccatctagattcattaacatccatataaatataggaaatgttagaatgacttacattgtgaaacggaggaagtatcttcttatggaaggtcataattttacgaaacatttaatgatggccccaaaaagattatacattaaatgtccttcttcgacatttcatttcaaaaggagtactaatgattttggagggagaaaaggacaaaggtcagataatgttggacattatgatagaattaatctaatagtctctatcatgtaaaag

SEQ ID NO: 11215 - DNA, 744 bp, Oryza sativa
  unsure (1)..(744): unsure at all n locations
tgtaatctccttgtgctagtgtcctgatctcagatattaaacttcatgtagtctgcaggttatattgaagtaacaaatcgtttcatttttcagaagtttgataatgtcactacaaatgtcatatgccatggagaaaagagtgttatcaaggaaggccacaagagctttccaagtgggcattcttcatgtaagacatgcaacgcatcggtacttttaagttttgaagtaccgttgtatgtttctgagttgatatcgagctttacatgccttgcaacatgcattttttacatctgtttctccacattctctacatacatttccaaggatttttctccaattttttcttttgcaacagttccgagtattttagtagttgcctcagccttcatgtagggcattgttcggagtactgctctccaatctgatgtgctcctggtaactatgcaggacatttatgaataaatgaaattcttgactagtttaaattcaatgctatattctcttggtaactatgtaggacatttattgaaaaattgaatttattcatgttggtacccttaacacctatatgttgtatctatgattaagactccgaggctatcaaataaatggtgtagctcatctttttcttataattgtttatacttcctcctgtacagaaaaatgtgtttctggacatcctcatgnnnnnnnnnnnnnnnnnnnnnnnnnnnnnnnnnnnnnnnnnnnnnnnnnnnnnnnnnn

SEQ ID NO: 11216 - DNA, 422 bp, Oryza sativa
  unsure (1)..(422): unsure at all n locations
nnnnnnnnnnnnnnnnnnnnnnnnnnnnnnnnnnnnnnnnnnnnnnnnnnnnnnnnnnnnnnnnatgtggatatttttaacatgtagatctcaattttagaaaaatttagagacttgaaccaactaaatcggagctaagatgaattagatatgaatttttgaagatttaatcggattaaaacacttatattgattttaattgaattatgacgcaataatgaattatttttgaaaaggaaaaggggatttattgcgtcagcaggctagggtttgcggtggaccgggcgcacggcggcggttcacacgaacggacggccgagatcgacttgatccaaaacggacggccgagatcgatcggtccacgaccggtctacgacgaacggccccgatgannnnnnnnnnnnnnnnnnnnnnnnnnnnnn

SEQ ID NO: 11217 - DNA, 1580 bp, Oryza sativa
  unsure (1)..(1580): unsure at all n locations
nnnnnnnnnnnnnnnnnnnnnnnnnnnnnnnnnnnnnnnnnnnnnnnnnnnnnnnatttcaaaaaaaaaagaagtttgttaggcataactcaagtaatgcaaagtgctaaataaattttacctctaaaacattgcggagcgtgttctccgtgtcctcaccacccctcggagattggagggcatgccccatttcattcacactcctgaggagctctctcaactgaaagcgtgagaagatatatgttggggtctagggtgcaaatggaagtaactttgacaaatgcaagaaaacttacgactctgtctctaagtggggcgtgctccatttgatatccaactctagtccagacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgttccttccggctgttctccattcatcaatgtatctattatgctctagcccccagtctttcacattctttgttctcaccctgtcatacctagacaagtagaaggtgatgaaacaatagtgagcatcgacaagggttaaatggtacaaaattgaacattgacaatgaaagcaaacaaagataagaaatatttacttgtgtaattcaactccagttgagatgtcctcaaccggccaatcctgtttcttcccgaactgtcacatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctacaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacatctgaatcaatagcacacaaccactcatgttggatgatggtgcctgacgacaacaggcctcacagagctgtctatatgtccacgccaacactgctgagccctaactgaaacggcccagatcaccaaggttggcgaccaaaggaatccatatcgccgaagcaatgtcacccccagcatcaagaaacagaacctctcccaacaagtgcaagatgtatgcacgggcataacactcaacacgccatggctcagcatcgtcgtcaagatgtgagaagttctgactcagccaagacaggggtattccattctgttcttcttccccccttgcccctgctcaatgttcagtggaatgccaaacagctgctgcacttgtgcatgccatccaggagtctctgtcctgcc

SEQ ID NO: 11218 - DNA, 1540 bp, Oryza sativa
  unsure (1)..(1540): unsure at all n locations
atcacatggtattgtgttgttttaaccaatcaatcactttaagaggtgtgttacacaattagacatataaagaggggatgaaaattaacaatacatctctctacagattgacatcaaacataatcaggatatgattcattcatgacgtcctcatacaactgtccatgcaacgtatgcataattaaaaagagtggactttcctcatagagtggacttgatatatgtgcaatataaaaatattataagaaatagtttgtttgaagaatggaaatacatttgaattatgttcacctctataatgtgatgtggactagggttcccgatcttccgaaaggttcagtcgatttgggcggagtcacgacacaacttaatccggcttctgaatgaacacgctcttgagccccacaatcgtagcaccacgtctcctctggttagcacccgtgtcgaaacacggatgacctgccgagaaggctaatccctgtttgtgaatcgaagaacacaaacaagaacaaggaagaatacagccaaaattgcagatgaatgattaaactcacaagttggggtcttacaaaccgatctagcggcgaaactgttcttgacagaataatctaagcaaaaccccaaaccctaaaggtgacgggggggtataatatatagagtttatggtcgtgcaaaaaacccttgacttaaccctaatgagttccaacacgatacacggcccaaaggcccaaatacggtgacgcggcaccggaacagattttgaatgtcaaattgttagatcgattcccattgactcagaaagaatttggacgtggaaccataaccattggaaaggttatcttcttagctttacatccatataaagaactccccaatccgagcacgtatgcgacctgggcactcgttttagtgcagactggtcctgaactccgaatcgtactcgaagtcgacttgttttgggcctccaccttaacttggacgtccttgatgatcatccatgcctctaagtccctctccaagtgtctccttgtcatcttcattgttcctaatcacaatataatcattaggtagcaatctattctcaaaatcatataaaggagaatataggaacgagctcagctctaaattcaattgtcacgcacgaactcttgttattggtccttgaatgactgatggaggattgttgttgttgtgtgtattcgaaggagtgatgtccttatcataatgtgtccaaacaattacatgataaaatggggctagaaggatgcatggtgctttcatcatttctcattttctatgaaatgcttgatgaaaggtttttttttttgggagtactattaataaggaccattcattggacatcattctatccgaaaatggtacctagcatagctcctgctctatgaccaatcggtacacccctatgtatttttcccacacatcagtcgtgtgaaccctcccaatcaccatgtgcccatggtnnnnnnnnnnnnnnnnnnnnnnnnnnnnnnnnnnnnnnnnnnnnnnnnnnnnnnnnnnt

SEQ ID NO: 11219 - DNA, 1278 bp, Oryza sativa
ccatgggcacgtctagcaaaacgatgcacccacagcccaccatgtagtgtattttaattagccaacaccattgcggtggcactaatccagagctattgccaataatcaagtctatgctttaatgtggtccccttttatgcactagttgaactaagcatggctaagcatctcctaaaccaacatctagtcattttaatacccaagttatcaatggcataaggaaaacaacatatagctgagtaataggacccatcccacatgatattgtaaaacaatgcaatatttaatagaaatgcgggacatttgtaaattaggtacaatatgatcaattgtattgcatgacttgccttgctctcgcactgatggaaccacagcaacgtcttcgagaaaccacggatcgacgaaacggccgaaatctacgtgacaaacaaagcacacaagcaaaacatgctataagactactgaaacagataacaaagccatttttaatggattctacacatttttatgaatttactgagacttgaatggacttaatcggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaaggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcgacgaccgaaagcgacggcgagcgcgcgaagagggcggcggcgcacggggaaaaaaaaaagaaggaaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaacccccacggcgaccatccatgccggccggagtcggaggggagagagaactcaccgacgacgcgagggaaatggggtttcggtggtattccggcgacgcagagcagcggccgggaagggtcttgcggcggcgaagctagtggtgg

SEQ ID NO: 11220 - DNA, 5728 bp, Oryza sativa
gcagcggtttcggcgggacggcgcgagcgggagagccgggaggtgggatacgggtccgacaggtgggccccacctgtcggcgaccccgggagggagggaggcggcggccggctgggcctcggcctgcggccggcccagcagggaggagggggaggaaaggaggagatgggccggcggcccatccgaaagaaaggaggaaaaagagaaaaaaaagaaaaagaaaaagaaaaaggattttttttcctggaattaaaattgcactttggtgatttttaattggttaaaattatttctagggctctgaaaattccactaaaaatcctgttagtgagtttcgacatgtagaactcaagaaaaattccacatgccaaatccgattattatttgcattgattaaatagggattcatctctaggttaaattaaacaatttcttcggacgatttattttatgaatttagagcaagggaggggtacttcagggcgtgacacctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccttctaaaaatattggaaaagtagaactgttctcctccctttctcttttaattgaaccaaactaatggcacatgcacttcataatctcttttaatggttctcattcaaaaatttattccagtgttattagtaccgtacatctattactgtactaatggctcattttatcagcaaaagttttacaatattgttttatttaatcttgctgcaataaaataaatttagcatgttgattttataagtttctttcatttcttttgaaaccagttattcaaaagtacaaaatttgtaacctggtttccaactgtttcaacttatctcgcaaagcttggtttactttatttacttacctttttactttgaatttctaatctttattcaaattaatccaaaaacttgtgctattaattggataaatgtcttaactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcagttggccgacactgagtatcgctaccatcctcgccaaccccagggaagtgaccgtggcagttaccttgagactgaaggaattgagaatgatgctaccacaaggcatttggttgagatgctgtgggctatggatgaaagccgcgcggagactgtgttagcagctcaagatcgtgaagattggaatcgtggtaagatttgcaagttagaagacaaggtggatcgtttggagaaggaactagccgcattgaagggagaagcaccacctcaaaaggccaggattcgtcttaccgcaaggaagagagctctatttgtccctcgctatcaattggcgccaaaggttcgtgtggtggagaaagaagttgctccaaccttagcagatcctccggttatcatcataagtgatgatgaagaagaagaatccaagcgcaaccattccaagattgagtgggtagctacccaagatgatgaagacgagccgaacgagccttcaatcgacctccgatgctcggaagaactagagtgccatgtctagccgttgtcttagatcgttgtgttagtttgcttgttttaagtttggttgtgtgtgtgtgggtcttgcatgtgatttacatcagtggtgggatgtaagtgcatgtgtttgtttgcttttgagtgttaggaagttggtgagtttagtggtgtgagagtcttcagtttgtaataatgaaactcagttaagatcaataaaagttaaagtaattatctgtcctaagtagtttcccccggtttctcttcttgtgccctgtccatgccagatggtgaacactcgcagcaacgggaatggccccaacaacaacaacaacaataacaacaacaatgaagggaacccaacccttgctcaagttcttgctcaacagactcagttaatgaacatgatgatgcagcaacttcagaatcagcaaaaccagggaaataaccatgcacctccccagaacaagttagcagaatttcttcgtgtgaggccgcctattttctctagtaccactaatcctgttgaagctggtgattggttgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgaattcaccgctgctttccggaagacgcatataccatcgggagtggtgtctctcaagaagaaggagttcaggtcgctcacccagggatctcgctctgttacggagtatttgcacgagttcaatcgtctggctcgttatgctccggaagatgttcgcaatgatgaagagcgccaggagaagttcttggaaggacttaatgatgagctttcttacccactcatgactggagattattctgatttccagaagttggtggataaggctattcgtcaggaggacaaatacaatcgcatggagcagaagaaacgccggattgctcaattcaagacacaacaggggaataatcagaagccgcgtcttactttaggaccccagtctgtgccacaggggggttcttcgtctgttgttcgtccgcagcgtcagttcttcaacaacaatgctggcaacaacatccgcaatcaagctccacgtcctgttgcagctccaacacagcaacagcctgccaagagggagcaaggcaacaagcccgtggtgtgtttcaactgtggagacccaggacattatgctgacaagtgtccgaagccccgacgtgtgaaggttgtccctgtccagagcagctctaccgcactagcattaaaggcccgtgtcaatcatgttgctgctgcagaagctcaagatgctccagatgtgattttgggtacgtttcctgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctccttgcaacgtagcccctctgtcagaatagaaattcaaggagtaccatttctggccaatcttatactgttagaatccaaagaccttgatgtcatcctagggatggactggttagccagacataaaggtgtgatagactgtgccaacagaaaagtaactctcaccagcaatgatggtcgagttgtaactgttcatgtattgtcttctgagtctttaaggtcaagactgaaccaaataactttggaagagattcctatagtccgggagtatcccgatgtgttcccagatgatttacctggtatgccgccgaaaagggatatagagttcagaatagatttggtacctggaacaactccgatccataagagaccttatagaatggcagccaatgagttggcataagttaagaggcaagtagacgatttgcttcagaaaggatacatcagaccgagttcatctccatggggagctccagttatttttgtggaaaagaaagaccatacccagaggatgtgtgtggactatcgtgccctaaatgatgtgactatcaagaataagtacccgctacccagaattgatgatttgtttgatcagcttaaaggtgccaccgttttctccaagatcgatcttcgatcagggtatcaccagttgagaatcaaagaggaagatatacctaagacagcttttaccactaggtatggattgttcgaatgtactgttatgtcttttggacttaccaatgcccctgctttcttcatgaacttgatgaataaggtgtttatggaatacctagacaagttcgtggtggtatttattgatgacattcttatctactctcgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgacctagtaatgtggaatccgtaaccaactggaaacaaccgaagacagtttcagagatccgcagtttcttaggcctcgcaggttattatcggaggtttatagagaatttttccaagattgctaagcccatgacacgactgcttcagaaagatgtgaagtacaagtggtcggaataatgtgagcagagttttcaagagttgaagaatcgcttgatatcagctcctatcttgattttacctgatccaaagaagggttttcaagagtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacagaggtgtataccgatcacaagagtttaaagtatatctttactcagccggatctgaacatgagacagaggagatggttggaattaattaaggattatgacatgggaattcattatcacccgggaaaggctaatgttgtagcagatgctcttagcaggaaaggctattgcaatgctacggaaggacgacagttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcatggaggatgagcaaggaactgtatggttgggcgagagaatctgtgtccccgacaacaaagatttaaaagatgcaattctgaaagaagctcatgatactttatattccattcaccctggtagtactaagatgtaccaggatctcaaggaaagattttggtgggcaagtatgaagcgtgaaatcgcagaatacgtagcagtatgtgatgtctgtcagcgagtcaaggcagaacatcaaaaacctg

SEQ ID NO: 11221 - DNA, 1161 bp, Oryza sativa
  unsure (1)..(1161): unsure at all n locations
nnnnnnnnnnnnnnnnnnnnnnnnnnnnnnnnnnnnnnnnnnnnnnnnnnnnnnnnnnnnnnnnnnnnnnnncgagtcaaggcagaacatcaaaaacctgccggtttgttgcagcctttgaagattcctgaatggaaatgggaagaaatcggtatggattttatcactggtctacccagaacgtcatcaggccatgactctatttgggtgatagtcgacagacttaccaaagtggctcatttcatcccagtgaagacaacatattccggaagtcggttggcggaattgtatatggcaaggattgtgtgtttgcatggcgttcctaagaagatagtgtctgatcgaggcagtcagtttacttcaaatttttggaagaagcttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccttatgcagaatttccgtataacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggcccagtctcgacataagagttatgccgacaatcgccgcagagatttgagttttgaagaaggagattatgtgtatcttcgtgtcacgcctcttcgaggagttcatcgtttccacaccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtattttggaaatagatgagagaaggaccaggaatcgagttatccgcttttgcaaagtccagtggagtaatcactcggaagaagaatcaacttgggtcgagaagatgaat

SEQ ID NO: 11222 - DNA, 383 bp, Oryza sativa
  unsure (1)..(383): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatctgagttgccacaaagtgttcccatgagtcaatctgctcttgaaagttcttcagaagacgcagactttcttctctcattggaccaataacggcagagctttctaccatttcagatagaaccgaaatttatctgtgatctcatgaaaatttttatttaaactagcctcttccagaa

SEQ ID NO: 11223 - DNA, 1278 bp, Oryza sativa
gtaggtcattcaacagtggcagaaaagataggaaatattacatccgtcaccaagaccaagtagcatatacacttcctaaaaggcgttgcacccagcgtcaaaatatgtgccaagtgcaccgggtgatttatgaaaaaaaaatgaattttccattcggacatggcaggcatcacctgaagcatgttcaagctagaaacaatataaccagggcaactgtgcacgcatgtcatcatgcccatttttgcaacagcacacgacactataactgtagctaccatcatcctcacctttgagcttgccatcacctcttgcatctcccactcaggtgctttctcacttagtttgtcacctccaagctctagccatctaagtatctagtcgttcctaaactataatcgaggaaaaaaaatgtatttgttcaaggaaaattttgcagtatttgcttatgctgattcttctcatcatgcttaaaaagaagaattggaacatagaaatatgtggctttcatggtgttgacctaaagccactaatatcttgcttgatagcacccttcaaaaacattcttctcttcaagacaaatagtcaataaatttaaggatctaaaaactattgaaggtcaagatcctactatacttatgccttttttaacagaacctcatggatgtatgttgataatgtgataggcctatgaaagtatgtaactctgtatgtaacacatcactttttgtaattgtgttcaagaaaaataactttgtagttggatatatgcaactaatgtttactttgaaaagacaataagttccagatttttcaacagagttagatgtattgcccccactccccagtatacatcatgcctgtcaatgccatatccatccaacttggcatatggcaaccaaattgaccctcaacttacaatttgcaggaaaattccaaacaagagtagtttcagcaaacaccatcgctctctccccatcccaaatcactccaaaaacttgagccatgcatttacatgattccaagactctggccaccacttcctaccatctcagtgtttagtttcaggcgaggaaattctacatcagcagaaaaagagttgcagtgagagaaatctctgctcaccccgggggagagatcgaacccgatggcgttcgtcccgactcccgacagaagcatcagcgggtggttcctcgccggcgcctgcacgaacacgggcgagatcaaatcaaatcaagcacggctctggaaaatggaaaacaacgggaagaagcaccaccg

SEQ ID NO: 11224 - DNA, 427 bp, Oryza sativa
  unsure (1)..(427): unsure at all n locations
nnnnnnnnnnnnnnnnnnnnnnnnnnnnnnnnnnnnactgtaacatcggcgaccgggtcggtaaccgagctcccctctccactccccctctctctgtttcagcttttttctttttttttaatccatgctgatttgtgatgcgagcatttgatttctctggtgtgatgtcgttcatttggctataatgctatatcatctaaaatttattcattcaccagctaaatgctcgtaatattgtttcaaacaaatgattgtgagtttttttttcattgaacacacccttcatttatatataacttgtcatttaagttacatgaagcacttgacaacttttacattactctggtcataaaattacttttatactgcatatatatgcgacaatttcattatcgtaaagcttcgaattataaatttgtattttaga

SEQ ID NO: 11225 - DNA, 1472 bp, Oryza sativa
  unsure (1)..(1472): unsure at all n locations
agaaacattagctcatgattgggataacttatgactcactgttattaaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcagagataagtccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccccacctgaactaaccagttccaaaagctaactagggtgaaactaatcacggtgaatctggtcgcccgcccataaccgcggnnnnnnnnnnnnnnnnnnnnnnnnnnnnnnnnnnnnnnnnnnnnnnnnnnnnnnnnnn

SEQ ID NO: 11226 - DNA, 632 bp, Oryza sativa
tctttcacatactttgttctcaccctgtcatgcctaaacaagtggaccgtgatgaaacaatagtgagcatcgactagggttaaatggtacaaaattgaacattgcaatgaactcatacaaagataagaaatatttacttgtgtaattcaactccagttgagatgtcctcaaccggtcaatcctgtttcttcccgaactgtcacatgacacggtgcggaaggtggtactcaactgcccagaaacaaatcaatgggcactggtacatgaaatagtcagagtctcgattgcacatcgagttcagggtcaggcttgaagcctcatttgtgtggtatggtcaccactcaatctacaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagattaaccacatccacatctgaatcaat

SEQ ID NO: 11227 - DNA, 706 bp, Oryza sativa
atatagcaaacaaagtacataaatagctaggtattcttaacacaaaattttattccatcttgatcattctttcttcatcttgccaatcatatgtagttcagaatacgaggcacatcagcaatcttgactggcttcagaatataatcctttgctcctccatcgaagcacctccaataaggaaaaaaaaagaagaaaaaaggagcacatattaggatccacaagctcagatgagaatttatcaactaaagaaatcaaggtatacgttttcatacttactttctgatcctttctgggatgttatcagaggaagcaattatcaccgggagatgtaccagtctaggtgatttctaaaagtaaaaacaagtcaaattttaacatgtaaaatatttgctagaaacattgtaatatatatatgatgaaaattaacactatactccgatccatgacactattgtacgcaccttcacttccatgagtaagtcatagccggtcatctctggcatacaatagtcactaacaatcatgttcacatcatgttcctgtgtccatcagagataaaaacatgtttgttgtatgatatgtaaataaaattacctaataaacaagtagaaaacttttaatttaccgagtccaaaaatactaatgcttgcatgacactttctactgcagtcactgcatatatcaaacatggaaacacttaattaac

SEQ ID NO: 11228 - DNA, 203 bp, Oryza sativa
gctgctcctgctgttcgttatttattcctcgatgacggcgagctccggccggccctcgccttccgggatcgccaccagcaccggccgccagctccgccgcatcagcaggctccgcagcccgccggaaccgaacctcctgcctccaccgccgcctccgcctccgccgccatgacccgacctgaagccgccaatgcccccacctt

SEQ ID NO: 11229 - DNA, 1270 bp, Oryza sativa
tgatactcccatgcaaagcaatcaacatactctttaagtagctcgattatcttaaccttataatcgcactctcatatttttgtttacaaaagtcggccttggtttggttccatcacctatgtctactgcctccaacggatcggccgatgtaaacccttgtccaagcttctccacttcatcaaaatcttcaatagtttcaccaatatcgttctttgtagaccgatatttttgcaccctcttttgtaaccactctaaattagcctctttactcattatacaaatttatatggcttagccgtgctacactagccagctttacagagataggtacaaattttccatcggagatactaataaaatcatagctagaaagattcctccccgataagcattgaatattcccatgacgccactcaaaagtagcatcggccattgcaacctcggctgatgtatccgcttgaacaatttcaacatcatcgccgtcccattgaattaaacattgatgcaaggtagaaggcacacaacaattggcatggatccaacaacgacccaaaataacattgtagttaccttgcacatcgacgatgaagaaagcggttggtacgtcttgttccccacggtaagttctgccgaaaagataccctccgcctccgttggttcaccattgaagccattgagaatcatgttggtcttcttcaactcatcatctccacgcccaacttcttgaacaacgagtacggcatcaaattcacggcggcacctccatccactagcatcctagagaccgacttcccatctatatgacctttgagatagagaggcttcatatgacggtttgactcatcggcttctcaaaaaccgcatctttaggacctagtgaaaattgagcaacctcagcttcatccatagcacaaaactccataggcaacatacacgccatgttgacctccatgtcttcctttggagatgcttcatctttagtaactgattgttcttccttttcctcttgcaaaacaactggttcttccttctctacgaatttactcctccataccggtggtggtcacaactcattgaacctcctatctctttgttcttcggcctttttctctcttatctcttgagcccgaagacgttgcaaccttctccttggagtagccgtcaaatcctcaggcatccacctaggtttctgctttgttccaggaggtaaatagaaacccctgttaagtctatttgaagacgaggaagcccctacattgcttcctgcaaa

SEQ ID NO: 11230 - DNA, 693 bp, Oryza sativa
aagcttaacaactcgcaaccaaccgttgaatccaccaattggtctattcgaggagagggaagtggtctttggggcacgccttgttgagatcggtgaagtcgacgcacatcctccacttctgttggctttgcgtactattactggatttacgagtcactctggatggaggacttctcttatgaagccagctttgagaagtttgtctagttcttttcgtatggcttgtttttggtcgggtgcgaatctccgcagtttctgcttaactggcttggcatcgggtcgcaacatcagtttgtgctcaatcacctccctggtactcccggcatgtctaacggttgccaagcgaacacgtctgcattgtctcggaggaaggtgatgagcacgagttcctatttgtcgtccaacgatgccccaatcttgacagttttgtcggggttggagctagacagtgggatgatcttgatggcgccatctggttttggtgtcttcttgggcttgctcactttcttggggttttcggttgtggcgggcgggttaggagtatgctcgaccatgtcgaggctccgcttgtcgcattgtactgccaacttggtgtctccctggatagtgattgtccctttcggtcctggcattttgagcacttggtatgcgtaatgcaacgcccccataaatttgcgagtgcagtcctcccaa

SEQ ID NO: 11231 - DNA, 3258 bp, Oryza sativa
cttctgggtgaggcatcacaaccagcacctcgatgccccgcctaggccactggcccacctcgaggccacccgctgactagcaccccaaccatctctctaagccaaagaacacctccgacttcctcactcccgatccaccccttgccccttcccacaacctaccttgaaactctataaccacttcggagctcattgaaactagaaaaggaaatcgtggagaagttctggaggttagaattttgagctattgttcatctagaatatgccaagtgatgtatagcaattctgtatgaacatgtgtaacacggacggtagccgagcccaaggtggtcgattcaaccctcctgtcgatctttcagaattaaaaaaagtatgcgattgattaaatttcaagtagaagagaggaaattcatatgggttatttaattacataacttcagagcttgtttggtaaggctccacctttagagttgaagcccaaccaaccaaacgacttcagctctacccaaaaagaaattagtggtgaagcctaaccaaacgcttttagctcaacccaaaaggagcaggtcaggctacaacaatttgataagatgaattacagaggtggagcctaaggcccctaaagcctaagggcatgtttggtagggctccaattcctaaatctaactctaggagtaaattttagaatggagatgtggtatggcctccaccctagcttctagttaacatttttagatcattctagcccattactctctttttaggttggaactgaaaccatttggtttaacttcagctccagatgtgaagctggaattataaaccctaccaagcatgccattagtttaactttttgaaaagaactagttgaagctagtggttttgctatttgtttcaaagaatcctatgttttaggacaaaatgtttcaataaatcccaattttatgtaaaatattcatatttcattattatatatgattgttttcatataaattcacattagttgactcaaaatatgtgccccccttctctactttgtcattgtccttactttcatgccacactattattgcaaaaactcaacataatccaaactaataatgacatgataacatgttacatatacatatatacacaaataataaaactatcggtaaccaatgcttgttaaaaagaagcaagcgtgtataaatactttaaaaaatatcaatacatttcttttacatttattatggataaaatatatcagccaaatgaatgacataagcttgtacatggagtcttacggaacattttacccaaaacatggggtctcatgaaacaaatcacaaaacctgatgttttagttatgtatgccccaaaacctagggttttgtgaaattcactcaaattttttcaaggcgtggttgttttttattcgttgccaaattctttaggtgtttgagcttatagtgttctcttgcaaaagtttgtagcaaaactattttttgcagcaaaccaaataaatgttaatccctaataatattttactcactccatctcaaaatataacaacctaattttaggatgaagcctattaagattcatagtacttggtgtataattgagtgctaagttgctatatatttaaacggagtgagtaactatcatatttcgagtttaggttgcaaaacataattaccatattgcccagcgaggtttcatgtgactcccttttgtttatttttttagataatagaatataatgtcccggcctttactcaaacagagctacagccaattattacatagaagcattcaagaacatagtgtagatctaattaaatagaacaaaccgtaacaaaaataaagaatcgaaactaacataaggagatcacaattattgaagactcccttttgtttataaaaggtaacttttatatatgaatttaaacataggttttgtctaatcatataatggataaaagttgtttttttcttttttaagggagagagtaggaaagaagactcgaactgtcgccgtctttagttccaaaataattcttcaaacttcgaactttttcatcacatcaaaacttttctacacacacaaacttccaactttttcatcacatcgtttcaattttaaccaaacttctaattttggtgtgaactaaacacagcctacatcaagcgacaaagaaagcgggctgggccacatgatgcagagccccataaatgattgaaaaggagcgtgcctttgtcttctggcccatttttgtctcttcgataggctattgagtgacaagcaatattatgtggattgtcttacagccactcaaaattttccagttccttttctcctctcaaaacaaaacaattttatgtttttagcatttctgatagtggagacggcattagctaggcaacctctgtggacgttgttttcatcccctttcgacccggcaataagatgcgatgatacagttgtgtcatcatgtgattggtagagggacaattttaaatgaaaagaacagaggccattcattctataccacaaaaacgcatactctgttttttttagagcaacaaaaggtcactgggcggctggaatgaggtcattcaatgcttgaactctatgaaatatgaataatatactgtagaggccttcgacatgtcctctaagttttacgaattctatctagatctaaatatatggtactatgatgtatcatatctattcagatttgtagtcacatcatatcctagatttattatttatggaacagaggggataaccgtaatcttgctcaatcaattgagacatactcattccattaaaaaaaccaacctagtattgaaggtgacattctctagcacacgaaagattcattgtactagaaaatgtcacctctaatgctagattcagtggcggacgcaggattaaaataaagatggggcgaagttgctcgtctcaataagaacaactgttgtaatcatataaacatatagtataatcaataaattaatgcaaataaaaaaaatatattaaaataaagtaacattttttgcgccatacataattcatcatacctaaaaagatactagtaaacatatcaatttgcaaatatgagtcaattcataaagcatggttgatagatatcttttaaaaaataaatatatgagaagatatcgcatacccagaataaaatgattattattttgcttagaagggagagagagaaaaacattaggcatctagtaggggacggggatgag

SEQ ID NO: 11232 - DNA, 835 bp, Oryza sativa
gacttctagaaagtaaaaaaaataaacccgttgataatcatattagatttttaaaatctcaatgacaataaaacggagaagcagcgggcggggtgtataagagtatagttgcagagccgccgacggttgacaggacttctagaaaataaaaaataaattccaactatagttatgtttgatttttttaatcacaatgataataaagagtagacagcggacgggctatagaggggcatagtggcattgttttatgggacttctaaaaattataaaaagtaaaattataagtccaatttttaaaggctcggaacttctaagaagtaaaaaaacaatgataatcatgttcaattttaaaatcgtaatgacaataaagaatggaggcagcgggtgagccgtaaaggagtacaatggcaaagccgctaacggtttggcgggacttctagaaagtaaaaatgaacccaaacgataatcatgttcgatttttaaaatctcaatgataataaagagaagagacagtggacgggccgtagagtagtataatggcaacgtttgacgggacatctggaaattataaaaacgaaacccaacatgacaataaactctaaaaactataaaatctaatttttaaaggttacaagaagaatgaataaaaatagtaatagatcgagcaaacaaataaagaaggagataacataaggggtagcaactggtgtaacttttaaaaattatataattagaaacacgaggatgctaagatttggtctttcaaattcttaaaacaatgagatagctatttaataaattttaagtaaaatcatactaaaagaatatatga

SEQ ID NO: 11233 - DNA, 17762 bp, Oryza sativa
atatatatatatatatatatatatatgaatgtggataatgttagaaactcttataatatgaaacggatgaagtaatattttagagaaaaaaaatgaaaactaaaactacacgtctaaccgagggagtaatatataagcaggcattttattcgcgatttcgcatcggtttcttcgtcaactgatccaattaattcatcgatcgtccctgaattcaaacagtacttacattatatagtttggcaagtaacacggaaattaacgtcagctctagcagctatatatatataacattctacctgttcagacaaacattcaatcgtgctcgattgacctcactaattcatccctgtaaccagctaccacttcaattttcccgcgcaaacgccttaataattagatcgagtacgataatctgacgttcttgtgctaaccaaattataaggggacgatcagcctaagtaggagtaggcgagtagctatcatccgagacaatggggttcgcgtacaggatcgcgagcgcgtcggagtacctggcgatcaccgggtacggcatcgccgacgtgaagctggcgaagaaggcgtgggtggcgccggggcagcggtgcacccgcttcgatatctccccggtgaactacaccttcgaggtgcaggccatgagcgccgagaagctccccttcatcctcccggccgtcttcaccatcggcccccgcgccgacgacgacgactgcctcctccgctacgccaagctcatctccccgcacgacaagctctcccaccacgtcaacgagctcgtcaagggcgtcatcgagggtgagacccgcgtgctggccgcctccatgaccatggaggagatcttccagggcaccaagtccttcaagcaggccgtcttcgagaacgtccagctggagctcaaccagttcggcctcatcatctacaacgccaacgtcaagcagctcgtcgacgtcgccggccacgagtacttctcctacctcggccagaagacgcagcaggaggcggtgaaccaggcgaaggtggacgtcgcggaggcgcggatgaagggggaggtcggcgccaaggagagggacgggatgacgcggcagaacgccgccaaggtggacgccgagacgaaggtgtacacggtgaagcggcagggcgagggggcgaaggaggaggcgagggtgaaggcggaggtgaaggtgttcgagaacgagagggaggcggaggtggccgaagcgaacgctgacctggcgatgaagaaggccgggtggcaacgacaggcgatggtggctgaagtggaggccgccaaggcggtcgccattcgtgaagccgagctgcaggtggaggtggaacggactaacgcctctaggcagactgagaagctcaaggccgagcatctcagcaaggctgtcgtcgactacgagatgaaggtccacccatctaaccatataccaccttcagtttttaatatattataccattgactttttataaacgtttgaacatttattttgttcaaatatttttacaggtatgaaaaaattaagttatgcttaaatagcatttgacaataaattaagttataataaaataaataataattacataattttttaatataacgaataatcaaatgtatctcaaaaagttaacgtcatatattaaaaaaaagaacagtgtgagtacaatcaaaactttaaaactacattgactatgaatgcatgttttagtttattaaaaaaactttcacaatacaatattgcttgatgacctataaatagtcaaatgtcgtataattttgaccggtgaaagagggaggtaaacttttttttttctcttgaggggatgttgaaataaaattttaaaaaattctctggatttttctcctcgagagaaatagaatatatgaatttttttattaatgtgcatatttttggttaatatgaaaaaaagaggggatatccttttgagggacaaataaactttctcgctgaaatagtacataaatctcgattactttgatgtgtacatttacactatgccatgtgattaaaaagggatttgctaaccgttattcaacaaaaaaaaattggagaacaaatcttactaattttggaccatcttatgggcatatcttaaagatttatacaccaaacttcttaagctccggcaactcgttgcaatggggcgatgaccccacctagttaggatttagagcagggaaagaggaaagaggggcaattccatggcttatagggagaacagggcaccgtcggcctagcggatgcatggtatgagcgattaggaggaggaggttggcgacgacaaggccaccaatggggctatgtattgcaagcagcggggggcatcaactggtgaactgttaggaggcggcagttgagagcagctagaccaccatcggcaacaggccagtggtggcatcacgtatttcttgacgatgttgacaacgaaaaaggcgatgggagggagggcgggtgggcagcgtgggaagtgaatcggtcgctggtagcggtggatgggttaggggaggtagcggtggatgggttagaggagctgcggtagccaggggcggatccagcatgggggcggcgaggtctcgaacccccactaaatttttttaccatatgtagataagagtgaggattgtaactctatctagtttgcttagatcctattgctatttctttctggattcgctactggcggtagcttatgtgtaaagaggtggatggatcccaagtcccaaccactgaaactaaattgggtggctcaaaaattcaagcgatagagcttcaaaatttgtcaaaggttatataggtagttgcctaaaaagaattgttgtacatacatgacaaatctgattggaaagtgtgttttgtgcagggttcaaattttcggaccgtaatttttgaagtttcgggtctatcggacccaatacaaaattaattattccacccaagttttttttatcgttttcatattatttttgtgaatttggaaaattttgttaaaaattcaaattatttcaaaccgaaactactgcaatttccaaaatttgggaaaattcggtcttatgggtaccccgatagaaataggcaaaataaaaatttgaacactggttttgcgcatggcttatgcgtgtatgtaggtgcaagaagcgaactgggagctgtacaaccggcagaaggcggcggaggctctgctgtacgagcaggagaagcaggcggaggcgcggcgcgcgtcggcggacgcggccttcttcgcgcggcagcgcgaggccgaggcggagctctacgccaagcagaaggaggccgagggcctggtggccatgggcgacgcccagagcgcctacctctccgccatgctcggcgcgctcggcggcagctacgccgcgctccgggactacctcatggtcagctccggcgtgtaccaggagatggcgcgcatcaacgccgacgccatcagggggctggagcccaagatcagcgtgtggagcaacggcgccggcgccggcggcgaggtcggcgaaggcggtggcgcgatgaaggaggtggccggggtgtacaagatgctgccgccgctgctgacgacggtgcacgagcagaccgggatgctgccgccggcgtggatgggcactctgactggcggcgccccctcgtcgaccagttgaccttgacgcgttttcgatatttcccgtactatgtgtctatgtgtatattgctgtgtaactgtatatatatactcccttcgtctcataaaaaccgtgacacattctagtaatagtactacgaatttgaacatacatctgtccagattcgttgtattatgatgtgtcatatccatttgttttttgtcagaaggagggagtatgcatgctgtgtgtgccatgtgtcctcttcagtatgccttggatatgtatgcttgtatttcatcagaagaacaaatgtatgtactgattgtgtgaagatttacatgagtatataactgcatatatattttgatatttccaaagacaataatcgaaagagaccgtcagcgagttgaagcccttgccaccaaggcccatcgctgctagatctggcattaattagtgggatgcaggacaagtattttctacatggcactcttggccttattgctcagaattaataataccgatgctgaatgcatgcagcaacagtatatatatacgataataattaacttcttcttatacattgatggagttgtcatcgtcgtggttgagtgtcggctggcgatgggcgacgacgacgtcgatctgctgctcgtcgtgcactagtacatcatgttgctcgggaggcggctggcgcgtgatcccggcgtgcgtgcacagtgcccagaggcaggtgatgaggtcggcgccccatgaggccaacgccttggcatggccctgcacgtcgttggacggcgcgaggtagatgacgaggtgcacccagaggcgcgccagctcgtcccacgcctcgtcggcgggcttctccctgagccagtggaacagctttacacctctccgcaccgtcgggtcttggaacgaattctcccactggtcgcctgatatggcggtcttggcgatcttcttcttcctgcaccggcggctcggcgggcacgcgcggcagccgcaccgcctggacgcatgatccaggcagctcctcgttttctcgtagcagctggacacccacgtctcttcgtcgggcagtagctcggggagttgcaccaccagatgcatgcactacttggacagcaccgacgcgatctggcattctttcttctgcttgtccatcgtcgtcgtcgtctcgagcagctccgtcgccaggtgccacgccaggatggcctcggtggtggtcatctggttggaatcgatgcctgatggaaggttgatggctccagtgctgcgattgataatgtgacatgaacacaaggcttggatgatctgcgcagtggcactcgccggcagggtaacctgggaagtccttgcaaaatgcttgtcgattggaccacaggcgtcaagaatggatacctggcagattgtcatcttgtttttggatgaagaaagtaaacaagagcgtatgtagatgaccacggaatagattttctgtagccaccgtctactgggccggtcgtaggagcacagcatgcggactatgttccaatcggagaacacaaacgaggtcaggaagtcatgagcctcgatgagaatgaccgtgagcacaagcaacatggtcaaggagaggatgagggacggggaattcacaggggttcttccccagcccatgattcggcaatataatggtgctgcatccttgttgacgattagtatgtcaactacggcatcgatgaaaaaatacaagaagataatggaggacaagaagttggtgcagaaaaggataggttgggacatcaccacaggggcagccgcttgctggtagtagttcttgaggagctcaagctccattagaagcacttggaaaggcctttggagttgatcatgggatgagttgctgcctgggctagagaagttgagtttgaggaggccgtcgagcatcatggcgcgagccatgtcggagccgacctccaccatcgggtagtgctcgaactggcgccggagcatcttgaaaagagagaaagataggcataagtcctcaaggaaatcccctatcttgccatggaagatgttcttgtgtttttcgcgcatctcccatattgttttcacagtgaccaagggccattccttgttggagtcgctgttggagtagtcatcgggttcggcgatacagagatgtaaatgcttctgctcgttttcgttgcagtaggtggcttggtgttggtggccaccgccggcgacgacgacgcgccttcccatcaccacgaatttgcagttggacatgtcgttggccggcacggcgctccggccatcgccgtcgcggttgtacttgtccatgactttcgtcatgtagcctgcaataacaagagggttcctcgccgtgtggaaggagtagctggcgaaccacctgttcacagcgcttagcacgagcttcacaaagcacaggaaccagagcacagcgaaggtgatgctcagggatttatcatctggcaatttggagcatatgaggtagccgatccacactaggtgactagtgtgtcgtaggcgtaatccatgagcgtgaaccgtccgatccccctattgaaggaggagccatcggttggcagcagcatcccctgcaccttcttgcggatgatctcggcgaggagcatccacaggagtatcaggaggagctcggttttgctccggttttcgctctgtgaaaaggctgaggagaggagaggaacgaactggaagaagacgaagttgagcacaaaacgcacgatccgggtaaggtcgtaccggtaaaggaacatgccaccgcaggtaggcagccgcctgaaggagaggcgtagaaagccggtgctgtagatgatggagcccatgagagccatgagcaccaccatgaacgtcagcttcatgttcatcaacaaggcttcatgttggtcggcctgagtaatatatactatgggtgttgccggtgttgttccgggaagaggataaaactccatcgcaccatgtcttgttgaaagctcgcaaaccgggagggaggccaatgccaaccctatgatgaaatggcaatgtgctcatgctggtctgtgcatgcatgatcatatgctatgtgtatgttctagctaatggctatcgcatttgcatgcaaacaaatactcgcatgcatacgcgtatatatagtccccggcaatataaatatatattcatcgacaagatactggcctcctcattccttgcttagtttaatgatgcactcaacgaacgtgctaggcatcgtatatgcagatccggcaatttatgctgcaggccgggatttcacctagctggcttctattccttttctctacaggctatatatgcatgatctgtatcgatgctttaatcgttgttacaacgaaaggaacgcgtcgtatgaggtctgttacgtagttcttattccatttagagatggttctctttgtaacagttgagacgataaaagactaataattaatgcatcaaaacatttttttattacttattattattattcttttcttggtattcatgtagcaaaatttcttttatatgcgctaactatctttttctcctactcacttctatttctatatcaacaaaaagagctcgctattaattacagttgtacatgctctaatccccatttcatttattaaggcttataagttcactctccccctacctttattttttcttaaatcgactttgcatgctctctatatgctattataaaagcgaagtcatcctcctctcttcatgtaaaatctcatgctaaaaagccatattacccaaaaaaaaccatctctcccaaaaccagtttcccaaacaaaaccaacgacctaccaaataaaataaaagactattaattagtttttttatttttctctatacactgttgcaacacattttgtattttttttctccatacagtactgttgcaacacacgggcatcgcactctataaaaaaaatatacaggagttccttgctcattgtacctgcaaaggacctttcaacatatacctttccatgttcgtgattacatttgcatctatacttggaaaataagtgcaggagttcgttactcagtatagcagcaaaggaggacatttgaattcaacctcggaggcagatgcttgtgcatgctcgtgcatattagaattaaatacttatctatcatcgtaagcaactaaaagaaagctagctctgctttactccatatacttgtatatatactactttgctggcccataaagtaatggtaaattaatgcggtataaacatctacctcaatctcaaaatacaaagagttttagacttggacacaaatatgaagaaagtagataaaattaaataggaaaagattagaattggttgagaagatgaagcacgcaaagaaattgaatgatacaaaattgtaattagttgagaagagaataaagatgaggaagttgttatattttataggaaaaagtacgaattacccccctcaactatcgcggtcgattgaattacacccctcaactgaaataccagacattatataccctcaactatttataccggacaaataacccccctcaacgctgttttgagtggttttgacttgagcttgcttacgtggcgccaacgtagcaatccagtcagcgaaaaaaataaaaaattccctgggtcccacctgtcattccctagtggttatctctcgcgcacaggccacgcactatagatggccataaggcccgaggcccgaaggcccggcccacggcacgaccttttggcccggcccaagcatagcacggcccgacttgggtcgagcccgtgctagcccagcccgaccgccgtgccgtgcttgggcctccccaccggcatgctgggctggcctggcacgatcaggccggcccggcacgatgggccggcaggctaggcccggcacacaaagtatagggactaaaaatagacatataaatgtcatggtccaaagaaaagggacctaaaatagacttattttatctatttatatcacaacccaaagaagagggaggttaaatagactttttgagctatatatgtcacagcccaagaggagggaggaaaattagacttattctgagaaaaagcacgatggaccgtcgtgccttcaggccggcccggcacagcccgagtcatgttgggccatgtgtgcggcccgtgggccggcacggcacggcccggtgcgtcggtcgggccgtgccggcccgacaagccttggcccaggcacggccgggcctgggccgtgccgggcggcccacatggccatctataccacgcactcgggcggccggctgtggagcacgcggaggtggaggcggactgggcgaccggcggcggaggcgaagaacgcccgcgcggcggccagcggcggcgcacgcgcgtgcggcagaggaggcggagcacgcgcgtgcggctagctgcggagcctgcggaggaggaatcgcggaatccggccgagaaagagcatgcacactgcccgagatgtcatgcccctctcgctctgtttttactccactgccgtgtgtgtgtcacaggcaacacgcgtgcaaaagatcaaacacctacgaggcgagctcatctctatccatccatctcaacctcgcggaggcagcggcgccggcggcgatggggttgtgccagtggaggctggagaggcaggaggcggtgtcgaggtgcaaggcgaggcgggacatggcggcggagcatgtggtctacctccgggcgctgcgtgccatgggcgtcgccctgctgcagttcgccagtgtcgatgcagaccatccgaggcagattccgcgatctcgggtggctagctgcggagctccggataggcaaccgtcgccgcgtcctctgcgcgctcgccacgctgccctcgcctccacctccaggccgctgccggcacgcgccgccctcacctctgcctccatgccaccgtcggtagcgccgccgtgctgtgtcgcctcgtcttcccccgccgccgcatgcttcagaagaggagggagaagagcgccggtcgcgtcgcaccctttcgccggccgccgcgtgctttagaagggatggagaagagagaggtgggtggggattctgacgagtgggccctagcgattctttttagaaaaggatgactggactgccacgtgtgttatttgaaccctaaaccgcttgtaacagtgctaagggggggtgttttatctggtattgaaagtttagggtgagcaatgtctggttttcgagttcaaagtgtaatttggtcgatcacgatagtttaggaggtaattcatacttataataatttttaaatactaaaaatttattatatttcgagatggatagagtacttaatgggagaagaaaggaacagaatcagttttcattatagttgcctgcagggaggcgggtgctttaaaaaccaagagctcggtttaggccagatggacaagtcaacacagcggaactctaaggtgacgcagcgctggaacccaaggctattcctattgcaagtttcataagagtttagatgtcacataagctaaattgatgatacgtcaagaaatttatgaagagagaaggaatgagtttcatctagaaaggatgattttcatctagatgaaacttggtttacacactatctatgcagtgaaattagaatgaaaccccacttcaacttgatcattttatccttataccttggaaacgaaaataaaaccacattaatcaaatagtttcataatatcattcaataaataaaaattgtggatagcatatgaaatcacgaaatgaagctatgcatcaaagatcgacatttgtttcattcatcaatccgaagctcttttaattatgtagcactcttgaaaaccccaaaataaaactctccactaggaatagtctaagtggcgcaaaaggttaaacgtgaatatctccttgatcaagttctgtagtaaaggcagaacctaaatattgttacaactaagtattttaatttctttttccttccactttaaccctgtacatggctttgattatttctaactcatagatactccctccatcctaaaatataagttgtttatgtttcagagaaagtcaatgtttgactaacaaataaatatttcatctgtcttaaaatatattaatttaggatcagatagaatatatcctaatattattaatctagatagacccgtagaatatgtcctatccagttctaaagttactatatttaagaacatgataagtatgttatagttgtgcatgttatatcgttagatatatctgaaaatatatttatataataaaatttcatggttattaataatatattagaaataaatgattaaagatgatgtaaaaggctaatacgtctaggggtgggcattcaatctgatcaaagaatttagcctcggtcttcgatctttggttttttggacagctatagataaattgcacagtaaaatagtcaagaccgagcaatttggtcctggtcatgatcacaattttaggagataaaaaaacacacatattactaacaattttcagtcatccaaaatatcacacacaaatcacacaaatttcaataaactcagtgtcacaccctaccctgacaccacctaacagtgatgccagaggggatgcatcataggagatcggtgtgaatagactcccatagaaccgcgatgccggtaccaatcctaagacacgactgctggtacctgcggttaactcgagaggaatcattgcaattaataatataaataattatacctttaagaggtcacatcttcgaaacggctccgagagtgtaaccgacaaactagacccaatccacaagcaacggcttgggattagatagatggatagagaggtggatggatccaaaccatttggacttaattgggtggctcaaaaatttgaatgatagagctttgaaatctgtcaaaggttatataggtatagaaacaaaggtattgtacatgcatgagggtgtgtcgttcggccctatcgttcttcaccctaatgtctcagtctagtctcccgataaaaatctagtttaaggatgtctggaatatataaccacagtgatgttatatatgttgttgccttcttggaggcatcgcattggagattctgttttctggttgagaaagccaatgactacatacaacttgaaagtcgctagaaagaaacaactatgcagattctgaccaattattgtaacaccttgatctgacactaccgtacaacgacacttgatagggacatgttgcaggagaaggatgcaagccacttcctacaatacccgatattagtaccagtcttaggacatgttagaactcatgatgatagttatgaattattgcgatccttaacataaacattaaacttatttatgttaacttaacataagttgcagcacgagacgaccagagaatgcagctgacaacaaataaggaaccagcaacagcgaaaggagcgagctaactcccaactccctaaacaatagctaggaacctggacgaaacactaaatcttcttcacatcacttcaagcagggatgtggtttgtgaaagggcatgtagtctagtggttacaagagtctcagaagcaccttaggtcctgggttctcgactctctatgggagcgaattttacaggatctaacgacattgtgctttcagtggtaggcgacgtacccatcgacagcgagacacctgtggtgacttcgtcaatctcaaggatttgccggcccagttttcgaagatgctcatacgggtagggtttgcatgcgtgcgttcataggggtggttgcgttgtactgtgtaattcaaaaaaaagagacgcctgtggtaatttcgtcaatctcaaggatttgccagcccagtcttcgaagatactcataggggtggtgagtgtgcgtgcattgtgagtttctacgttccagtcttcgaagatgctcataagggtaggttttgtcggtccagtcttcgaagatgctcatagaggtagggtttgcgtgcgtacgttcatagaggtggtaagtgtgcgagcgttgtaagtttctgcattgtactgtgtaattttaaaaaaaaagcagggatgtggttaccaatacgttacctggatacggcttccaggccgcgtatccgtatcaggtacatgacggatacgggatacgtatcagatacgtattccgtacgtatctagcgatttgatgcagagccgccgtcctccgtctcccatcccgatgcatctcgcacgcgccctagcgagatgtcgccaccacacgctgggtacaggcatgcgtcgccgccgcgcccggcagcacaacaccttctctgcaaacaggcacagccgcacagcacctccgccgcgagtttagaggccgggtggcagccggccagggccgtcaccgcccaaggcaagcacagcaccggcagcatcgaagcaccgttgcagctttttatttgtttccctcactacttgagataaatccactcctctagtgtttcatgcttgatctgcaatgtctttattattttaggataagtagtcaaggactattgtttttgttagatccaacctccaaatgctactgtgcagtctgtactagtgcatctagcaattctaggggtagtgcggaatgttgatgcacatcaatcaaagagcaactgtgttgattgaactattaaatttgcgttttgtatgctatttgtagtcttgcactttattacacaccaattttttagggggcttaaatcgcttcgtcaactatagcagagttggagaagatggccatggaatgaactgcaactgcactaatcctagtattatattgccattttcttaaaagaatccttaattttttgtatttctaatatatatataaatatataaatgtattcccgtatccttgttttttggaaaataccgtatccatgtatcgacgtatcgaggtagcataggttaccatgggagatcgagccaaggagtaaaaaaaaaagtaaaagtaacagcgacggtgtaaatgtcctacaataactagagaaggggaaaaaaaggaaaaggagaatagatgggctaagttggctggtttgtttgggcttgacccattgcagcgaggagagagagttgagagtaggccctgtttctttgggccaagctaagctagcatgcacgcacgcaagatcaggccggtcagcaagctagcagcaactcaatgcagcagcagcggcatacagtgcaaaatattagtacaccttggagggagtggattctctcgagggaatatctccttattatttgcatgttatctaaataattataaaaaaaattcaactaaatagattaatatgtaatagatcactccacaaacatgaaagttaaaattcaacttctgcaagttgcaaaaaaagatattaaactatggctagtaaacgtatattcacattcaaatttatttttttcgttgtaacttatagaagttaaatttgaccttacatgtttatgtagtgatttaattatcatatattaatctatcttattggtttttttcaaatattttcataaccatttagaacacatgcaaataatgagggatgtcccttcaagagtttagaatagcttcccccaccatggaagattgaagaagagatgaagtggcttataaggatgagtgcctgaactttgtcaactttgacttaaataagtttatgtaaaacgaggatgaaaacactgagttaaaagtatagatggccatatggcccgtggcccgcggcccggcccaaagcacggctgtttggcccggcccaagcacggcacgacccgactggggtcgtgctcgtgccgtcccggcccgacagccgggccgtgcttgggccgcaccttcggcacgctgggccagcacggcacggcctggtcaaataaaaaaatatagggatgcaaaatagacttaaataatcgtataatgcaaggcccaagacaagaggtatacaaaatagacttattttccagccatttaaacacagtccacagagttgagggaccaaaaatagactttttctgtgaggagtatacagaatagacttattctccagccatttaaacacaacccacagagttgagggaccaaaaatagactttttctgtgaggaagcacgatgacccatcgtgccttctggccggcccggcatggcccgagtagtattgggccatgcctgggctgtgtatgccgccattaggctggcacggcatggcccggtgcgtcggtcgggccgtgccgacccgacaagcctcagcccaggtatggccgggcttgggccgtgccgtgccgggtggcctacatggccatctatagttaaaagtatatagttgtggttcaattcaactcatcaccgttttcggaactctaaaaacaggtgaacattctttttataaaatcacaattaaataatttaatggtgtaggatatcagttatggcgaaaatgtttgtcagggttatggataaggcataccctctatcctacgacttatgaaatataccgataagatataccttcacgtatacggatcgtttccgtacacgccattaggaactcgtctcaagttatggaaaatatctctgagttaagaaattgccgaagtcctactcggaaagggtaaaatctctgttatatcgtgtcggtttacatatccctaagtcttacatgagggtcaaggtattacacggtataaaagggacccctagggggaggcgaagggcatcgcatctcatcgaccacacacccaccaaagtttacgaaatcggagtgcacggagccaagtcaccgggagatctcgtcgaatccctcgactacgatctcgtcggtaccatctgtttcgactactctctttgtaatatgttcttatcgtcatcaatctcatataaactggactagggctattacctgacaaggggcctgaaccagtataatccttatcttttgtttgcttgatgtcgtactacgtagaccctcgttccaacataccccaataattaactcatccggtccgcgagtatcccacgtcgacagtggtgcgccaagtagggggacttggtgctcaaggatctaccagtatgacttcaggacttcccgacaacagtgtcatcgccagcgtcgatcaaggagtttctacctcgacaccgctagtgtggacttaggtcggatctattgtctttctggtctataccgttacaccaatctcggctggcccaatcatcattgggaacgagagaggtacggcaacgactgagagaaacgacgccccgccgacaattcctcccactcaggtggagaacggaacatcgacggccccaacatctgggaggaaccctcaggcggctgaaattcacccttcatgtgaaagatcaaagccgacaaggatgaccaccctaagaccgagatcttggtgtcctgtgcataagacaaccaagcatactctcgaggactgtccggtgatactccacgtacaagctgaactctacgcctgttgggaacgagggattcaacacacttcaccaacgggaaccacctactgtccgatccacagatctagatctcatgatttcacaaattgcagaatctttctctggaccctcaaaccagcgcatcatcgtgtccaacaaccatgagttcaaaccccgtgcgttgccaaggaaccagatgtggcaccgattccagataggtttgtgggatctgtcggtacaaacgagccatccgtgttgcacctccttgaaggcaacgaaccctcctcgcagtcacctagggatgtaaacgtggtcgacaacactaagacaagtgcgtccgcagcagcgagaatgcccgctcatcagttgcggaacttggacgcgatattgagagaaagtcctttcgatccagtaacaaacccagacgccagccaattggcagagcgactacgggaaactgtgacgaacctcaatgccgcgtttgccgaagcagcaggcggcccagagccgcacaggaacggagagcgacccaccaaggacgcggatggagaagacctcgccggaagacatgccaccggtgatcattcccctcgagaaagacatgatcctacaccaccacgccgtgaagatagcgatcttcgcgagcatctgaacagacgccagcagagtaggagggatcgtaacgaagacgaccatcgtcgccatcactctccttctcgtcgggaggacggtactccacatcgacaacatcatcatcgctctccctcgcggcgagaaagagacgacggccgaggaaataccccaaatgaagatcgagatcatcggccccataatgatcgatgcgataacgacaacaaccgaggtcaggagaataatcgccgaagacaggagagggacggcgacaaccgacgtgatcgaaactcccaatctccttatccgagtcgagatcgaggacgcgatcatcgctcgagaagccaagctcctgagccaagtgacccctcatcctcgtcttcgtcgtcctcttcggatcggcctccaagacgatgtcgcgaccacgggccacaccctatcccaggaaacggatgcagggcgttcacaccagcgctccgcaatgtgcgatggcccgagaagttcctaccgggatcgattgagaaatatgatggaggtacagacccagaagaatttctgcaagtctactccacagttctctatgccgctggtgcagacgacaacactctggctaattatttgctagccgcgttgaaaggttctgctcgttcatggttcgtccatctctcgccgaactcaatttcttcgtgggaagatttgtggtagcagttcatcgccaacttccaagggacatacaagcgccacgcgattgaagacgacctacacgctctaacttagaacccgagcgagtcattgcgggactatattcggcactttaacaagtgcaaaaatacgatccccgagatcaccgatgcttctgtcatccgagcattcagatcaggcgtccgagatcggtacaccacccaggagttggcgacgcgccgaatcacgtctgcccgaaagctattcgagatcatcgata

SEQ ID NO: 11234 - DNA, 41549 bp, Oryza sativa
gcaaatctcgagaagatcaaggcgatcgagaacatgaagtcgcccacaaggctcaaggaggtccagcggttgacaggatgcatggcttcgctaagccgattcatcgcaaggatgggagaacgaggacaacctttcttcgccctgctcaagaagcaggaccaattcgagtggaaccaagaagccgagaacgcatttatcgcgctcaagcgctacttgtcaaacccccttgtactcgttgctccacacatcaatgaagaattattcctgtatatcgctaccacgccttattctgtgagtacggttatcgtcgtagagagggaaaaagaacaacatcccgtgtactacgtaagcgaggccctccacgacgcaaaaattagatacccacagatccaaaaactgctctatgcggtggttatgacatcgagaaagctacgccactacttccaggctcacaaggtcaccgtcgtctcctccttccctttgggtgaagtcattaggaataaagatgtggtcggctgaattgccaaatgggtagttgagctaagccaattcgatatccactttgtgcctagaacaaccattaagtcacaggtcctcgccaattttgtagccatctggactatcccagaggatagcccagccgcccaaacggacaacgaaacctggatcatggcatttgacggagcactgaatagccaaggagcaggcaccggcttgacatcccccacaggagatcaattcaagcatgcaatccatctaaacttccgggcaacaaataacacggccgagtacgaaggactactcgcagggataaaagcagcagccgcgcttggcgtcaagcgactaatcgtgaagggagactctgaattggtcgcaaaccaagtacacaaagactacaaatgctccaaccccgagttagccaaatatctcgccgaggttagaaaactagaacgcaagttcaacgacatcgaagttcgacatgtctaccgaaaagacaatgtcgaaccagacgaccttgcacgacgcgcttccaggcgagaaccactcgagcccggaacgtttttggacgttctgacaaaaccatccatcaaggacacgcacgacgaaagcaccacagccaataccagcatctcgcagggagctgcagaggtcacaattcacaaacgtcgttgcgaacatagagacaacagacgactggcgcaccccgctaatcagattcttggagtcagacgagctgccggatgacgacacagaggtagagaaactatcccgtcaggccaagatatattgtatgatcagcaacgatttatacaagaaggccccaaacggaatcctcctcaagtgcgtatcatccgacgacggaaaaactcttctccttgacatccacgaaggcatttgcggatcacacgccggcgcacgtactctcgtcggaaaagctttcagacaaggctttttctggccaactactcttaaagacgcatgtgaactagtgcaacgatttgaagcttgtcaattctttagaaaacacaccaaattgccagcacaagcgctccagactatccctttgacatggccattctcatgctgggggctcgacatactcgggccattcccacgaggacaagggggctacaaattcctgttcgtgccgatcgacaatttcactaagtggattgaagcaaagccgacaagagaaattaaagccgaaaatgccataaaatttatcaaggggatattctgtagatatgggttgcctcaccgcatccttaccgacaacgggtcccaattcaccaacggtgatttccaagattactgcatcgaacttggagtcaagatctgcttcgcctcagtgtcccatcctcagagcaactgtaacatcctgaaaatttcgattctgaaatatggaattaaaaattcggaataatcaaaaatctttttaaacctttttacatgctaggatttattatgcatttgtgtgttttttatgttgtgtgccaaagatctcgattaaatcttatctccgaaagggacgccctcagtccaacgtcctttccttcccttaacttcacggtctgatttattaagtgcttcggtactaaacaaatcatagatctggatatataacccgaaaatcttcccttatatcgcaacacgacatatcttcctcaattcttaccctacggttatttcaaaccattctattaattcaacttgatatccccttcgaatgtctacgatcggtcgacatatttatttatcgtacgtcgattcgaatatcctcaaatttattcctactgcgacgattggatttctatgccacatgtcgtccctaaaatccttccttcactaccatcggtcgttcgtacgaacactctcaaaataaaataatcctatgaataaaataatcctacgacgaccgatgaattcgttcgtcaggcgttaagcctaaattcctatttggcaatgcaggttccataaataccaaacctcgtattgcagtccaaacattcaatccttgtgcataacggaatttctataccgaacacaaccatacactccatagtaccatacaagcacagtccgatatacagagccaaataaatgtccagattatacattccaaaatataaatacagtccaaattacaagttccattaatacatatgtcattccaattcaatccctgcaatatgcaaaagttcctattgcaaccaggccacctcccttccctgtcagcccagctcatctcacagaaagtctgttttgcctccctaacctcagagctacagccaccaagcaaccttctcagccaaagtctgttttccctccccagccgaaccagctgcctgcacagaagctgttcgatgaattgcctacaagccgcaacagggtttagcaccaactattgccggctcacaacaggattttgcaccaaaatatgcggccattcaataacatgggtcccttccacacagcaaaccatgcacccatgctcccggttcacaaaattcattcccaaaatacaaacaacacaatgaggaagatccacaacaccaagttcacaccgaaaatggcagagccaagtgcaaggggccatgcatacctggtactgtggcgatgtcgacattcagagctgctccccgcctaccctcacattgcctcccatacacaggcagccagcaaacctatatgaaccccaccaaagacagcagcagctcggctcctctccatttcttctccacctccacgctcgagctctgccactgcgctcctcagtcccgtgcacaagctgccatccctccatttgctccgccgcggccggctccggctgggcctcagttgagcaagaggacggataggccgccgcaccattgatcacccgagaacgactaactttaacatctaacccttagactcactaaccagctaaccctttactttctgtttcactgactcttccactttccgtttcgctaacttctaactccctaactcttaccttgcactaacccgctgacatttatcccctaacactgtgtgttcgcttgttaccgacgatcgaacacgtggtgtgcgaggacgaacagcaagcctaggatgatccgcgagccgatcgtcgacgcccgtcgaccacgcacggtgtgccgctactcggctgccgcagtgtgagcatctgctccttcccttccttgccctccttcccattgtcgtcccttagtgttgtcgatcgccttctctctgtttttccattcgcttgtcgctgtcccggcgcggtgccaccatcgtgcgctccgtcgccacctccttgcgtggccgacgcgtagccggtccgcgcaccgtcccccatccgacgcgcccggccgcgccgtcgccaggccgtcgcctgcgcctacacgcccggccgctgccccaccgacgtcttggcctcgcccaggacgccgccgagtggccgcgctgtcagccgcgccatacgcgcggcatcatcgtcgcgcccaccattcacgagtccggccgacgccgcctccgtagcgcgcgccgaccccgacatcctcccgccccgccgccgagcttcttcctcggtctcctctccattacccaccgctgccgccctctcaaccatccccaccgctgccggtctccatctccccaccgccggccttccctccctccctcaccaccggccaaccgtgccaggccgccgccgtcacccagccgccggcccctcctcccccactgcgctaggccgccgccacacgccgcctcttggccgccggccctccccacttccccgccgcccagccgccatgtcgccttccctccgggcgccgccggacaccgtcgcccacggccgcgccgccccgtcgcctagcgccctagccaggccgcctccccatcgccgccctcgctccctctctctcagtcgcgcgtgaggagaaaacgagaggagagatcgagaaggagagaagagaaacggataagagagagacaaaaagaaggaataaggggagatgacacttacatatgggacccatgcgggccccacctcatataatccctcatgcacagtaatgacactcctaatccctctcaaataatcccagtgacacgtggacccatcccggattaattcctgttaaaccatcttttagagatatgagtcacttacatgtggaccccatgttctagatctttcattcctccatataagtctacattagatccctctactccctcggccaaacccagagaacccatgtaccacagaagtctataaattatcccccagagcccaccatcggcctactcatacactaaagtccataagacatcccatgtgcaacccagagccctctctgaaagtctataacccgtccccaacccgaggagcaactccccttcggtttataaactcttccaacttcgaaaacccatatctttccaaccgtaactccgattgactccattcaacttccataatctctctaaaattgagatctatttaatggaaccattagttgcattgaatgttgctttattttacttcttttaggattgtgtgtggtttctttggccgtttatcgagcgtgattattctgggtattcttcggtcgtggatattctaattatctaactgttgcggatatcttgaagtcattagaaccaatagcaaggcaagtcactacgctcccatccttgaacatatcgatcctatgtttacaaatgtgttgttttacaaataaattgcatgctatttataaattgcgtacctatgcttgattatgcctacccttgatattgattacctttatacatgttgtatgcctttgattacctgagtcatttatttatatgcggtcaattattgatgatgcttagtaatgctatggtagacatacgtacactccatatttatgctagatgattatggatgtgagatcactcgatgtgagtgattgatgatttgtgggtggagacatgagcaccacccgccatacacaaaccttctgcgaaaaccaaaacttaatacaacaaaactatttcaactgggacgacacgaatagaatatgggtggttctgggaacggtaagccgctgaccccggtcagttaaggaccaagtcaagaagctaagcaggaaacgaaccgagtacgaccacacttcttgagtggggttagacccggtggactaggttattctcgtggggtggcaccccagacatggtaggttctggacattggtatggaaatgtggaagtatgtggtttaatgacgtcaaaactatatatatgtataatgtaatctctgatctcgggagcgccaggactcccctcacaaccggctcgaggtaggaatgtggcaccgggggtgcaatggggattcatagtccttggagcgggtgccgccatgcaagggtaactgaaaaaccgggccgtgacaagtctcatgtgttgggtgcgtcacggagtgtgggattaaaagcgtacatccactgcagtgtgagtaaattaaactattcgaaaagccgtgctcgtggttaatgagcgctaggacctgtactacccttgactagactcatagattttaatactacttagagtagatatgagagacatgagaaacttgcccaaagagtgggaaggttagtatagtagagttggtataggatgaaatgtgagggtaaaccgaaccaagcggggcttggagaggtggatgaaccctggataattacaacttcaacaataatgttgtttttcagttaaaactgctaggtcaataggtttgtgaaatgaattgtgaaaactagctttatgcaaataaaccaagccatacttgaacctctgtgtgcattagattcattttgtagtagtggcttgctgagtacgtatgtactcacccttgcttaattaaatcttttagaaaggagttggagtcgattatattcatgccatgctactatcaagtgcgtgtcgaagatgatggattagggaccataggttcaccagtcgttgcttgtggagttcgatggaccaccgctgcttcgcttccgctgttctatctagtactttggtattttgtattgtaagtgaccatgtttggtctatttcgggacccaatgaggttacccttgtattattattgtagaaacacctgtaaacgatgtcagttgtgatattatactatgctatgtgtgtaccatctactgatacaaggagtggtactatataacacatgggattaccggtgtatataaccgtacacgcgtacaaagtacacgcgtacagaagtatactgacgaggaacaggacgaaaggcgaagcgacaatgtgaatcttctcgaggaacatcgtgaacgagttgccattcgagcagccgcataccaacaggccctacgccgatatcatgagaaacgcattagagctcgcacactcaccatcggcgattacgtcctccgacgagttcaaaaccaggcaggacgcaacaaactcttgcctaagtgggaaggaccatacacggtggtacaagtactgcgaccaggcgcgttcaaaattgtagatggcgatggccgcgagttatccaactcctggaacattgatcagttacgtaaattctatgtataaaatcaatgtatcccaaatatgtgcaaatccattacccaaaggtattttgattttctcatgaaatatagcagtgccttacccagagatcccttaccacgataacacctactcttgaaatcgaacctactgaccctttacgccgtttcgacaagcctccgagaaacctacgggaattttggctggggacgcccagagcagataaggtcttgtcggatttgaagagccgaacgaccatgtaagacctggtcatgtaagagtgctcaaaaggtgtattagctaagccgtgtaatcggaaattggtttttccaacttcacagctagggcctaggcaaaatcgcaattttagataggcaagttacgagtcatcgagccttcccctccgagagcagacctcaccgaggacaaggctaggggctagggagagtaccttactcaataatgggcaaaaggcagcctataaaaagagtagtactcgttcacagcataacctgtttaagcattttcactagataggtttctgctttaattacaaaaccttaataaagataacagtatattacaaattcttgctagatgtttcttttacagggactaaagcctaccacgacggctattgccagttgatggaagcaaaaacctcctcggctagaggagcaagggatcgtgccagtcggtcgacctcgtccgccgataaccgcgaacggcgaaaacccccacgcaggaacccgagatccatctgcgagcggcgatcttgaatacaggtgaggacatgacctccagcgtaacggctggcgcgacgacattcctcttagaggctgatgtcgatctgctgtcctatgccctcaagctgagcacatgcccccctcatccaggacaagtagcccgccgtactctcctcgggctccgcgcgattaacctttagctgacgacaaacgtcggccatggcactgtagcagctcttaaggtacgagttcagccaaacctcgcagcctcggagagcctccacggcctggtccttcttcacgaccacgagcgaccgctcgagttcggcgacctcgaacttcgtcctccagtacgcgatacgcctatctcgttcagcgaggacgtcgtcgagatctacaaaggggagaggatgtaagggatgctgccttttaaacaaaacaacaagtttaaaagatgaacttctctatgacatcgcacccgagttctcgcgagggaatgcgaccacacccgggttagacgggccagaggtcatacccacctccccatcgttaacaatggcaggggcaggcgcatcgctcgaggaaggtaggtcgatcctcgcgacatcaggacatccgccttgctggacgtcctcagaatctacgcagctacgaaagacaaagaaacgcggcaaatcaacaaatggtgcgaagtaaaggaagtcgctctgcccataagacaacaaaagtgtttgtacaaaaatcacaatacaagacggagaaagtttactccttgtaaaggggaggatgctttccccgagatccgacacgctggacatcacgttctcccgcgtggcatcgacagcccccttcgacaagatctccttgaggtcgacgccagggagagctagcttcacgcacgcgaggacgtaacatgcccccgtgtggattccattggagatctcctccgcaacatgggcagcgtgccgcgatgggatggcctccatctcgcccgccagctccgacaacgccgatgtcagggacgtctcgtcgggatgtgtcgggatggaggactccatgccgcacgacaacgccagttgatgcaggctggtgaagctcctgcggagggagtcacggagggagaagaggatgtcatgtgtatcgttcatcttcttctctaggccctggcgttgcatctcgttgccggccacgatttccttcatcttctgaagatcttcatgggcaacctcgagttgcgcctccagttgaaccacccttccgtccgctgccgtcccgcgggccaccacatggtccatctgggctcccaccgcccgagaagtgctctcgagaaggcggtggcattcggccactatatcggaccaattggccactccgggcggcgacgcggccacaggagcggtggtaggccccacggactcaacgacaacaggggcgacctccacgcggggaatgatagcggctggagatccactcatcgccgtctcactcccgctttgcacggagaccgccaatgctttcctgtcaatggagtgggtcaagaggatataatcagcaaagatcaacaatgcgacaatggagtgggtcaagagtttcacttacttgccggcgggcagctttaacaccctcctcttcagaggaggagcgaggctgcccaagtcctgcgtaagatggcgaactatgacctcattctagcatatcaagaaaaaagggcgacaacggtgcgctttacctcggagccggcaaacttctgccgagaactagaaggagcgctcgacctcgcccagggctttcgcttggtcccgctgcctcctgcgacggcgggaacagaggaaatgttggcaacctcgtcggcgaccttgtccttgagcgaggcgaaggcctggtggtcaacaagaagaccgacaacatccgtcaatggcaaggcctacaggagttgaagttactttggctcttaaaaagaataaaaacacaaggtcccccggttctcgcttacattgatagcggccgccttctcggctgccaacttgtcgcagagcggggccggcggttcgtcggccgtggaggcagcgctgatcaagacctccttcacccgctgcatcacgagaaagacctgaaataaatatacaagaggatgagttaggcttcggcctcaaagtcatcatcaaaaacaggaggaagatcacaatataaagacgaataccccgcgaagagattcgagttatatcctccgctcccgtgtagtcgaatgcggggtgagcacgggcctgcagaggctagatccgacggctaacgaaatctttaacgacttcgtagccggttagcccttgttcccgaaggtcactcacggcatcgacaaaggcttggagggagggtgtaattgggggtttcgaggtccagtcctcggaacgctccggttggacctcgggcacgacaagaactgggtcgagttcttttatctcgaggtagaaccatctcgatctccattggctccgagatgagtggcattggagagggatgtacttcgccttcatgccatcacgaaggcggaatccgcaacatcccgaaacccgattgggctccatccaccggagttcatagaaaagcggaaaaggtctaagaaaggcactaccccgatgtaggcctcgcaaagatgaacgaatatgctcaagaaagcgatggaattggggttcaggtgcaagaaagaaaggccgtagaagttcaagaccaacaaaagaaattcggaaggaggaggcagaaaaccgcatcggatgaaatcttttacagctaccatacgacctaagacaggagaaggattggtacctcctgcctccctcgccatgatctgtttcggagggacggcctcctcggtgtgcagcttcttcaatgcagcagcgtcggaggaagactggtaaaggtctgccattggaagaagatcaccggaagaggatcgccggtgaagggtgttgaggattggggaaacgtagagtctgaggaagccggggaatagtaagggttttctggcaagcggacttgaaatggatctcaaaattccattaaataggagcactacctggcggttcgtatttcgaggaaaggggagagattgccgctgaaaattcctaaggcccgttggagaccgttgttcagacttcaatttaaattcaaaatccgcatcgatgggttccctgtaagtgttgtcgatagctccgtgtctctacggttaaacaaccgagattgacctagcgagtacgacaacgcactatcgggagaagtcgcatgcgataacatgaattcatttaagttgaagtcgggggccactgtcaaggttatggataaggcataccctctatcctacaacttatgaaatataccgataaggtataccttcacgtatacggatcgtttccatatacgccgttaggaactcgtctcaagttatggaaaatatctctatgagttaagaaattgccgaagttctactcggaaagggtaaaatctttggtatatcatgtcggtttacatatccctaagtcttacttgagggtcaaggtattacacggtataaaagggacccctagggggaggcgaagggcatcgcatctcatcgaccacacacccaccaaagtttacaaagccggaatgcatggagccaagtcgtcgggagatcttgtcgaatcccttgactacgatctcgttggtaccatctgtttcaaatactctctttgtaatatgttcttatcgtcatcaatctcatataaactggactagggctattacctgacaaggggcctgaagcagtataatccgtatcttttgtttgcttgatgtcgtactacgtagaccctcgttccaacgtacttcaatacttaactcatccggtccgcgagtatccatcgtcaacaatgctaggttgcaatgggagaagcatagaaagtcataattcattggtgtatgataggaattatgccaaaatgctcgatacctttatatcataatataactagcatggtggcccgcacagattgcgcggctagcatcgttatgttttttctcatataacagcttaaatatttttcatattttttttattaaaatatatttaaaatagcaacataattttgaattttgtactgtattgacagtgattaattattttctaatttcgaattttacttatttctaaattatattcctatatggactctagactcttctcctaatcatgcttatttttaaaattttgaattttagttatttataaattgtatttatatatggactctaaactctacttttattatttttcttaattttgactttcaatttgttctaaattcctatataaactctagactcatctttcaatattcctattttttaattctgaatttccgttgtttttaattatatttctatatggactctaaattcatcttttaatattctttatgttttaattcctaatttcaatttttctaaattataacctgtatggggtatagaatcttctttcaatattgcttttttttaattccaattttagttatttttaaattgtatttctatagggactctgacttctaggtttagttttcttattttttttaattccaaattttaattagttctaaattgtataccggtatggactttagtctccttttcctatattccttatttataattccgaatttcatttgttttaaaattgtattcctatatgaactctattttttttcttttttcccgattaatatgagaatttctagtaaggtagcccgcgcagattgcgtggcttagcatcttttttattttcttattttatttttaaaatatagtaaaatgggaacatgatttaaaattatggtctaacttgaccaaactaaccaatgtgtaatatttttattgtgttatatatacatgaaaattattaatcatttttttagttttatagttatttgtaaattatatttttatatgtactctatactcgtcgtgtaatattcgttattttttaaattccgaatttacattttatgtttttttacttctacatggtttcgaaagagaattgttaggaacagtttttaaattaaaaagagattcttttgatgatagaaatggttgtcagttgtcactggcttttgcagccgatgtgttttaggccattttacatctcgtcacctcgaacgcttgaacacctgtatgaattactaaatataggttaaaaaaataactaattgtacatattgcaactaatcatctcgtcacctcgaacgcttgaacacatgtatgaagtattaaatataggctaaaaaaataactaattgcacagattgcaactaatttgcgagacgaatcttttaagcctaattgctctatgattcgataatgtggtgctacagtaaacatttgttaatgacgtattaattagacttataaaaaaagtctgtgtcatttgctacagtaaaaagaaaaaaaaaacatcacagccacgcaccacacaataaaaatcatgggcatttcatggttgtgtcgactgtcgagagagtctcgagacacagagacagcggaaaaaaaaaaaagagaaggatgcgtagctactctgccataaccacttgctgctcctcacccaggtcgtcggtcgctgctctcctccctcagctcgcctctcgttgctcgtgcttgccccgctcgtctcttgctggtctttgttcgtgcttgcctcagctcgtgtccatggcggcccccagatcggaggatggtgggtggagagaaagaagaggaaggatggagaggaagaagaggaagattgagcacgtggccacgccgtcaaatcgaaaatatcctctctttctccatctagctcccagatccggccggcgtggtgggggaagggaaggaggccggcggcacggtggaagatggggaggaggcctcaccttcgtccggcatgccagtggcgaggagagcgcctctcgtcaccgtccgcctctcgtcgccgtccgcctctcgttgccgggagccggatccgccccgccccgcctcggcgccgtccgggccaggtgcgccgaggaccgcggtggccgtgagattgtatagtatgattaggggtttttttttttttttaccgattgtccgattccgtttccagtgtatagtatgattaggttttcctttttttttttaccgattgtctcatttcgagtttcttaatgctttttttctttcttcagtttttaactaatcctaatctagttctattttttttatttttttagattaatgtgagaatttctagaccgtgagagcgaatgtggatgctcatttttctagggagtaactatatttatggcgccatatttttcaccaaaatatagtcagcatgtatttacattgcaagtctctaaattacatatataattttagtgtatttgtaatgtaagttctaaaattacatgtgtaagtctataaatttcatatgtaattttagtatatttacaatgtaagtcctaaattacatatgtaagtctttaaattacatatgtaattttttcatgaaaacacatgctgacgtgatgagaaatttaaatttaattgtttggcttcacgctgcaacacacaaagacgttcaatgcactggtatttcaatcgtagcacgaatctcaagggagatcaattggacagaaattcgactgtgattagctggaaaatgtgtcgacataattatagcaacaccgtttttctattactttataatagattttgtttcgactctagccgatcaattgcacgggtcatcttgtgctagatagatggaacaaaagcctcatgtacatatgcaataagcccctcagcttattaaaaaaaaatgcatcatatcatgctttatttacattgaagcaactcagattttatacaaggaagtcaatacaaaagcacacgaaaataacacatgctcacactcacacgcggggccaaatcaatcaaacaagcactgtaccatgcatgcaatcccccattacacacttggccttattgcccagagttttagagagataccgatcgatgcagcagctgcagatatatatatatacgttgatcattactagacattgctgtcgtcgacggtgagctcggccgcctgctcggaaggctggcgcgtgatcccggcgtgcgtgcacagcgtccagaggcaggtgaggaggtcgccgctgccccaggaggccagcgccttggcgtggccctgcacgtcgttggacggcgcgaggtagacgacgaggtgcacccagaagcgcgccagctcgtcccacgccttgtcgaacgccgggccccgccgccggagccggtggaacagcctggcgccgcgccgcgccgccgggtcgtcgtcgaacagctcctcccaccggctcgatcggacggccacggctatcgccttcttcctcctccggctcgtcgggcagacgacccgcctggacgcgaggtgcagggcgctcgccgtgtcgccgtacctgtcggacacccacgtctcgtcgtcggggagcagctccgggatctgcgccaccaggaacatgcagtacctcgacaacaccgacgcgatcttgcggtcgtcttctttcttctccttcttcttcttctgctgctgctggtcgtcgtcgttttcgtcggcggcggggggagggtggtcgtcgtgttcgttgtcgagaagctccgtggcgaggtggcacgccaggatgatctcggtggtggtcatggtgcggaagtcgaggccatcgatgtcggggaggctgacgatcccggtggtgcggctgacgacggcgtcagaacgcaaggcgtcgatgatccgtccggtggcgatcgccggcagcgcgacgtcggccgccctcacagttgcgtagagtttttggagtggagaggcggcgtcgaagatggacatctggtagatgaccatctccgatttgcccacagaaaacgtgaggaaccttaccctgatgacaaggaagcagagccaccgtagccacgggcgatgggcagcacggtgataggtgcagaccatgcgaacaatgttccagctggagaacacatgcacggtccagaactcgtgggtttcaatggcgatgaccgtgagcacgagcagcacggttatgtagaagtagacgttggagatggggccgtttccggtggtcgtccagacgatgatttggcaatacaccggctcaccttgacttgagatgaaaagtatgtagacgacggtgccgagcagtagacacaggaggaagagggaggagacgaagttgacgacgaaaaggataggttgggacattaccactggggcagccgcctgctggtagtagtgcaccaagagatcaagctcaagctggagcacctggaaacccctctggatttgaccttgtactcggttcagcgtgaacttgctgcagagtttctgggctttgcccacaggctcacatccctcgagcttgaggacgccgtcgagcatgacgccgcgagccatggcggagccgacctccaccatcgggtagtgctcgaagcggcgccggaacatcttgaagagggagaaggagatgcacaggtcctcgaggagctgacgcctcctgcctttgaacaggttggcgtgctgctcgtgcatgttcatcacgtcttccacggtgatcagccgccccttctccacgcagtcgtgctccgtcaggcggagatactcgtcggggtcggtgaggaggagatgcacatgcttgtgctcgttctggtcgccgccgacgcgccttgccacgccgtagccgtatccatggatcgtgaccggctcgagcaccccattatccctcctcctcattctcctcttcctcttgttgttgttgttgtcgtcatcgttgttcaccttgttgtagtggaggacaagtcgatcctcgcccatgacaacgaatttgcaggtggacaaggtgatggcgggggggcttgtggccgtctgcttctccatgagtttctgcatgtaagctgcaacgacaagagggttcctcgccgtgtgcaaggagcagctcgcgagcctcctgttcaacaggctcagcaccagcttcgccaagcacagcgaccagagcacagtgaagatgtagatcaacgtcaaccctaacaaatagtatcggaattctaacgtctccgtcctcgtctgcctcgccaagtttgcgaagatgaggtagccgacccacaccaggtggctcacctcgtaggagacatccatgagcgtgagcctcccgatgcccctcgagaaggaggagccgtcggtcggcagcagcatcccctggaccttcttgcggatgagctccacgaggatcaaccacaggagcgccgccaggagctccgattcgttccggaggacgccgtcgttgttgccgccgctgttggcctggctctgggagatggtcgccgagacgagagggacaaactggaagaaggcgaagttgagcaggaagcgcgcgatgatggagaggctgtacttctggaacccgatctggcgcacccacgggaagaagacctgcacgaagccgttgatgtagagcgtgcagcccacgatcgccatgagcaccaccatgaacagcagcttcatattctccgtccccgtccccggtcgtgggacgttgccgccgccgctcacatcgtatagacgattactgcaccattttcagtggcgaaccagaaataaaaaatatttactgcaccgtttctagtgacgaacccagaataaaaattatcagggatacaataaatactaatcatctaattattaagtgatatactccatccgtttcaaaatgtttgtcaccgttgactttttagtatacgtttgatcattcgtcttattcaaaaaattttatgaaatatgtaaaattatatgactacataaaaatatatttaacaatgaatcaaataataggaaaagaattattaattacttaaattttttgaataagacgaacggtcaaacatgtttaaaaaaatcaacggtgtcaaacatttcgaaacggagggagtactgattaacatagttctatcctgtgaccccggctaggactgtataggatcgccactcaccatgcagagaggttgaatgccggctcaatcgaatgaatcgtcccaaaaggcaacgagaacgaccccatattaattatatgctggtgaacgagcactactgcaaactaatgtcaatagctaattaattgctatcgcatttcatctgcatgcaaacaaatgatcacatgcatacctatatgtagacggcccccggcgatacagtacattatattcatcaacaagatatatatacatcaattctttgcttagtttaacggtgcactcaacgtatgttcatgctgccaggcatcgcatgccagccttctctcttttctccactggccagccaggcgcgtgtgtgatcgatgctttataatccttcctcccaagcactgcaaaaattatgcatcttaattaagaggccacaagtagtactccatgattccatgtaggttttttttattaaggctcatttaatttcatttcatttagcaacaaaaaacaagaactatactcccaatttgattttattaagaactatttggtagagctcctacttctaaatttagctaaaatgagttgggtctaaaataaagttctagagcaacctaaacacagctccacctttctagttctttttgtgagagcgctacatccagctccgctttcattatagatgaaactgaaattgtttagttgagttcaagctaaagagatgaagctggagctgtgctaaacagatcccaaggctcaaaagtagtagcaagtattcataccttcaattagacacacatatatacatattcctcctacaggaaaatcaaattacaacacaagtgcacgtgtatatcttcaattactctaacactatgctttttttttcttagggcgtgtcttgatttcatgcacctcgaattttcaaaaaatatcagttacttttcccatccaaaaattacaaacgatggatctcattactctaatacagtattacttagaagtcctttctttcaatgataaaattgttgaacaataaattagtctaacctaaacaagaatacacctacaattcatacaaatgtaagaaattacatgcaaaaataaattcaaacttgcataaaagataaatgtaaaatcatagaaaactacaaaattgtagttaaataaactaacattacacacattgtgtgtatatatatactgcaaactttatacttaacaataccaattttagtgacattgacatgaaatcttgggaaaaaaagaccttatccttaattgacctgcatattagcgtatataaatgggaaaaaagtgcagcgtttactcaatgtgtagcagcaaaggaggatacatctaattcaacctcggaggcagatgcttgggcatgcttgtgcatattagaattaaatagttgtctatcatcgtaagcaacgaaaacaaagctggcggtgaacaaagaaaaagctagctctactgctttaattaatatgcggaagagttactttcgctacttaaaaacgacttttcctagaataaccccttttatttttcaggcgggtaaaataaaaaacgctcgtgaaactgtaaccgaagatctgcaagcggttatctttacataactgtttgtaaaaataagtctatttttatcagcgattgtttgagaaggtcacttataaaaatagatttttacaaacggtcatccataaaaaatactggaatgagatgaagaaacaaaattatatttttttcttatctttatctatccaatacccactctcccaccacccaccacatcattctctctttcacaccctatctcttctagatccagtggcggggcagcaaaccggcggccgccgcacaggcgcgagcgggcttcgacgagagctctgtcggtcggtgttcacgcaggcttcggcgagggctccagcgtgggcgggctccggcggtggattcgactgtcggcagtcgcccgggcttcagctgtgggcgggctccagcggtggatcctcttgtccatggcgccaacaaggggagctcatgcatggtggtggtagatggggcggtggcgagagcgacctctaccagatctggtggaggggaggcaggcgacgtctcctccctcatggcggcagagggtgtgatggtggcgtcctctctcccatcgtggccagaggtgcgcgtgtgttaaatatgtgatccgaattttggacccacaatatattcggattagtttcctagtaggagtcctattaggtgtctttctattatcccctatatatactcttgtaagccgtacgggaaggggtgacgttcccattgtgattcccctacgtttgtaatcatctcctctatagtgatcattgccggtcggcgcccgtggttttttcccgcaagggttttccacgtaaaaattcgtgtctccgttgtgcatctatttttataacaagtggtatcagatcattggagattcgatcaacaactatcccaccatcgttctgcaattcggcgagattatccaccggcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacagatcccaaagtgaagaaaaagtagggcaagtcagtcagagccatcatcgccctgttctgtgaattcaatttcacgttgagaattgctacggccacctaagcttgtgtaccaggagattccctgatctacgctacgtgcacacagaaagtgcacccagaggttcgcgattttgctaggtttaccctaatttcttactagcaaatttcaggattaattcctatggcgagtttgaagtatgatctaccgctcctggaccgagacacaagattctcactttggcaagtgaagatgcgagccgttcttgcacagcaagacctcgatgatgcgctttctggatttgacaagaggactcaggattggtccaacgatgagaagaaaaaggatcgtaaggctatgtcatatattcatcttcatctatctaacaatattttgcaggaggtgcttaaggaggagacagccgctgggctgtggttgaagctggaacagatatgcatgactaaggatctaaccagtaagatgcacctgaagcaaaagttatttttgcataagttgcaagatgatgggtctgtaatggaccatctctccactttcaaggaaattgttgctgaccttgagtctatagaggtaaagtatgatgaagaggatttaggccttattctattgtgttcattgcctagctcatatgcaaacttcagggatactatactttatagtcatgatactctaattttgaaagaagtttatgatgctttgcatgccaaagaaaagatgaagaagatggtaccctctgaaggttcaaattcacaagcagaaggcttggttgttcggggcaggcaacaggagaagaacacaaagaaccaatcaagagataaaagctcaagtagctaccgtgggagatcaaagtctagaggcaggtataagtcatgcaaatactgcaagagagatggacatgatatctctgagtgttggaagctacaggacaaagacaagagaactggaaagtatataccaaaaggtaagaaagaagaggaaggtaaagccgcagttgttactgatgagaagtctgatacagaattgcttgttgcttatgctggttgtgcacaaactagtgaccagtggattcttgatactgcatggacctatcacatgtgccctaatagggattggtttgccacctatgaagctttgcaaggtggtactgttttgatgggtgatgatacaccatgcgaggttgcaggtattggaacagttcagatcaagatgtttgatggctatatcagaacattgtcagatgtgcggcatattccaaatttgaagagaagtctcatctctttatgtactcttgatcgcaaagggtacaaatattccggtggagacggaattttgaaggtaactaaaggctctcttgttgtgatgaaagctgatattaaatctgccaacctgtaccatctgcgaggtacaactatattaggtaatgttgcagcagtttctgattcattatctaattccgatgctactaatctttggcatatgcgtcttgggcatatgagtgaaattggtttggcagaattgagcaagcgagaattgctagatggacaaagcatcgggaagctcaaattttgtgagcattgcatctttggcaagcataagagggtgaagttcaacacatctacacataccactgaaggtattcttgattatgtgcattctgatttatgggggcctgcttgtaagacatcttttggaggtgctcgttacatgatgactatcgttgatgattattcgcgaaaagtttggccttatttcttgaagcacaaatatcaagcttttgatgtgtttaaagagtggaaaactatggttgaaagacaaactgaaaaaaaggtgaaaatccttcgtactgacaatgggatggagttctgttctaagatatttaaatcatattgcaagtctgaaggcattgtgcatcactacaccgttcctcacacacctcaacaaaacggcgtagctgagcgtatgaacatggcaattatatcaaaggcccgttgtatgttgtctaatgcagatttgcctaaacagttttgggcggaagccgtttccactacttgttatcttatcaatcgatcacctagttatgccactgataagaagactccaattgaggtatggtctggttccccagctaattattcagacttaagagtatttggttgtactgcttatgctcatgttgataatggtaaattagagcctagagctattaagtgcatttttcttggttatccgtctggtgtgaaaggctataagttatggtgtcctgaaactaaaaaggttgtgattagtagaaacgttgtcttccatgaatcagttattttacatgacaaaccttctactaatgttcctgttgagagtcaggagaaagcaagtgtgcaggtggagcacttgatcagttcagggcatgcaccagaaaaagaaaatgttgctattaaccaagatgcacctgttattgaagattcagattcttctattgttcagcagtcttcaaaacgttctattgcaaaagataagcccaaaagaaatattaaacctcctcgaagatatattgaagaagcgaacatagttgcttatgctttgagtgtggcagaagaaattgaaggtaatgcagaaccttctacatattctgaggctattgtttctgatgattgcaatagatggataactgctatgcatgatgagatggagtcacttaaaaagaatcatacttgggaatttgtgaagttgccaaaggagaagaaacctatccgttgcaagtggatcttcaaaagaaaggaaggtatgtctccaagtgatgaggcaagatacaaagcaaggttagttgctaaaggttatagccagattccaggtattgatttcaatgatgtcttttcccctattatgaagcatagttcaattcgcactttactcggtattgttgcaatgcatgattatgaactagagcaaatggatgttaagactgcatttttacatggggagttagaagaggacatttatatggagcaacctgaaggttttgttgttcttggaaaagagaacctagtctgtaggttgaagaaatctctttatgggttgaagcagtcacctagacagtggtataagagatttgactctttcatgctttctcagaagtttagaagatccaattatgatagttgtgtttatctcaaagttgttgatggttcagctatatatttgcttctttatgttgatgatatgttgattgctgcaaaagacaaatcagagatagcaaagttgaaggcacaattgagtagtgaatttgggatgaaggatttgggtgcagcgaagaaaattctcggtatggaaattactagagaaagacattctggcaagttatatcttagtcagaaaggttatattaaaaaagttcttcgtcgtttcaatatgcatgatgtaaaaccagtgagtactcctttagctgcacatttcagattatcttcagattatcttcagattatgtccacagtcagattatgatattgagtacatgtctagagttccatattcaagtgcagttggttcacttatgtatgccatggtatgttctcatcctgacttatcacatgcattgagtgttgtcagtagatacatggctaatcctggcaaagagcattggaaagctgttcaatggattttcagatacctacgtggtacatctagtgcttgtttgcagtttgggagatctagagatggatttgttggttatgtggattcagattttgctggagatttggataggcgaagatcgctcacaggttatgttttcactataggaggatgtgatgttagttggaaggcaagtttgcaagcaacggttgccttatctactactgaagcagagtatatggctatttctgaagcttgtaaagaagctatttggcttagaggtttgtacactgagctttgtggagttacgtcttgcattaatatattttgtgatagtcaaagtgcaatatgccttacaaaagatcagatgttccatgagagaacaaagcacattgatgtgagatatcacattattcgaggtgtgattgttgaaggtgatgtcaaggtatgcaagataagtactcatgataacccagctgatatgatgacaaagccagtttctgctactaagtttgagctttgctcaagcttggtgggtgttacagtatagtcctagagactatttggcgcgcgataattttacctacatgaggtatctttggtgattgatgtttttatgctacaagaggaaattcgtctcaaggtggaaattgttaaatatgtgatccgaattttgggcccacaatatattcggattagtttcctagtaggagtcctattaggtgtctttctattatcccctatatatactcttgtaagccgtactggaaggggtgacgttcccattgtgattcccctacgtttgtaatcatctcctttatagtgatcattgccggtcggcgcccgtgctttttttcccgtaagggttttccacgtaaaaattcgtgtctctgttgtgcatctattttcataacagcgtgcggcattgtgggcggaggattcggctgctggaggtgtgcgggtggcagattcggccgtcggaggtgcgcaggcggcatgaggcgtcgtgggcagaggatccggccaccggaggtgcgcgggtggctagaggcgtcgtgggccgtggatccggccatcggaggtgcacgggcagcaggcggcagcgaccaatgatggcgagaggagcttcgggcgggaggcagccattaagtgcggcgagttggggccacactcccgctagttcccaaagaaggagacagtgtaccagtcggagcaggccttcctcttgcggctccaccacaagcacctcgatgagtttgatgagtagctgctcgtctaagagtatacgaagaacggcgcgctctacggccacatccacaatggcagttcgacgacggtaactcagctccctcccacgccgacagcaaccagtgatgcctacgttgatttggacaatgatttaggattttgattggggatttggaacaatgatttgggatttggggacaatgatttgtaatttgtgaaactattttgggcctggattttcaaaattctttttgctccaaaaaagatttcgcttgagggtctcttaatattgccgccagcgaaaaccgattttcatgtctaaattcgatctacacatgaagaaaaaataataaattatatttgctctttacaagtattattcattgtctgattttattattttggtttcgttagttgtaaagacttatataatctcaattaatgttttcaataatctcaattaatgttttcattttttataataactatttaagtcgcatataaataatgggtgccatgacatctaaatgtaaaaaatcattgtgttttactcatggactccacatggggtaaaatggacatctcgtccccgcgttccacattagcacatcaatgtgttacgccacgtagttaaaagggtcaaagtggtaaaatacaaggacaaaaatctgaaatatagtgacatttgaagagtacaagtcatctcctatagtggcaatttgttaaatccccctgatgactgcaggaacggcggcagcatgtcgtacacgtcggccgccgccacctgctgcaccgcgcctgcgctgctagcaccggcgttggcgccgccggcgccgctcctgatgctgatcttgggctggatgccgctcatcgcgctggcgttgacgcgcgcgacctcctcgtacacgccgccgtcgatcatgaggctgtcccggagcgcgccgtggtcgccgccgagctcctggagcatggacgccacgagctccgccttggccctgcccaccccggccagcgcctccgcctcccgctgcctcgcgtacagcctcgcgtcctcggccagcttctgctcgaagaacttggcgccggcctgcgccttgcgcgcctccgccgacttcacctgctcgaacagcgtcgcgtccgctgccatctgcctgtcgtacagcgccgcgtttgaatcttgcacctacgtacgccagcagatagaataagtaaaacttctcttaattagatgatttgacatgagcaaactcgatccaagtttgaatcatgtttgtgtggctgtgtgtatgtaaccatataaatagggagatggacttttatcccttggagaacatcccttgttttattcatgttgtttaaaaagtcactaaaagtaaaaaaatattgataaaataaattaatatatgatttgtcattttacaaacatataagttcaaattcaacctatacaattaaaaaaaataaataaattcgactatgcgaattacaccgttctatttttgttatttttgtttttacttgtataaattaaatttgaacctacatatttgtaaagtgatatattaatttttttactatttctttaggaaaattatggtttttttagtgatatgaaaaaacaagagaacatcttcttgagaaataaataaagtttccctataaatacctgtgtctcgtactggacggtggccttgctgagcttctcggccttgagcttctcggtgaggcgcagcgcgttcttgcgctccacctccagctgcagctcggcctcgcgaacgacgacggccttgaccgcctcgacctcggcaaccttggactgcttgtccagcccggccttcttcaccgctagcgccgcccgcgccgccgcgatgtccgcctccctctcgttctcgtacacctccacatcggccttcaccttgatctcctccctgcagcccacaccctgctgccgcgcggacagcaccttcgtctcggcatccaccttcgccgcgttctgaagcgtgagcccctccctctccttggcgccgatctcccccttcatccgcgcctccgcctcggccaccttcgccttgccctccacctccgcctgcctcttctgccccaggaaggagaagtagtcgttgccgggtgaatccgggtcatcgacgagctgcttgacgttggcgctgtagatgtagaggccaagctcgttgagggcaagctgcacctggtcgaacacttgttgcttgaacttctttgtgccctggaagatctcctccatggtcatggacgaggcgagcacgcgggtctcgccctcgatgacacccttcacgagatcgatgacgtggtttggtgatctgatctgggaagcagcaatgagttttgcgtacagtagtagctgcttgttccaggagcacaagtagacaaagaagaagaagaagaagggattagactgccaacttgagcagaaaattgttcaaacgaaagctggttgcatatttgaaacatcttcagcttttatagtagtgtagatatatgctaaagctgcagtcgtatatcgtcataggttttattaggttagccaatttaggtgactgacaagattagaacaaaatatatcgactaacaaagagcaaaactaggacatataatttttcatgcttgatccatgcatcgcttttttttcaatgttatacaaatgtgaaaaaagaggaaatggttcaattcgaaccactcggcaaaattgttaagctagctgaccaagaataaagcccaatgcaactagcctaaaaaactgatttaggtagcaatttatatatcttcctagtaaaggtattcccggcacctaatattgcgtcatgttgcttgtgcaaatttaattgactgacggataagagagaaaatgacaactagctaatagcaaaactaagatactttaatacttcttgcctcaataatagtttttttttcaatttttttagttggtgagcttaaaaaagaaggtattcaattataatgaacatcagagtgattttacagttattaaagaaatactgagaggtacaatattttctagtataaaatttgttctctctcaatgtctgtacaatttctcttaacatcaagaactcggcgagacatggtgagcgtaggtaaaagaaaaaaaatcatatatctacatgagctacatataatgtatgttagtagagtatttggaagtatcaattgtatcaaagggaacataccatgtccgcacatcatgcaaactactaacaaacaaataccatcgaaaactctaaaaaagtgtacatacatttttaataggattatcacctacatgtgatcagcatcatctttaaatccataatatatagatagtaataaaaaaaagacaaggttctgacatatttatagtctcaggctttttatttttattgttttggctaaaatagaatatatattttaaagttgatactttacacatgcatatataaacctatcaaaaatacatgtgtatttttctctagtttttctataatatttgttaattagtgtgcactgagtatattatttgaagcacgtgtagagttaatttaaagaaatagtagggggagtaaaaatatctgtgaatcatgcacgcataccgcttcctcgtcgcaatcctccagtctccgttgtgtgtcggccggcggcgccggtccgtccaccacagggttccgtttgatcttggggctggggccgatggtgtaggcggcggggagcctgaagggcagcttctcggagctcatggcctgcacgtcgatgtcgtagctcaccggcgtggcgtcgaacttgaggcacttctgccccgcgaacacccacgccttcttcgccagcttcacgtcgtcgatcccccagcccgtgatggccaggtactccgacgcgccggccaccacgaaacgcgccatctcgatttctcgatcgatcgtgtctcgcggcgattgagtgagttcgttgttggatcggcgcggcgccggcgaggaaaccccaagttttttttttttttttgtagcggcgcacgcacggacgcgcggcggcgatcgaggagagaattgaagggaggaggatatgatatctgatgcgatctactgatccgtacgtgacaagggcaatgaggaagggaagacgttgtacggtggagatgagatcgaaatcgaatgagatgtgtcggactcgacaacgcaaatcgaaccgatcgcgtcgtatcggctcaggcctcagggtcgcacgtggcctgcctccgaatcgtatgggctcgcccaagctgcacgatggcccaaacggtctcggtctcgctcaccgtctcaccgatcgcatatgcgcatgtggggcggcctccaaaccgtgtgggctcctacctgagccgtctcccacttgggccgtccaaacgaggccgcgtctgagcaaaacctacagacctacagtatgtcagtggggggtacggctaggggtggagaggaagctcgtggctcgtgataagctcggcttggctcggctcgtttaaatttcctaacgagcagagctggctttaaagctcgttagagataacgagccagctcgagctagctctactcgcgagccttaacgagcttttcattagccaacagctcaacaacagcaagccacaaagcccactaagccaagaccacaaagcccgtaggcgcataggcccatcagataaggacataaggtaaagactagtaaaccctagctgactgttcgctccacttccctcttccctgttcgctccgccgccaccatcgcgactcgcgtcccctctcctcttctctccactccgcgcggcgccgccagcccgccacagcgccaccatcccgtgcactgccgcctctccagatcttcctctcctcttcactccgccgcttcaccgtcaccaatccaccgtcgctccgccgccgccaatccacctccgcgccaggctccagcactctagcagtgagtgtcgtgcgcccgcgccgccgctcatcacccacgattccacgacgccgcccccacaccgtgccagtcatcatccacgtccgtggttcgccgctggttgtgtggccacgccgccggctgccatggaggagctgcctcaaccagatctcggagcaaatgcttgatttgttgttgttgatctcgtgtttagtactttagttcttcaattatcggttcagcttcagcacctctctgcacttacctgtgtatccattgcaaaaattgttgggccggtgttttaggtcattagctcgcgagccaaacgagccagctcgagctttgcaacgagtcgagccgagctggttttttaggtcgttaggataacgagctagaccgagccgagctggctcgctacccacccctaggtacggcacagaatactgatcggtatagaggctgcctgattctttcgactactctggagtacaatcttaatcctttcatcccagtttgatcattccctaaagtttgatcattccctaaacgaatggcaccaagaccaaggacactattatctgcaaccggttggatgaagatgggagtcatttcttcttcagatgcaaggaagtaaaatacatttggagagacctgaaccttgaagagactagggacaagttagctggtatgcaatcagcttgggcagtcttaaactccattttggagttggaggaagaaaagagattgctagccattgtcctaatgtatggttggtggaatgagagaaatcggaggagagagggggaaggaagaagagtagctagtgtgctggccttttcggtgcagaagcaagtcgatgaactcctaaatttggccctgcaacagcgaagggagcataaaaatagaacagttaagaagtggacacaacctgcagctgaggtgctgaagatcaatgtggatggagctttcaagcatcaactgctcctaggcggttggggttatgtaatccgggacgtgggagcacatgtgatacaggcgggagcaggaagttcatcgaggatgcaagatgcttttcacgccgaagttatggcaggagtaaagggtttacaggcagcggcgaacctgggaatggccaatatccagctggaatccgactccttgacgcttatccaggctctgagggaagaaaactttcgctatgctcctttgggcggcctgctgcttgaagcgaagaacattatcacttcgtcctttgtatcttgtcagttcagttactgtcctcgcgagtgtaataaggtagctgatgcaatcgcatccattggttgtaatagtcctctaaacactgatctcgtctgggatggtgtacctccgggtgttgaggatctggtggtcggcgattatgccgcttccttgggttaatggaaactaaagttttcctctaaaaaaaaagaccaaggatactaaaatatttatcactctcaaattaatccttatcggttagggtgtttcatcatttcatatcccgtagattgctgatgttttaaatattgcatgccattgcaccaataaaaattaatcttggttggttacatgcaacatattcaatgatgcacatttactctttgcacaaataaataaagagacacttgttagatgatgatcattttagaaaaacctcaaaaagcttaaaggatgatcaaaatgggatagatggagtcctggttttaggttcctttcactaaaccagtaaacctcctttgatcgatagaaaaaacatacaaattaattttgaagtatttcaatcaaagaattacatcatatcatatatatatcctttgaaatttttaggaaatggacaaccctatagggattttgaagaagagttagcaagaggtgcggcctgttagaaaatttcagttcaatctatatctctaatccgaaatttttaggaaatggacaaccctatagggattttgaagaagagttagcaagaggtgcggcctcttagaaaatttcagttcaatctatatctctaatccgattcctttgtttttcctgcactctattccaatgatcatttcggtgtttttcctaaaatttacattcctttgtattgcacttaaattcctatcaaaattctacgtttttttatttatatattccttcatttttttcaatcctacgtttcaaatgagccttaagttttgagttatactctatcataacataggagtttattatcactttaattttcttgcatgagaaggcctgtctattgttcccagatcgcaaagaggaaaaaaaacatctacttgattatataattttcacattaatttgctactgcctctattttttatgtctaaatttgactattgtaatgttttttttcttatttgtataaatagaaaaacatacaagccacacaaagtctttttaatggtagatttagtggtacttttttcgctttacgtaataactaagtaattgaataaatagtgtcggccaaatttgagggaaaataactgtattatatattataaaaaagaggtagtataatttacacattatttaaagagattttttatgaattaccattgacgattgtttggttctaaaaattgctattgttgaatacgagttttgactttggacgttaatgtttccttttgcttttacagtcgtccattagttttctactccctccatatatcaatataattgtaacctagtacatatgtgatatatcttataactttctgtctagattcgtagttctaagatatgttaaatttgtagattcgtagtcctaagatatgtcaaatttgtactaggttgcacttatattagtacggagggagtattaaactagatgtttatatgatactaatagaagtaacatataatagaaatagcttgtaagatagctacactttgtattttttttatctcgaaccaactattaaaaaagctataaattaattaagatgatgtggtttataacaatgtaaagtatatggatcgattgatcgtcaaaaaacaaaattaaagtgatatggctcagatcaatgagagaaggaaaagaaagaaggtatcgatggttgcacctatattgctacggagggagtattaaactagatgtatgtttatatgatattaatagaagtagcatataatcgaaataacatgaagatagctagctacactttgtattttttttatctctaatcgactattaaaaagttataaataattaaaatgatgtggtttataacaatttaaagtactagaaaaatgcccgtgcgttgcaacgggtgaaggctattttaatcttattattgttcactgtgagaattcgcttggatatatatttttcaagaaaatcatgttaggttagtatgcaagtttttcttttcaagagattaaatcatgttaagttagcatacgagtttttttcaagagatttcttatacgactccttatgtattttcaaaagcgaacgaaattaaaacccggctcaaatatagatctggatttctaaaagcgaacgaactgtatttttcaatacggttaaaaaccaactcatacacggatgacgtaccagagtaccggtaaaattatcttcaatttttataatagtagaaaagttttagtgattttggtgtcagcaatctctactacttcaaaaatttcaaaacgtttccttcgtccgtcaaaataaaaaaaaaagagcgaaaaaacaacaaaaaaaaagtccgactcccctaaaaagatggaaaaaaccgcagatccgattccccctaaaaaaggaaaaaatagcgaaaaacaactaaaaaaatccggttccactaagtggcaaaaaaaaaccgtagatccgaacgtgaaaaaatctgattcctataaaggtgaaaaaaagtaaaaaaaaagatccaattcccataaaaatagaaaaaagtctgattcgtataaaaggcgaaaattaaaaaaatctaaaaaaacatgtaaaaaagttcgtccgatttcctaagaaagtggcgaaaaatggcaagtataaactaaaaaaacacgcgtgaaaaaaaaagagcagaaaaaaaagcgtggaaaagaagtccgatttctattcgttttagtagacagtatatatctcttctccaactctaatctaatataactacttaaaaagagaagttttcattctacaactaaaaaaacatgagaaaataaaaacgattaaaaaatgcgtgagaaaaaagtcagaaaaaacgttaaaataatgttttgtcttttgtaaaaaaataaaaaatgcatgagaaaaaagtatttccatcgtccgtaaaaaaattaaataaaaacatgaaaagatgttccaattttcttattgtcttagctacaaacgatccatacaaacattgttattgacatggttacgagtgaaaaacgtatattatgattaaatatttttttcacccgttataacacacgagttttttcgctagtaaaaaataataattaaagaaaacaacactaagtatatacgtgtatctcaacccactgtaatttttcagcggaattcaattcaatgtcgtagatttcattttagtactccatccgtctcaaaataagtgcagttttgcactattcatacttaacatttgaacgttcgtcttatttgaaaattttttatgattagtatttttattgctattagatgttaaaacataaatagtactttatgtgtgactaaatattttcaattttttcacaaaattttcaaataagacggacagtcaaacgttgggtacgaatatctacggctgcacttattttgggacggaggtagtataagaaaaacagaagctggtacagtactttactgagaaaatatcgtgactgtttctagtcaaagaaccttatctctatccaccctctctcgtttactctctctctttccccgtctctctcctgtcgccagccacacatcctctcctctcctctctagttctctacgcctcctctctccctctacccacgacccgccgtcccgcggcaatgatgcctagagagtagagagcaggagcagtggtgcacaacgagctggggagcagcccggcaagctactcctcggtgtcggcggctctccttccgcgcagcgacgcctctccgtccctcgcctcctctccctcgccatggggccgcgggagggctcgatgctgatgggtggtggcaggtggcggcgccctcccttccggtgggaggggaggcggcggcggtccgacgtcccagatccgtcctcttcctgcactcacccttcctggcaagggcacggtgactcgaggcggcggcgacggcgactcggtcttccggactcctcccgccgccggctacggcatcaaccggcgacgacctccatggtaacgagctgacggcgacagcgggctgcaggtgcgacaaatgcccttcttctcctctctttctcctctactttcctctggtggcttggccgatccattggtgttggaggtcggagatgggccgatctgggaggtgcgatggtgacgccgccccctcctgttcttcctcccacaccagaagcagaagcagtgacgatggcgatgataatgaattactcgtgtgatttgttcatgtttattcatgcttttttttatcttgaggatttgtatgtgttgttcatctgttgaaataaggatatggggattattgtttgttgttcgtatattcatcttcaatttggggatgggcattgaagtactcaatgaagaaaattggatcgatttgagccggtcgtgggctttttttgtgcgattttttttgtgcggtttttttattcttcttgtttcattttctttttctctagattctatcttcgattggattttgtatcgatatttgaatttgtgcaacatccgccttatgtggtaagggcgctgtggtgcgacacgagggggaacggggagggagtcggactggaaaataacacagaaaaatcgcaaaaaaaaaaagatcgcggggagggaatcggacaacgtacgaaaaattcttggcataaacatcttaaacttttataataggtaaagatatgcatcgattgattgttcgaaaaacaaaacttaagtaatatggttcaattagagaaggaaaagaaataaggtaatatggattatctacttatggaacatttccctcaacttctctttataaaagttttgaaaaaaaataccgtttaggtgtaaaaaacgaagaagtagaagttgagaagagatagtagtatagaacacctcttaaataaataatataatccaaaactattacactccaatgccaacacgacgtactctgacacaaaactgaaaattattatactctataactctagcacgatgtacttttgacacaaaactcagaattattacaatgtaatgctataatacgacgtacttaatgacacaaaagtgttggtgtggctatcttaattagttcattagttggcgccgtcttttggcagggagcccatccacgccggcggctgcatgccggtctgctcgtgaaccgtcgacagcagcggcggcagcatcttgtacacgccggccacctgctgcatcgcgccggcgccggcctcgccggcggcgccgtccgcgccgctccagatgctgatcttgggctgcatgccgctcaccgcgctggcgttgacgcgcgccatctcctggtacatgccgccgtcgatcatgaggtagtcccggagcgcgccgtagtcgccgccgagcgcctggagcatggacgtgacgtactccaccttggccttgcccaccatggccagcgcctccgcctccttctgcttcgcgtacagcctcgcgtcctccgccagcttctgctcgaagaacatggcgtccgcctgcgccttgcgcgcctccgccgacttcacctgctcgtacagcgtcgcgtccgccgccttctgcctgttgtacagcgccgcgttcgactcttgcacctacacccccaagttaaatttggatgaaactcgttaaaattaaggccctgtttagatccacccaaaaattttacaccctactatcacatcgaacgtgtatgaagtattaaatataggtaaaaaataactaacagattgcgattaatttgtgaaacgaatcttttgatcctaattacttcatgatttgataatatagtgctacagtaaacatttgctaatgacagattaatttggtttaataaattcatctcgcggtttactgacgaattctgtaattagtatttttattagtgcccgaacatcctatacaacaccctatataatgtctgatgtgacacgccaaaacgaacttagattaaaaagtgtatgaatatatacctgtgtctcgtactggacggtggccttgctgagctgctcggccttgagcttctcggtgaggcgcagcgcgttcttgcgctccacctccatctggagctcggcctcgcgaatggcgacggccttgacggcctccacctgggcaaccttggactgcttctcccacccggccttcttcatcgcaaggccggcctgcgccgccgcgatctccgcctccctctcattctcatacacctgcacctccgccttcaccttggcctcctccctgaggccgatgccctgctgccggacagacaccaccttcgtctcggcgtccaccttcgccgcgttctgccgcgtgagcccctccctctccttggcgccaacctcccccttcatccgctcctccgccacgtccaccttcgccttgttcgccgcctcctgctgcgtcttcttccccaggtaggagaagtactcgtggccgggctcgtcgacgagctgcttcacgttggcattgtagatgtagaggccaaacttgttgagatcgagctgcacctggtcgaacacctcttgcttgaacttcttggtgccctggaagatctcctccatggtcatggaggcggccagcacgcgggtctcaccctcgatgacgcccttgacaagctgtttgacatggttcgacgcatggtcgtgcggggcgatgagcttggcgtacagtaggagctgttcatcattcattcaagcaaaacaaaaaacaatcagattatttatttttagtacaaatttcacatcaagattgatcagcaataacaaaagggcatcaaaataatcatgtttcataacatataccttttcctcgctctcaggcatgagaacgcgccgttgattcgaggcgccatcgacctcaggcgccggcgccggcgtgatcttggggccgatggtgaagacggcggggagattgaaggccagcttctcggagctcatggcctccacgttgaactcgtagttcaccggcgagatgtcgaacctgctgcacttctggccggcgaacacccacgccttcttcgccagcttcacgtcgtcgattccccagccggtgatggccaggtactccgacgggccggccaccacgaaacgcgccatctcgacgacgatctgatcttcttccctccctcgctagtcgctactgctgatctcgatcggcgattgagttcgaccagcaaaacccagaaaccctgatgagatctacgtctatctgatgacgagacgaaggctatggtaggtagtctggtagccgcgatcctccgttatataggtgagacggtagtatgatgggtatcaatctgtttgatttgtttcttaaccaactctgcatatgaattttgtgggtatctatttcggttaattggcttgttaattaagtttgggccgaattggagttgggttaactaattgtaatctgattaattaatccactgctatcgtacagaggcccaacagcatatagttaaatggaataagttcacttggtgacccttaaaagtgatcgaaatctaatccgtgaccctaaaccagaaaaccggatatattgaccccaaactattgaaaccagtgcaatttgactccctcgacggttttggaaggcggtttcactaacgtggcggtattgacctagtctatgtgccgacgtggcgcttaggtggcatttcaattaaaaagttatacgtgggacccgtttgtcattcacacacacaattgtggggcccactaacatgtgggccccacatgacatcttctcccattcttcttcctcccctcccttctctctttctttctccctctcccctacggccatccgtggggagcaagcggcggcggcggcggcggcggccgtgggtgttgacgtaaaaatcgaacacggcggcctgggagatctgcttagctcctgtgcaggtccaattatgatgagatgtgggcgtgccagtcagtagatcctgcaactaacaagatatgtaaacagtagatcaaacagctgatcgactgacaagccgatggagtatttccaaccgatagccaataatagttgatactgataccagccgatagcaatagggtttaagcaatcggctatatgtccaatgtagatgatgatgtaaaggcaatcggctgatgatgatgtaataaaatcacaatataatccagtatagaccaatcgtctagcaatgatatgatagaataagcactgatccgaaggttaaagcatacatcggttaggggtccgatgccataaaatccacagattagattaaacagtgaaacctttattgccatcggctaaatccaacttttatatttatatatatatatatatatatatgtatatgtatatatatatatgtatgtatgtatgtatatgtaatccgtataagccgatgcaacgcccagataacttatcggctagcactccaataaaacattagcatgaacctatcggcttcacaagacttatattatcagcaacaatctagtaggtcgaacctaaccgatgcagcacgagattgtatatgataatctaatactcgatgagccgatagatctgtctaatatgatggatataacaaatctatttagaacagcattatgattgtagagatatatcggctaagacaggagatcagacctaaccaagacagtcccagctaaaccgatacgtctctaaacacaatgcaattagaaatagaattgagatatcaggtaggcaaatatatcaaccaaaccagagcgatccaagagatcgaagtgatgcagccttgaacgacgccgatgtaaatgacagattcaccagggcccgacggaacgtaggacttaccccttcgccggagatcgaactgaaccgatgcagccccgcgttaggtgcccaaattccgccggaggataagtaaaaacctcggggaagagggtggcgatgcgccgagagtagttgtattgatcgtgattgatagattacatagactccgggtgtacatatttatacccatgggttgatacaagtccttgtaggacaagaaagaaactatcctaaagataaaaggaagagataaagtccttatcggacactaaacacactttcctaaagataaaaggaaactaacaaactatgcctaattaatagataaactgccatgccgcatcctccttgaactcgaactcttctagataagcttgctttgattgatccgactccaccaagaacatgacagcatagagacttggcgactcccatcggctgattcccccaatcggctgattccagccgatattaactctaagccgatgatgacttcgggctttaccaaatttcactgttaacagtgggctggagctgaagcggcgggctggagtccatgtcgcgctgctcgccgttcttctcgtaccaccaccacccgcaccactcggcggctggcatcgagacgtcggcgacggcggtggtgggcgacggtgggagggcgggcgagcgagggtggcagcggctcacggcagtgggaaagtcgtggtcgcggacgacgacgaaactgcgcagccccacggcgaggcggaaccactcgaggagagggaggagggagagcacgccgccgaggaggtcgcctcacgccgtcacccctcctacgcggccgtccaccgagcggagaagcg

SEQ ID NO: 11235 - DNA, 1856 bp, Oryza sativa
ttgcctcaaaggatttgtcaacatgacttgccacaaatttggagtcagtccggatgagtaagcgccgaacccccaatgctttcgccttttttaggccccgcagtatagcttcgtactctgccgcgttgttggttgtgttgaactgcagccttgcggcgtatcgaatcggtacgccccctggcgaagtgagcactgccgcagcgcccgcccccttgtgcgaccacgagccgtcggagtacatcacccaaggttgttcgacaggctcaggttcaagggcgaatgccgatgtccattcggctacgaaatcagctagtacttgggacttgatggcagtgcgggcgacaaaatgcaagtcgaagggagataattccgccacccacttgctaagctagccagtaatttccttgccccggagcacttcgcccaaagggtactgcgatggaccgtgactttgtgggcctgaaagtagtgtttaagcttgcgcgaagccatcactagggcgtaagcaagcttctccatttcaatgtatcttatcttcgccccctgcaatgcttcggagatgaaatacactggtttctggcctgactctgtttcttgacacgagtgctgcactgaccgccaccggcgaagctgctagatacagtagcgattcgcttcctggtgctgggctgatcaaagcaggtgtgctctgcagatattgcttcagctcgtcgaacactgcttggcattcgggtgtccaggtgaacttttccgctccccggagggtcttgaagaaaggcaagcctctttcgaccgcttttgagaggaattgactgagtgccgcaatttggcctgcgagctttttgtacttcgcgtacgctcgacgggggcttcatttgctaaatggcatcgattttctcggggttcgcctcgatacccctttcagaaacgagggaacccaacaacttgcccgcgcgaacaccaaagacacacttgtcaagatttagtttcatacccgcagtgcgtaagttgtcgaaggtctcctgcaagtcggacgcatggtcgaaagccttgcggctttttacgacgatatcgtcgacataagcctccacatttcgccccaactgcttgtaaaggatcttgtacaccagcctggcgaaggtaaccccggcgttcctcaggccaaagggcatcctgaggtggcaataggtgccgaatagtgtgttgaaggctgtcttggggatgtcggccggattcatgtggatctggtggtagccggagtacgcatccaaaaagctcatgagtttgcagcaactgtcgaatccacgagttggtcgatccgtggcaaggggaaatcgtcgttcgggtacgctttgttgaggcctgtgaaatcgacacacatgcgccatttgccgttcgatttctgcaccagtaccgaattcgccagccactcggggttgttgatctcctggatcaccccagcctagagcagcttttggacttcggcttttgctgcttcttggagatcagcggacatcttgcgcagcttctgtttccttggcttggcatccggtttgactgctaggtgatgcataatgaggtttgtcgaaacacctcccacctcgtcggggccccaggtgaggatatcaatgtttttcttaagcacctccatgatgttctcaacttctctttcacctatgtcgcccccagcgatacaagccttgcgggatcggcgtcgtcgacctgcgggcttcggcgcgtgcttcgcccgatcatgcggttcggcctcaacattgtgcactgctctgttgatcacggccaaatcgccctttgatgtagttgaaggttgaagccccttgaccacgattgaccacgat

SEQ ID NO: 11236 - DNA, 1276 bp, Oryza sativa
ataaacggcgcagacgactccactccacaggcagcttgaccaaggctacacctaatcttccacaccatcagcatcattgtagaactcttccactgatgaatgattgtaaggtgagtatatgacatactcagcaagccacgcacaaatatccaagtgcacaaggataccaaaggatggcatagtagggtttcttttgcaaaagcagcatttagcacatattttagaatttaataaaacagttaagtattaaacaatattaatccaacgctacacaacataccctgttgtataggcccaaccattctgaacaaccatcccggctgcacagttctatctccaaaccaggaatataccattccaaaccaggagctgatcaaattattaccagttatagcatcatttactatggggagaagggtgagactaatcacgaaagacattgttagacccacccataaccgtgggcacggctattcgaatagttttactctgatcagaggtgtaccactgtacccacaagacacaaccccacatcatgtcaccatgtgcctcaataccaccacggtacctgggaaaggagttgtgacaataccgcttgcataacacactccaccgcagcgcaccttcctggatcataatcacccccttaaaaacaaggcatggactcccagcgacccccgtgggcttatcttcccccaattctcagtctggtgccccgcaatgaaccatgctatacaaaagataaagccgttgcccacgctggcttgagggtggcacggctaatgtttcacaaccgaaactcgtgaaccgatccttaattgtcatgagcacgactctcaaaaccatatgctcacaacccaccattaccaggttttagttggcacattaattaattaaccaatcacgattgaccatcgtgagctatcattaagccatcattaagtaatagtgagtcataagttatcccaaaagtgagctaatgtttctaagcatggctaagcaatcacatctaatatctagttgaaccaatatatatagcccaactagtcaagttaaaataacccaaggtatcaaggaataaaggaatcaagaacaaaaagggctataacaaacaataggttaattccacccaatgacattcgaaaataaatgcattagttgaatagaaacaattgcttgaaacgggatcaacatgctcaaagggttgtttgggatctgggagactggcctttctggccttggaactcttcaaattcttatactgggaaaacggact

SEQ ID NO: 11237 - DNA, 653 bp, Oryza sativa
ctccagattttttccctgattaaattcgtatttaggcattacaagctcgtacggcttcggcgagcctccacgaatgcaggtgctctaccgccggaacggacggacggacaaacatgaggaagctgccactggtggagaaatgtattttactctcagttggtaaccccttatatttccggttttctaaccgggagtaaaaatctgggattaagttaaaataactgggactaagttttttttttctttttttttctattttgtatatctcacacatgttatctcagatcattcacagcaatatagttcatcccagatcactcgcagcaatagttcatcctaaatcatttacagcaacatattcattctcaaaatcattcacaacaataacacagatcgaaccacacattcaaccaaatcgaatcatttaacacagattgaatcatacattaaggaaaaaagaaaaaaaaatccacccagcagcgctggcctccaccgactgccgccgtccggccgcctcccctcgatctcctttgaatctgccgtcgctccccaccgctcgaatccaccatgatcaaacccaccagccccgctgctataatccgccagcgccatttgaatccgctgtcaccacatctcgccgccgttgatgacct

SEQ ID NO: 11238 - DNA, 711 bp, Oryza sativa
ccataatgtgttccatgtgtcgcaattgaaaaagtgtttaagggtacctaccgaagaagctaatcttgaacagatagaagtccaagagcatctgacctatgttgagaaaccaatccgtattttggaaatagatgagagaagaaccaggaatcgagttatccatttttgcaaagtccagtggagtaatcactcggaagaagaatcaacttgggaacgagaagatgaattgaagtcagctcatccgcatctattcgccagttcttccgaatctcgaggacgagattctgtttaaggggggtaggtttgtcacaccctgaaaattcaaaatatataaattggcgtttaaatggaatttttagaatttattttaaaagcctagaagagaagatctatttataataaataaatcccaatataaaatggggccagataaaatttcattaaatactttgcttaattctataattcgtagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagacggcccagtccgagccgccgctcttctctctctcccgctgacaggtgggccccacctgtcagggtcgtcgtcttcgtcgcgccgccg

SEQ ID NO: 11239 - DNA, 1612 bp, Oryza sativa
gcagagtcaatgacataatttacgcagagtcaccgcatatattgaatcctcccgttgaaaatgataaatggaagtaaatgacatactgttattgtttggcatagtgaataatttccatagcacagttcgtgcaactgtcattgtaacccagacgatactttgtccatgcatagcaatgttttcatgattctgtcaagataggacagaagtgtatttcgaaaattacatgaaaatgttctggtaaagctagaagtagaaaattgctaaactaattgtctttaatttgtcgaagacggtccaccacatattctggtagtattgcctcgttatcacgcagagtcaaaaggtggatcaaaaattgcctccggaggtagtacgggtcctgcgaaagttagagtattttctttatagctttatgaggacatatttatggtggagtgcggtgtgtgcggatatgaaagcattatgtacctctgtaatagggttcagaagacgacgaccatcgtagttcaccataaagttgaatacgtaaaagccacagtcatccctgtatgtttttgagaaagtagtgtcagtacaagctttgggttggttgtatttcgtttgttttaggagtcactcacccgttctgctgctctggtatattttcaactgtctcaaagtcccaattaagtatgtccatgttccaccctggagatgcaagacgcatgcattccattacacactgtgacaccatgatctttatcttgtcatgcctggtgaaacgtgattccccgagtggatcttctgtgtttagtgaatcaagcaccgataacttcttgctctccatgttaaatacgtacagcacgtaatgattgaataggtgaacaggaatcagtatctgcaaagtttaggtttttcagtggggactacttctgtactgttgtttacaagagtttctacaatctacgaactgcaaatttgtactcaccaggtggctttctgaaacatcatatactacctctgggcccgaaaagtgtgcaagttgatggctagcttcccaaaattcctcaccagctagcgcgtacatctgacaatacagaaagaatcattgaatttatatttttattgatgaaagaaatatattgtttattgcatgcaatgttaccccaaaatcttggttaatgaaatgcctccaaccaaggtagtttgtgttgtgaaatctctcaacttcttgttggaacattattcgaattgcaaggttgagagaatctgaatccatttggctcccaatctttatagtttcttggatgtttcgtagcgtcaatgatattctgaaaggatgggagctctgcagccatgtttttctgaaataaaccatggataaaaatgaatgtcagatttagtggggtgagatactcaattattctggaagaataatgatacttactctaatgatgcatcgtcagaaatagacattatataggaatacaggtcgtcagcaatcctagattccagcctctccgttgagcattgcttgacatgaaaggtgacatgacttcctgtttggtttgactacacgctttgacatgtgcttcatcaagtgagatggtgggttttcaacagtgtattt

SEQ ID NO: 11240 - DNA, 833 bp, Oryza sativa
cccccccccgaaagcgatacgtatgctgaccgatccatgcgcttgatgcgaccatgcgtcgcgttacatcagggaaaacgtgagcggaacagcaaccgcgacggcgccaccaccgcgcagcagcagcacgtacgccggcgacacgcgcgcgcgcgcgtgcccgtttctctcgatctcgccacggctagctaaagagcgagacagtgagtgcaacctttgatcgatcctacccccaaatagaagtagaattgagacactgagtggtgcaaagccctactactacgtgcactgccgctgtcatttctctaagtagaagtggaaagttagtagaactcgtcgtacgtacgtcgacgactcgtctcgcgcgtgtacgtacgtgcacgctccactgcacgtcgtggaggagaaaagcggggctcgatcgtgtgcgatgtgtgtgtggcgtggccggccagcgatcgagcgagcgcgctcggtgaggcgcgcgcgcgggggggtgggtcggtcggtcgccgccattagaaaaatgggcgcccttcggcgcgaaatggcgaagagcagccacataacaagcctctgatgaggcctccactaccgttcactcgtctccaccaccaccaccaccaccattatctcctcctcctccgacgcgcggccatgcacgcgcccgcccgcctcgctccctccctataaatcctgactcccgcgctccccacacttctcctagcccaacaacttccaaccgtgtctagctctagctaagcttagccgccgcctcttgatcgacaagccttcgctagcatcagcggcagatcgcgtctcgtcgtcctaga

SEQ ID NO: 11241 - DNA, 3768 bp, Oryza sativa
agagtactatggtatgaagatttatggtttagaagctgcagaaaaatttgatgagttcaatggggttatcaaaaaattgtttgatgtttatgctactagtgcgtgtgcaacatcaaagaagaaaggtgctgaaatgcatgtgcatcaacttcaaattcaatctgatcctgttcataatactgatgagtttgatgatatctttaatgagaatgacagtagccatgatcatgagcaacattttcaaagatttttgcttgagagaagtcagccaatttgtagtgataaaaccgagttacaaatttacatggaacaaccactgttactatggacttccaaagatccatctgatattttgtcttggtggaagctcaaacaagcagaatttcctatcctctgcaaacttgctcgtgatttcttatgtattcaagtgtcaactgttgcttctgagtcggcatttagtgctggtggccgtgttgttgatccatttcgcacccgtcttgatccagaggctgtgcaagctttagtttgcaccaaagattggattaaagcagctaacaatggtacactttgtgtctgtgttcattgcttatttggccattcctttttgtatatatcaatatatgtatagctgatccatgatctgatctggcatcattcttaggttataagactcaggctatcatcaatgagttggacattgaaagcgtagagaggcatctggcaaacttattgatagtggtgagctattttcttattttacctctatgaatatttttcttaatataacaacaatattattcgactcctgtaggaaaaagaggagaataatgatgacatgtgacggagcgtggggctcctcaccgggagaccgcgcaggcccccctttgccggttcggccgggggcgctaagtgaggttcttcgccctcgatctgaggaacgtcagcgagaaaggaaatgcacaagacacgggcgacgtagacaggttcgggccgctgagaagcgtaacaccctactcctatgttctggtggatctgtgagtgaaggaatccagagagccaagagcgagagagagttcaggctctagaaaccattcgccagagtcccaactcccctcctctcttctcctctttttttttctttcttaggcctgggtctcctttttatctggtcaggggtcaccacatgggcctctagctgcctaagaagggaaacatgctttttacaatgagggctagtctacagccggaaatgacctctgacaagcagagcatacgcctcctgccccgctcgcccgcttttccggtggacgcccatttcaaccttcatttaatggccagcgacttccttgccatacttgcactgaagcctggaatggatccgaccgggactgacataccaactcctggagttggcatgccggctccggctagggacgagagccaggaagctttcatcattccgacgggacggggcgaggcgtgtgataggccgcctattgccacctaacccgcgatctgaccggtctgtgaccggtcactcaccgcgaccggtcacggaccggataagcgtgcgctgcgccgcattaaatgcggcgtggcgcgctcgtccaacctgctataaatgcggttaggtgaacccgctgtgctcacctaacccacacacgtggcgccaaaaccatagggggtcagggcgccccagccctcggggccgaaacgggagcggcccgacccctcggggagacagagggaggggtggccacgtcaccttcgggcccgacccccccgagggggtcaggccacgtgggtgaccgcggctacccaagcctctagtcacgatacccccggcctcatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgcgcgaatcgggacgagccggttcgtttcgcctggagacatgatgacggcgcatttcacggttggcgggcgtagttaatgcgcgcacgatctgccccatctcgaccgccacggccgcacatctgccgcgtgcgccgcaaacgggcgagcggggttagtggaggcgtgggcgcgagaaacaagggggcgaggtagtgggcgcgggaatcgaggagccgggcatagcgttttcaagggtgtaaagacgccgagggagggattcgtttctttcctctcgccactcttccccttgccttcgccacttgtgctctaactcttcgtttctggtgccctacccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcaagggacgcccggcgccacactacccggggtggtccgtcttcttcctctctttcgcaatggcggggctggtcccgccattctctatttttttcatggatattctggagttttatgatctccagatggcgcacctcacccccaacgcgataatgacgttggccatctttgcgcacctgtgcgagatgtttatcagggtgcgcccatctctccggctgttccggtggttcttcaccgtacagccggtgtcgccgccgacggcagtcggtggctgctacttccagccgcggggtcaggtgctgaaccgctacattccatgcgtcctccgcaaaaagtgggacgactggaagagcgattggttctacacccccctcggcgaggaagcgcgcctccgacttccgagccagcccccggcgcaggcctccagctggcgggcgacggtagatctgggagacggctacgacgccgttcttgaccgcctggcgggtctgcgatcccaggggctcacgggggccatggtgttcggagactaccttcgtcgccggatcgcgccgctccagcggcgcgcccggggcgcctgggagtacaccgggcctgaggactacatgaggacccaccaggggcgcaaatgggactgggaccctgaggacttcagtatggtggtccaacgggtgctaaatctcagctccgtggaggcatccctcatcccccaaggggtcctccccctctgctgcgatccagagcgcgccaagatcctgaccatcatgcaggtggtcggggcgtcgggggagcgggccccccgaggccacgatggcacgggcgggagccgcaggggggaacaatctaccccgggagggggtcgtgcttctgggccccgcgacgggggcccggggggtagccgccctgccgacgcccgggggaagaggaagcaggagggtactcctcccccatctcctccccgagggggcggggcggtgcgtgccagcagcaggcgcccggagggagccgtgccgacgccgcagcccgagggggagcgaaagaagaaacggctccgcaagatgggagggatcgtaccatgccgggggaacctgtcacttcagggcgtgacagaacctcatctcgcccccaaggtggtcgtttagccgacctccccgcatgttcgaccccgccccctccgtggccttatacattct

SEQ ID NO: 11242 - DNA, 8851 bp, Oryza sativa
ccgccattccaagtccggtcggtctgaggccgaggagacggtgaccgcggaggcccggaggcgggaagctgaccggcgagaagccgcggaccgcctccgggaagccgaggaggctgcccaggaggccgtccgagttcgccaggctgaggaggccgctcgggaggaggccagactccgccgggccggggagtccgtccgggtggcagaggcggcgcgcgcacgccaggcggcctgccaaacccccgactcgactccgcccgaggcgacgacgacttcagaggccacccacgacgaggccgcgggcgcgccgctcgggcccgacccctcgggcgacgcttgggacgagccaggttcggggggcgcccccgagtccggcacgtcgatcggcgggccgagccgcgcggcacccacaccgagggggctctcccctcggccttccgctgccccactgagcgcggagcccttcctgcaggccttggccgccgcgaacagcacggtgctggacgggttaagtgcccagatggaggccctgcaggcggagcgggcggagctcgacgcggcgtgggcgcgcgtcgaggaggggcggcgctcggtggaggccatggtggaggcgggtcgcaaggcacaccgccggcacgcctcacagctcgaggcccgtcgtagggacctggcggagatcgccgggaggtggaggaggagcgggagactgccctcatcgccaccgccgtgctcgatgaggcgcggaacgacctccgcctccaatacgggagcctggcggcggagctggaggagaagctcgacgccgcccggggagtccttgacgccgccgctgcccgggaacggcgggcggcggagaacgaggcggcgtcccggcggcgcgaagaggcccttgaggctcgcgccacggcgctgaaggagcgcgcccgcgccctggacgcgaaggagagagacctggcggaccgcgaggccgccgtcgccacccgggaggcaacactggcggcgcacgaggccgcctgcgccgaagaggagtccgcactccgcttccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcgaaggagttggacgggagagcgcgcagcggcggggcggccgcgggccacggcgacctagtcgcccgcctcgcagccgccgaacacaccatcgccgagctgcagggcgctggactcgtccgccggggaggtcgaggccctctgcttggcgagcgaagtagggcccggcatacttcgggacgccgtctcccgtctagaccgcgccgggcggcaggcgggcctctggggcgggcggcacgcgaagtacgccgccaaccaggggggcctcgcctagcgcctctcagcatgaccggggccctcgagcggttcccgaggagctcgaggagacgatcaagtcatcctcgagggacctcgcccagggggcggtggagcttgtactggcaagctaccaggccagggaccctgacttctccccgtgggcagcgctggaagagttccctcccggaaccgaggacgacgcgcgcgcgcaggtccgggacgccgccgaccacatcgtccacagcttcgagggtacagcccctcggctcgcgttcgcgctcgactccgacgaggagggcggtgacgacggtgcggacgacagcgacgacgaggccgacgacccgggcgcgtcggagtgaggccccaggcccccgccagtcttaataacttttgcttcttcttccgaggccttcgggcccccttcttgtatagactgatttaatctgtaatcaagtaaagaggaaatttctgcgtcagctctgtttgttgtgtgtatgagacgaggatggtctgtgccgcggtccttctgtgtcttggcttgaacaagggctcgtgcccaggttccagcctcaaacggcgcgggtcggggctagtgcctggggagatccacgtgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaaggtaagtatatgcatgtggtagcccccggccaaccctgcacgccccggagaggggtgcggggttggcccgagcccgagacatgacacccgacccccactaggggtagaagcgacgaaggtgttcgatgttccacgggttaggtagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaagacgtttccccggttgctcggcttggcgtggttcggttcgcccagagcaccgctggcagcttctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtctttgcagtagtcaccgaagagctcactagtgaactgggtgccgttattcgtaatgatacggttaggcaccccaaaccgagcagtgatgcccctgatgaatttaagggcggagtgcttatcgatcttgatgaccggataagcctcgggccacttagtgaacttgtcgacagcgacatactgatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcacgccgatagagggtcccttccaccagcacgtagcgcttggagatgcgccggacgcgttcactcccttcgcggtcctcgggtagagtcttatctgcgaggtacgtctggatctcagtggtccaagcaatcaatctaggggagctgggagcgctcccctcgggtcccgaggcctggactccgatgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagctctatcccgtcgaagtggcgctccatacgccgcacctggcgcacgtaagcgtccatctgcgggtcagagcaccggtactccttatagacctggttaacgaccaactgagagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcgatgtgcccgagctggcctcgggggcggagacgggctcgggagctggggtccactccgccacaaagtcagtgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccaccagaatagcgtaaagcatcttctgggcctgagggtatcgggtcttggcgtcccggagggcctcactaacgaagtagacaggccgctgcacctttcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggccttgggccgccgttcggctcgggggcctctcctccctgctctctcccgggtcgagtcgacgcagggtggggatgcgcggagtgagggttgtcctcgtcgcgctccacgaccaacgccgcgctgaccacctgcggggctgccgccaggtagagtaacaacggctcatctggctccggggcgaccaggactgggggagaactgaggtacgccttcaactgagtgaaggcccgctcagcctcctccgtccaggtaaacggcccggagcgtttgaggagcttaaataggggtagcgccttctctcccagcctcgatatgaaccgacttagggcggccatgcagccggtgacgcactgcacatccctaagcttgctaggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaagggcattgtggtgtaacaataagttcctatgggggtaatgaatgcagttttttcctcgtcctccctagccatgcgaatctgatgataaccagagtatgcatctagaaaacacaaaaggtcgcaccccgcggtggagtcgacaatctgatctatgcgtgacagggggtaagggtccttaggacatgccttgttaaggtcggtgtagtcgatgcacatccgaagcttgccgttcgccttgggaacgatgaccgggttcaccagccactccggatggatgacctcacggatgaatccggcctccagaagtcgcgccacctcctcgcggatgaaggcttgacgttctggggcctgccgccgtactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgaccatccgctgccttggggcggccgggacggaggtggcgagcctctcgtcgccacccgcgggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaatgcgggcctccccaggaccgcgttgtagggcagactgaggtccgccacatcgaagtccacctgctccgtgcggaagttggcggaaccaccgaaggtgaccaggaggtcgatatgacccagcggccaggtgtgccccgacgtcacaccgatgatcggctgggacggccggagcaccatccccggggccttgatggcgtcaaaggctacgggggaaaggatgttgagggctgcacccccgtctatgaggacacgccccaacttcacattgcaaacggtgggggaaaccaccatcgcaatctgtcctccccgggcaacgcacggcgggtggtcggtctggtcgaaggtgagggcaacctccgaccaccgcgcccgccgcgtcgcctcatgggtaggggccgtggccagaagctctcgcttcatggccttgaggctccggcgagaagcgtgagcgcatgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccgcgaggtcgtggaggggggtgttgtgcacggtacaccacttgccggttgggcgctccctgctgggagcgccggcctccttctttttgtcgctcgcaggcctcccctttcggggggcccgcgaagcaccctcgacggcgaggacatgaccctcgtcgtcagaacgggccggccccttcttcctcctcctgtcccgccgccctgaccgagtggcggacacgggggcggccagagctgccacaccagaaccggaggagttccaggtccaggcctcctccttgcgagccacacggtccgcgagctcaaaaagctgcgcggtggtctggggctccttggaggcaatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcagatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggtaccgccaaccggggacacggggggccggcccccgtgcccggaccgaagtggcgctccggacgaggaagcgccctccgttgcgtgggcggcgcgacgagtgtcacgccggcgctcgatatcgaggcgggcatccggccccccacgcacatcttcttgggtcggaggcgttgacgaaggaatggcggacgaacggcgggtaacggccgccgctcgccgcgccctccgcctcgacgacgtggagccggcggcggcagcgccagaggcctcggtggcagaggaccgcccgccggcgcctaggcgctgctgcgccgtcatgaccaagtcggccacatcatccagccaacgtcgggctggagtctctggatcggggacgacgggcgggtgacgcaggagcgcgcccgcagcctggagcgcgccctagggcgtgccgccatcgccgtagacgaggcggcgacgcgccccgtctcgccgccctcccccgtcgcccgcgggcggcgaagtcgcggatcctccgacctccccgagcgcctccccccgcccaagatttcggcgagagggggacggtggggtgcgagcccgatggtgcgggttctgctcccagtcgtcaccgctagcgttcggagagaggctgtgcgccactgcccgttcggccattgggctgagcgggagaagcttggcgcacacgaaagaggacaagggcttagaaagacacgcgcgccccctacctggcgcgccagatgacggagcgtggggctcctcaccgggagaccgcgcaggcccccctttgccggttcggccggggacgctaagtgaggttcttcgccctcgatctgaggaacgtcagcgagaaaggaaatgcacaagacacgggcgacgtagacaggttcgggccgctgagaagcgtaacaccctactcctgtgttctggtggatctgtgagtgaaggaatccagagagccgagagcgagagagagttcaggctctagaaaccattcgctagagtcccaactcccctcctctcttctcctcttttttgtttttctttcttaggcctgggcctcctttttatctggtca

SEQ ID NO: 11243 - DNA, 8716 bp, Oryza sativa
  unsure (1)..(8716): unsure at all n locations
cccgacccctcggggagacagagggaggggtggccacgtcaccttcgggcccgacccccccgagggggtcaggccacgtgggtgaccgcggctacccaagcctctagtcacgatacctccggccccatgtcaccgacaacatggaataggatgatattctgatggatgaaatggatgaataatgatgttgcagttttcatgcatcagactgcaagtgtactgaaaattgctttgggctaattactattttgatcttatctttgttacctatagaactagaactcaatatgtgttgaacttttcaacgtgtttcgatttgaacacgatacactttgtttaatctgtgatgcgtcctacaacgatgatatttatattaaattagataaatatatgtggtgcatttgtatctacgagcagtttgagtggtctctatattccgagaaatattcgttttcgtattcgtgtccgatcatattcgatccttattcgtatccgcgataattcgtattcgtttccgtatccgagttattcgtattcgtttccgtatccgcctaacaatatgaaaacggatacggtaagagcattatccgtccgtattcgctccgttttcacccctattggtgataccttcactaaatcggatggtggatgtgatttacaatgcctaaattggatgcacatacctaattctaaccacaacaatttttcacaagatcaagttgtcgataaggactcttgccaaatgttcagtcatgcatgtaattgaagttttagcatatataattttgactgtaattgttcagtatattagaagaatactgttataagcatttagttcattaactttttcagaatgctaaattgtatggtcctcatgtttttatctagcttccaatttgtcacaaatagcttttattttgtctagcttccaaactgtcgtaatagtagttcaatttttatctgtccatgcttttacgttaatatttccatcaatgaacaatattgcaataccttaagctctctaatttcctttttgtttgcatcaaaattttcctttcagtgtaccatctctccttgagtcaagccgtaatcttttttttttgtttgtttgtttgctcctcataggagttgttcggttaatttaggctcatgcccataatcctcatttagatctttcattcccctcattttaaatgaatgtgcagggtttagggtcctatgatttataaataaagataaataaatcaaatttaaagtataatacaattatcataaattacggtttagatatatatggctttacagctacacttcatgtgaaattaatgatatcgtacacacacttgtttgcgtacacagagtcacacacttgtttacattgttaattatcattatacatttaaacttattactataaacaaaatgaaaatacatctaaaagagaggaaggttacagttgcgtgaacgcacaacttaataagctagtttaattgaaggacatatgttatttatattctctattaatttgtgttttatatgctagaaagaaacgtacgaaggtagtactgaattgttcttaaaaaaaaagtagtactccctccattacaaaataaaccaaccttaataagaatgtgttacaagtcacacaatctaataccacaaatctgacttttttttcaaaatctattgtattagattatgttatattcttttattttgggacagaaccataattaatggactataagcaagctcattgttgccggttgggctgcgcattttgtggtggggacaaagtgagcgagaggatttacacgagtacctcgatggctcgatggtgacgtgttggggggccatcgatcgctggacggctggaggatgatgggctcaacataagctattttcaccttagtcaaggatgttaggctgattaaacatacagtacacatattcctgaagatgagtatgaggccgacgagtccggctagtggaggcccaactctactttgttcctctctggcctgccaactgtcaagtccacatacggttttgaaatgaacgccacaacgtcgaggattgaggacccagctatcaggatattatagatggattcgtatttaaatccaaacaaatatgatattacttaattttattattattgtataacgataaattaatgacatctgtgcatgtgcgcctactattaagtgcttagaaagtatatcaatatgtttatattttaaattacttataatattttttcaaggtaatttttgctggaggacatggagttcatgttttatattttatatgaagaaaaaagaattaacctagtttacggaaaaaacggactcgaaaaacatacaaatgcatggttaattaagaaaaaaatagcaaaacacgcatggagtgctataaaaactatattctttatccagttgaaacatcttctccccatcccaagtgccaccctcgccatgggagggataggtagtcatatagatataggctatagttccagattcagaaaaggagacctcgtatccatccgacactgtcctgcagtcgccacagctgcctccttcaccaccgtggaagctggctcactcacatagctgacccgacaaggttaacccccccccccctccccccctcccaaaccgtagctcaccacccctacctgctgaaggaagaagaagaggcatcaccggcgccatccttttagccatgcagtttccagtagcagtaaggaaggagaacagtggtggctggtgggatggatcgccacccatatcacgccccttagtagtgatgtagggaccatagggatcgcaattttctcacaatatttgacatataattattaacaatatatttaaaaaaaccaatcttcaaagtttagtctcaaaatattaaaattacaatatatcttcaaatcaacagaggtagtgtttttcttaagaacgtagtaatctttggtgccaagctagaatggtgttcgtctaaatgcgtaaatgcgcttgttatatttttctaatgtaagcaccaacacaataacagtgtagttaccatctaaatacatttcagttatattatagttacgtctgaaagtttttcactcaaaaaattgtggcagttttttaaggtaacgctacatatcgcttcataggttcatctcctctgatgcaattattatccacattcatcttctttgcaaaaactctaaactgcaacctttttctccatgcatgaacgagtgctcctctctgaatataatgataaagaaaaaattggagcatttcacaatcaaccattgcattgcatgccaggcaagcaggtactagaaatccggtccatgaatttgccgagggcccaagataacaatggctacagtccagatttgcccggtggttgaagtgctccaaaataaaagaagctacgcttgcatgcccactcctgtgaaactttggttgtgagattctctaatctgcgatatggccccctttttgtgagtttttttatgggggagaccatctttttgcagcttttgttcaccaaagaaacattatctggcaacctagctgagcttcttctttctttctcctctctctctctctagatttgcttgatcttgtagctttgaaatgagcagcaaacagaggggggagagcctgtaaagccaaacagtgaggcagcatagcacaaaagttctattgcctttatgcatgcacaccatacattcaggctttgcggtccgtgcttgatgtcactgtacctgcttgtctgcttatttcttcttgatctcttttgtgaacaatgcttatttttttcatatcttgatcggtttatgggcatctgactaggctcaagtgatggttcatctaatctagcttagttttgttgcaaggttgggtgcaggcctatcattgaaaattttcagcagcattaggcaagcgtcagtttgataatgcatggcaaaattaatgtagttgagaccatgtctatctgaatatgtagaactcatgtagacaagtaggcaacaacttgcatatctctcttgatgatgcatgattaggctttagggatgcaataattagttcaaggatgctattatactcacaggtagacagacaaaaagaaaaatgtggctcgtgcaagccaagcaatctaatttgctattataacttctgtagcaggcatcataaagatttcagtcccattaaggtacggccagtccatgcacttcctaacaaatggctgaacttttatgccattactgtataattagaatccatttcttctactgttttctcagctaactgaattagaacagtaattatatactgtcatcagactgggaaacacgaacatttgttgctctttacctgagaaaaaaaaagagcttcagaaatcagaacctgcagctcctttcttgcaagttgagatagaccgaacagtaacactttctgtcagaaggaaaaaacacatccaagtctacccgtcagacgacgaatgttttcagacaagaagttcgctgaaaacatgcgcgccaatcagtcgctctcctttgatgtccaatcacatgtggtccatttcacagtagtgctgcttgcatccagcgtgcttgcttacagcggcaaaagagagaagagcacaccaagagatcagggcagaggtatggtcctgcgattggtttgctattccctgttcatgatctgaacagctctctaataatgcaggtttgttgcttggaggccatgttggattggatcatccttttctcctttttgggaatataaatatataatatatgtcttgtgccttgtgaagatcatgcccagagatgcagctatatatgtagcggaaatatacatagaaaatcccataaaaaacagaactaagggcccttttgatttggagaaaaaacatagaaattttagaggattctaatcctatagaaaaatttcctataaagccctttgaaacaaatgatcgaatcatgtcatatcctttgaaattcctatggaatagactatactatggagatttaggagaaaatttagcaagaacttcaacctcttgaaaaccttccttcgagtctatttctctcattcgatttttgtgttttttctgcggttcaatcaaatggtcattcttttgttttttctgtattttacaattttctatttttgcacttgtattcttattataatcctacattttttctattcctctatttttttcattcctacgatttaaaggggcttaaaagttctctaaatttataaaacagttattagagatagatggtaggcataaaatacattcatactaaacctccaatttaaactcaacttaatttaggagaaaaaataactttcagataatagtgttatctcaggccactgctgcatgccaggctaatttctgcagggagcaaacggaataatgtcagttgtgttgtcagagttcaggtgaaatgttctgtgcgctgtcacggttcacttgttactccctccgtcttatttcttactttctccgttttatttaaatttttttataattaacagttttattgttatgagataataaaacataaatattggcttatatttttaattttttttaaaaaaattaaataagacaaacaatcaaagttgagcaaaaaaaaaaattatggctgcactttaaatgagacaaagggagtactttgtactaatctagaatgtgacataatgtataacaacaaatatagagaagtttttgtcttaaaatatttggacaagctcttgtttcaaaataattttatttctagcctctaacctttgtgttaaaataaattcacttttaactcttaatccgcaaatcgaggaatttgtacttaccttttactcatccttaccaacccacacactaaaagtataaaactactttcctattaataaaggatactttagttttttcttctattttgttttaaatacccaaggttaaagataaagttattttggaacggagaaagtgtattcacacatatgcatgctagacaaagtgagttcagaagttggaattgatcataaaattacttccaattacataataggagtatcacgtaccagcgtggctaccagctgcagcgactgtcgagcatacataccctcggtggtttggaatgttatacttcctatccaactctcgtcgggcatcgaggctcgtcttgtctggtgttgaacaagtgaccaatgtaactagcaaactcgtcttaccaggtgttctttctcggtcagcactcctttgtttgtgccgatgtgttttggcaagcagaaggtcccgccaaatgtaagtttttattatgatttatgtctcagcagcgctattggacgtgttgttatgcaaaaacgtggtatcgatagccactcagtctgtcctttttgcactcaacatcttgagacggcgaaccacatcctactcgactgtgtgttcactcgtcaggtctggcaccctgtgttgtcgtcccctggctgggttgtcctcactcctccctgtggttgctcacttcaggtatggtgatcatcgtctttgacttcctagtcctcctagtctcttgtcagctgtggaaggagctgaattctagtgtttatgatctttcactttccttggtctcaatggttctggagccaatccttctggaaggtcgtatatggtcttctgctggcgctattgcttaattttgggggcttgttagaagtgtagtggggctctgccaccaccttcctgctttattggagcaagcatttcaattgtagtttttttttcttttaccttaactagaaaggtagcccgcgcacatgcgcgggacaccttatttaatgttgcttgaattttaattatgaatgcttatgtgtggatgagtatttcttaaaatatttttttactctattctgaacatgtttttttatcaataatttatttgagattgttgtgaatgttgcttttaattttcttccaattacctttcaacatataaattcgtaaatcaaatttatttaaaccatgtggtttttaatttatgagaaactattgtttcacaacaatagtgttgcttcatatggaactattatgtctnnnnntgtgtgtgttttttagaaattagcatatcttacatttggggtttataaaccttaatcaacaaattttcttgtatgttatagatgtctttattctatctgttcaatggcagacttctatttacttcttctccctcctctttttttttctcatatgatctcttatattatgtggagaaaatgaatttagtttgaaataagagcagaaataattagtatgtttagagaatttataaatatttaagcaccatagactaaagtacatttttgttaagtaagttcttgttatgaagtgtatttttaatgcatgaattctcatatataactttagtattgtttatgtttcctaattaaccaaacttagtatatacaaaatacccacacgccatacgtatttaatagaaatcaaaggggagaaaacacgacgtgtactccatccgttattttacttaatatttagggtgtagtctacaaaacgtacaacttatacatgatttggtaaattgaattgacattttagattatcctcgtatagtccgaatagattggaatccacatgataagtatatttatatgatcatataacccatattgttattttttatcatgatttgtcataattctcgattgccatgcaaggccccggatgtgacttgctacttgttgatattgtaaatctaattcagtcgcgcatatttgtgaactgatttgggccaaatagagtgcaccctacatagtaagcatatttatgtgatgatattacccatatcattaaattgttttttcacgttttgttataattctcaaatgccatgtaaagcgcaaagatacgacatgtttcttgttatattgtaaatctaatttaatggtacatagtgattataaccgataaagaatatatagtgatatatactccatactgtcatctttttttataattttcatgtccgtttggattacagaccaagaataaaaatatgacctaaaatataattttattttacagattaaagtatagtcaatatagatcataaattaagttaatggtaaataatataatttagtaaactttattttcaaacatattagagctatttttagttatttatgattataatgtgatatatgacactataacatatgttttcatgtttttttttgtctgtgagatataacgcaattggtcaaatcgatatgaactgatttaattctaaagaatataattgtggtcgaataaaaaaaattgtatatataatttaaaaattacaatagtttatttattatttatatactacatttatctcaaataatgtatggaaaaaaggagttaaggagagggaacaggggctccacattatctgcaattagtgagtgtggctagttagttacctatggtggaacttacccacctaggtttaacatctagacttgacatgggtcttatatttatggctaattattttttagtaggcaacgtttctatcaatagcgaggcgtttatgatgacttcactaatttgaagatatatgattggctcagtctctcgaatatgttttctatagataagtgtacgcgtgtgcatataaact

SEQ ID NO: 11244 - DNA, 2068 bp, Oryza sativa
attaattaagttctaaaatttaaattttaatcacgtcgaataagccaacaagcaaacagccaatcagccaaaaaaagccaatgcaatgcacagtcaaatcgacacgacatcaagtatcggtaattttatcgatatcgataagaaaaaagataatcttaattatcgatcgtacaccattgtagcacatacagagtactataggagtatttacgcaaacctgcggctggcggctataaagtgacagcattgatgcatcacttttcaagacaggaagtacatgggcagtactatgaatcgatctgcttaaaataactactactccaggctagtaccactcataggagtacgataaaataaaacaagaagggttaatggactccagagtaggaaactggtcagccaaatcttacgtaggtacccagcatgtagtggagactggatgcatttcaaactaatggccttttttagatcacacctaaaattttacaccttgttatacatcgaaagtttaaacaccttacagacaataattaattgctacatcgaaagtttaaacacctaaagtattaaatataggctaaaaaataattaattgcacagattacgactactttacgagataaatcttttaagcctaattgctacatgatttgacaatgtggtgctacagtaaatatgtgctaatgatggattacttaggattaataaatttgtcttgcatttacagaccaatacagtaattagttgtttattagtacccaaacacccgatgcgaacaccccatgcgacaccctatataatacctgatgtgacacgccaaaactttacacccctgatctaaacacccccctaaaacaatatatacatggattgatcttttgtgaaagaactccaactagttcatttcaaactaattaaactataaaaagttgaaacgaaaaaaagagaaacaaatttgaaaaatgaagaagcaaagtgagttcttgttagaggacgaatttagcttattagctacacggaaaacgagaaaaacaattagtatatgattaatcattaattgtgtattaattattaaaaatttaaaaaatatatttattgatttttaaagcacttctcatatagaaagttttcacacgagacacactattaagcagtacgaaaaacatgctaatgggaagtagttaattaatctcaaataattaagcgcttagaataggccctaaggccgagttcatatatgtgcttttcactgcatggaaaacaaggtaaggattgaggtatatgattatttatttgctttttaaaagaaactttgattaaaaaatctcaaaaatttacactgtctactaattcggaaagtgtgctaacgacaaaagaggaaacttactgtttggagctgaaaagaatgcagcctgaggcgaagcttcttttagtccacagagtggactttctatctaattaaaggagggtttgttcttggaaatcagggatgcaatataagtatatgtggattataaccatgtctttaatctcatggaagttaggcagacttatttaaaaaaacaaattcgacatatatatttcgtgaacatcatgcatgcatgggttttaagattatgtatattgtatctcaacacacacctagctagttattaagtgaagtaatttaattagacctccaagaaatacaggatttttccaattttcgcgccgattggacagattcctacgaaagtactgcgaattcttcgacgaaacatcaaattatacatcgtgaaaaaaatattagttactaaaacagttaaaagaaaatttataagaaagtagcatacaaagaagcaacatcagaaatatacagatgaaacatcctgatgagaacggagggcaacattaaaaaaaatcataagattaaaaataaaaaaagtgaaaaatagtcaaatcgtatcctatatatttgaaatgtttctctctcatgcataaaacatagaaattcattggtcgaaagatatatatttctttcataaaataaaattatctgatatatttttaaaaagattttgattacaac

SEQ ID NO: 11245 - DNA, 10008 bp, Oryza sativa
taattagctgatttccatagaatttctggacaaaaaaaagaaatccttttgcttccaaagcgctgtgagagatggctgcttgtgttcatgcctctgttaaaagaacggccaaaaaggaaaagggaaaggtgtatagctagattgcattttgttgtttgaattatgcctacctagcatgcattgttcagatatctatgcatgtccttgtttgccagaggccgaccagctagcccaactagcaaaaccgaaaagaaaatgttgggtcagtttctaccaggggataagaaaagcagcgagcatacaattttaaataaaagcagggagttaggattcaggaagcatcatgcaatagccggtagaggggaccaaattaaaagaaaacatatgaaaaaaacgagagtgaagaaagcatggtaaatgcaatagagcagagagagagagagagagagagagagagagagagcaacagcagtagcaaaactacggccaaccgtgcatgactgggttgtgttacattgcatggttcatactgcaaatggaagctaaccacaagcaagctgagccgcaaagcgagcaaggtagcagtcacaaaccctatgtccctagtccctacctaatcctagcttagcttgggaaccagaaaattagctagtgtagtagctgttgatcgatcaacaaacgtacgagtagtagtactaattaaaagaagtactacacagaccacaggtttcatggtagcgagatgcatggaagctaagaacacactcaaccatgggagataattaaaccatggttcatggaagtcggtcgatcagctcccgatcgagtcgatctcgaaggatctatctcacactctccatatgcaatttgcattgcagagaaatgcatgctcgctcactggccgctacagcctacagagaccgacagaaagcaatgacacacatatgcacgcaacgctagctgcaactgggaggggagtactctgcatgtgtctgtgtagcgcgcgcgcatgcagagacccggcggcggcagtggaaatatatatatatacataatcaattgggcagggagaggaggcttagcttagctgtgtgactggctataggattaggaggaggaggcagccgtgggtgggctacgtagtggccgcggtagtggccgtggtagcgacgctagtgtgtgcctctacctttatatatagctctctctctcccgcgcttcgctttgcatgcgcttttccacccagcgtccagcgattgacctcgccaccaccaccgcccttgtctgatcgcgtgcgtgcgtacgtgcgtgcgccgacccatccacccatcgcgccgcgcgcgcgcgcgatcgagagccaccatgcgcgcggcgatcgaacagctgagagtccaggcggcggcgcgcgcgcgggggccggcggggcggtggatccaccgaggcgcgcgcgactaccgacggggcggacagggggatcggtcggccagccgaccggccaccgaggcgggagaggcgcgcgcatacgtacgtggagcatatggatgaatatccctgtatacatgcgtgcgtaggagtatgcgcgtgtggccaggttgagtacttgagttgcggctgtaactttccgtccgagtccctttgaaaaagtcaaacacctgctctctcatgctccttaacgctttagagtttcatattataagactttatgtatagatttattagtatctatataaatatagacaatgctagaaagtcttataatataaaacggatcggaagcactattatagacagtgacatgtgaagtaataaaaaggtgggacccacatatcagtaacggtaatggtactgatattatgatagaggattctcacccggtctaaacataccataccaaagctaaaaacatcaatttttttcatccaaacagttaagtctctaacgttgactaataatgaaccggagggagtatatttttacgaatggactaacttagagtggtggagcttggccttatattaggaatgaaaaagaatgagatttggagaaagagaccctcgctccaaatattttttaagaaaaaattataaacgtattagggattgaaccgcacatcccttaccattgccttataagtgcatgttcgacctacaactgatagggcttaagcgctatacttagcatcataatactatttaaattttacaaaatcatcacataatttcttaccaaagaataaaaaccccggttccttcggctataggcgtacgtggattttacctgactccaccctggctaaaaacttttattttcttgctggatcgactgaacgcataataatcctgataaattagaaaatggatccacaggtcaacacaagcatcgttccaattccaacaggcttacaatgttggcgcaaagactttggaacctatagtagttctgccgctatatatagttttttgaacgactcgcacgagacaatgcaaagttctattgatagagcaggaaaaaattataagattacaaccctggagagtcataaccaggagaaagaaaaaaatataccaccacccacacactggcagcgccaacacacacgaccaggagaaggttagctccggaccggctgccgctaagcgtgaccggccgccgctagaccaacaaaggaacacagacgagatcgccctacagcaagggggtgccaaaacgacgtcttcaagaagagaagcgacggaagaccgccgccgccgtccatcagggctcaaaggagccaagactgggctttcgcccggcaatcacccttgaggggtgagacagcacgacaacgccttcaggagggggaattcatcgttgtcggtccggccaaggccgagctaggttttcacccgccgctcaccacctgcgaatctacggctgatgcaccgatgctccaccaccactcaaactctgccgacatgtggccctgcaccgacgcccccgtcggccagccttcgtgcgccgaagaccgtgccacacccaccggcagctccaccacgcaccgaggtcgcctcttccaccaccagccgcgcctctcgcgccaagccggtctcctccaccggacgcgcctctcgcgccaatccggcctccctccatcggctgcgcctctcgcgccaagccggcctccatctccgccgcccgcgcctctcgcgccgagccggcctccgctgccatcggctacgccactctgtgtccagccggtctccgacccctcctccaaacaatgctgcgctagccgatgcaaccgtctgccacgccctcggcaagccgtccgaggccgccatgcctcctcccaccaccgtcacggtcaccacctcaccgtcgccgccgtcacctcacacccaactccttccccgcctccactgccgcatccttcgacgttgccaccgtctcctcagtcacggccgctgcaagtcggccgccgtcgctgatgccgctgttactagccacgacgccagcagtcgtcattgcaaaccgccggcaccgccaacgcaaccgccccaacgccgtcgccgagctctccgctgccgtcgcgaccaccaccgaggcaaaaccatctccagcgcctggatccggtcgccgatgccagcctcaccgctagatccggcctccgtcgccaacctcaccgccacctccatccccgccgccatctccaaccccgccgccgacgcccccagcaagagaagcagcatgccaccagcacgcacgccatccctgtcgccgtcgccgcctcccccgccaccgtcgtcgccttcctcggcgccagccaccaccaactgccgccgccaccccaccaccttccatccccgccgccaccaccaccaactgctgccaccacctcacaccgacccaccaccggcggccttcccgccagatccggccacggcggcccggatctaggcggtcttcaccgtcccgcgcgtggccccccaccacgatgggagaggaagacgaagacgagggtgaagcctcgccgccgccgtccttgcggccgcgcggctttgccggcgaccgctcgggcggcggcgaggcggcggagggaggaggggggaggagcgggcgacgccggcggtttccgcctcccgtttcgcctgtgggggaggacgacgcgggggcgcggtcttaatagccgctatatatagttgctggcgtggccaagagaatcgccccgccctgtctgacctaagcagaagtactaagtcttagcaccgtcttcattgtcaccgagcttttgcagcttgccgctaaataagctaatcttattttgctcaaatatcgatcttacaagcattaaatgatattgtacttatatatggtcatctaatttaggcttgctagaacgaggctggcaccaaccattttgaagatctcaggttagaacgagaacggtggtaaaccttgggatgtcatttatagaagctttgactgaaagggcttcgacttccttgccattctggttaactggcacatgtaaaataaacattgaacggagttctgtcacaagtgccgccaacagtagtgggacggattctgcaagaaggacggcaataggtggaggctaatataccaatcctgtctaggctagccatgaagtagctttttcaatcctccccatcccacacccttcggtgtgttatagatgtatgctatttttttctaatatattaacatgtaaagtttttttatgttcgcggaaaaaaaatctcaagttgatagtaaggctatctataggtctgcattgaccctgccatgttatcatagctatttgtaattgcaccgtcagaataattgacactgatatacattacattctaaaatacattaattatatgtagagttgacctccggtttatctccagggataggtttcacaaatcagtttgttaaattagttttccaaaaggacgaaatgcgaagattacacaggtgagtgcgacctcctcgattgagacatgcatagttacaagcatatcatacacatgcacatgcggtttgggtgggaattgtgagtggcggtcggagattgcctcggggacggggctccttccaagattgagtgccgccgcctctcgcatagcatgcctatactctcccagtgctcttggccggttatctgatctgtccatgtcgatgtctcctgagacctgagtgcctacgtgtcatgcgctgctattccaacctggcattctggcagttcataacgaagataccaaaacattccatgcatccaatgcaagaacattccatacatccaatgcagtatgcatattactccctcgatcaacaaaagttatacatattgggttggtttggtttgtggcctaaataggccttaccaaattttgtcagtgccaaattttggcaagttttggcatgactaattttggtaaggcaaagttgtgtttggattgaagccaaaataacttaagttcactattgaaatggcctattttcttagatatgccaaaatttggcttcaaaccaaatagatactaaacactattaaaattgtcaaatattggtaagtctaatttaggtctcaaaccaaaccagcacattacttttaacaccaagaccaagaagaaattaaatcaccttgaatgttacaaaatcaagtagtaaatgcaagcatgtaaccaatgagtatttagatgagtccttgaggttctaataaaacatttaatttatctcttcatttaagttttaaattcataaagattacaaataggaacaacttatttgaaaaaatttaaatgtgaaataggtgtaacttttatcaatgaagggagtacaaagtactgtacatgtactagctaagctactgtaattgtctgcttcggtatctatcttgtcgatcgtagtgtcattgctagtggctcgtatagatcgtgggtttgcactacttcatgcaaaaaccggtttgttacgtacgctgacgtcagatgatgtccgggcccggcagcaaattatgctccaataatcaccggatggagttcatcaaatcattaatcaattcgagcggcttcttcgactgcaaatctatgttgattacaaccacacaaaggcaaatactatatctaattaattgacagaccacagatgaattgccggcagcaggggacgactcatggccatgacgagcggtttgttggtgatgaattgatgattcgcaataatttacttgtacaccacaaacataaactgcgaattgtcacctcagtggtgcattagctctgctacccaattcagtgctccgtaatgatacgagtatctggtctctgatacactactgttcctctacttgggcgcacaactctgaaccatgcatctccagagctcagccgctagctcaccgatcagatcgatcgatcatttcctgatcccacttaaacctggcttagtttcctaaattttttttctcaaaaacatcacatcgaatctttgaacacatgtatggaacattaaatatagaaaaaaacaaaaactaattgcacagttagtggggaaatcgtgagacgaatcttttgagcctaattagtccatgattagctataagtattacagtaacccacatgtgctaataacagattaattaggctcaaaagattcgtctagcggttttcaggcgagctatgaaattagtttttttattcgtgtccaaaaaccctttcaacatctagtcaaacatatgatgtgacactcataaattttcttttcgccaactaaacaagcccttaattcagcgcaagctatagcttcaactgtggtcgctcgtgcacaaccgtatatactaccgccctacctagtaagctactaccatttccagccagaaccaaacctaattatggaaccaatcatggatgtaaaatgcaacttattcttcatgctcacctctagttgtttttttttttgcctgcccaactgttactggctatgactcatcagagacgattggtatagcttcaattctctctctcccttctcgctctctcccgctttaatttgcgcccacaagaacactatccacggctttattttaccttttttgctgcaaaagaacatgtttgagcaggtatttcttagttggttaggtgatgcttgtttcttggcccatctccacaaacagggaaaaatataatggcgtacgtacaaatcagatgcgtctctctgaagcacttgatggtagtaaaaaacaaggtttatgtttggagaaacagttagtttactgttgatgacaccttttaagtcgtcttgagtcgtcaaattctgccttgtggatggcattattaggacagaaagttatttggcgtgcgtccgtatagcccagagggggccctgaaagtttttctttaactttgtgttcttgttttctgccgcttaattatttaaatggcacctagctttgtaatagtacgttgtacgaaacttttgattcaactttgaggcaatgaggccatctagctacccattattgcaacttgccataatctgagatcgagcgtaatgttgctgccttcagcaaattgctaggcattgcggcctcatgcgcctcccactccttaaatgacaattaaatagttgttgaaattttagagtttgattttagatttaattttaggattttttttatagctttcgttgcatagctctctttttattatcgctaagaagacaaagaagtagtctaccttaaattgtttttaaacatcaaacttcataacctctgcagctagcataactaagcatatatattaccaaactcacaaattgccaatctaaaattcaacaagatctctatggaaaaacatgatattgtgtacgacatgtgtttgtcactgtcacaccagccacgcatgcaagcatgtgacaaacagtactgcttgatccatggagcaaacataattaagcaaaccattctacatatatttcattagttctcgcacaaatcatatattactattacatttttcgtctttctatatacactagtaattaatcctttagttccatgctactagctttttaatcttccttttaaatttatctgcactagtttaattactttctctctcttcttttttttaattcttttttcctctaattaaacaagtcgctgcatgcagggatgaccggagatgatctctatctcaggcatgctcatcacatcatcagtaacactggaggtcctttttctcggtgtagttggggaagccggagctgaggcacgacaccggcggcacggtgggcgtggcggcgttgccgtagacgttccagcagaagggctcgtcgacggtgtcgccggacgccggcagcagctcgacgtcggagagcgtgatgttggtgcacggcacggcgtcgctgcagccgaagtggatgggcgggccgcgcacgtcgtaggtgccccggatgccggagtaggagacgccgttgacgaacacggcggtggtctcgttctcgcagctcttggagaggcagtagtactggtcgatgatgatggggttgcgcaccgcgtccatcctcacgttctcgaacgccaccgccgacacggagccggacccgccctgccacgtcttgatgcgcacgccgttgtccgagtgccggatcaccgcgttccgcaccgtcacgttcgccacgcacgccttggtcccggccttccccaggctgccgatgctgatgccgtgcccgggcccgcaggtgacgttctcgatgtggacgttgagcgtgccggcgccgatggagacgcagtcgtcgccgttggagacgacggtgttggtgatgaggacgtccgaggtgttctcgacgtggatgccgtcggtgttggggctcagcgccggcgagctgatggacaggccgtcgacgcgcacgccgttgcagttgtcgaaccggaagtggaactccgggctgttctgcaccttgagccctcgcaccgtcacgttgttgctgatggcgaaccgcatcgcctgcaaagattagcatcgtacttagcactgattacactgtcactaatcagaggcagttaatacggttaaaaggtcgttgcgttaggccactcaccactgggctgtcacatggtccatgagtgtttcccccctgaagaaaaaaagaaggaaaaaaaatggaaagctattagattcagatagatatgtactccaatattgcaagagtagagatgcaattaattagttgagcttatataccttgtgaggcttgcagggaagatcccaccatttctggcccttgccgtcgatgaggccggcgccgacgagcgacacgccgtcggcgcggtagaagacgagccagttgcgcttgttgttcgccggccacgtcgccggctcgctcggcgcgacgatcgtcccgtcgacctgcagcgtgacgctgccctggcagggcccggtgaagacggtggtgtggatcaggaacgagcgaccggcggcggccagcacgacgcccgcgccgtcgtccgcgcacgcggtgtcccacgccgtcttgagcgcgtcggtgtcgtccgtcacgccgtccccggccgcgccgaagtccttgacgatgtcgtacacggtggccgcgccggccgcgggggcggcgctcggcgccccgccaggcattgggtcggacgacggcgggttggccggcgccggggccgggggagagcgccgccccgggtgaggagccggcgcgccgtggtgcctcgccggtcccggggcgtgcctcgccgcggggcccggcgcctgcgacggcgggtgcgcggcgttgcgcttggcgtgcttggcgtggtggtggcgggcactcctcgcgccatcggcggcgctaatgaagctcgacgcgaaggcaagcgctagaagcagcgcaatggcggcggtcctaccggctgcggcgagctccatcaccgcggaaacctatgaaaaactctaagtgcagaggcgttcgtgcagctctgaactgaatggtgaatcttggatggatggatcgatcgat

SEQ ID NO: 11246 - DNA, 4645 bp, Oryza sativa
ggggggggggtatgccatgcgtgcgttgcgaaattcgggcccgaatcttcctctcccccgtcgtcgccggggtgaccactgtttctactagtctactagattagtactagtctttctactgccaccgttgtttaatccaaatcgagcagaaaatggacgtgaatctggcgaccagattggccgatcgagcaagatgcgtgcgtgcgtgcgcgcatccttcgcggtcagacattgcagctgcatgcgactactgcgagtgcatgtgtgatatctactactagaattaatcgtgataaagccaccactagctagagaggaggagatcaagagaaaaggctaagctaggtggcgcgcgctttacaactgaattattaaccccgaggggcggtgctgatcactgtactggaagtacatggtagcattcgtgtgcgctggccaaaagtttgattgctcggttttggttttcattgcggtaattcgtcgtggccactagatttctggtggtgctgccgtggtccatatgatccatttggttttaaccatttttctgcccgatattggtgtgcatccgcgtttcagtgcagcactcagggctcacatcaggtcggtacgtacgtagctgctagagattgcacggtagcataaatatatactgtctagctagtagataggtagcaagcctagcatctatcattgcagcttgatagtgttagttagtactagtttaagacagtcatttttgttttgcataaacaaaagcaggcgttctgtcttggcaactcgctcggtgcctggccgaccaaccatcatatcagtaaaattgttggacattttgcaaagtgaggttgtaggctcacatcaaaattgactaggactaggtcaccagaaaacaggcaaaagtctgaaacatgagtatcagactgaataaattgtatagtggaggagagaaacatatggtgcatgctgtacattcagctgtgacacttccactgaaaatagttgaaacaagcagagaaacataaggcttggcttcccctgacagatttgaactgaaccacctcttggtttctcttttttttcactacaagacaaccaaatctaaactgaaccacctcttggtttctctcttctttcttttatatgcactacatgacagcacattcagttgcaaaatcagatatctgttcttggcacacttggcagtattggggagaaaaggattctcttagttcagtgcaagcagctcttgatacggaagtgtttaaactaatggagtacttggttggtggcagaacaaaagagcatcctttgttggaaactggtattgtcaagctgcacgccttgggtggatggatttccggaacaaaagcaaaaggtagtatagcaaattatatagtatatgcaattatatctagaacatactagctactattcagaacataaatctagtcatccgtataaaaacttgcgcacgcaagacgcaagtgcatgcatggcgtgagtgcatgggatcccattgtattcctcaagaaaaacaaaagcacaagaaacaaacgatatggcgtgagtgcatgagatgcatcccattactcttcaaacaaaccaaaaaaaaaggcacaagaaacaaacgatgtaacaatgctataaaatgctccgttctagcaataacccagggattcagctcagcaattcatgattgaaacggtcatacagacagacactgcctctcaccaaaaatgggttttcattcaggagtgatatatgcgtaccttgattagtactttgacaaaaaacgagacattaattggaatgctccttacgcccttatccatcttgtaatcaaacattcaagctaacagaaatcagggtaaaaaaatggaatcatcgaggcgcatcggtatataaaatatttaatcatttgcttgtaatcaagcattcaagctaacagatatcaggtgtacaaaatcaacctcgaaataatgaggtcatatgttgatacatgccaaacatttcaacattgaacagagttgtttaggtgtttaaaagtggcacacaagtatatcacataacaatagaattaactcatgtaagtttatcagagtgttaatacaaaagaatgatcaaatacaatcaaatagcttgtaccaaacagatgtctcaactcttcacacatagaacttttttggcttagccctacaaactggaagacttaaatctgatggtcggtgaaacctgatagaggctctggaatgaaatatggctcaagcatacatacgtgttctttcttgcttgatacagcagagtgaataaagttctcaagtcaagggcagaccaatatacaagccccaatcaataaccactcactccatgtcttcatctgctttacagaatatgatggtagaaggcatgcccaagcagggtgcacgtagaacaaaattagggcccattcaataatactgcaggccatgctgttctacggaaccaagtagaccaacgtaatacccgattagtgtatgaactgtctgctcataatcctaagaaggcacattgcttcttagcatgctgtggaaccaacttcacaagaaattccattgatgctcctttcagctctgttcaagttcagtagttagcaaatcaggatattgctgtcagggtgtttcagttggtctggcattgacaaaaatcttaacttaccaagaggcttgaaattgaatagtgggggaagagtacggccatttggtaagcgagcatttggatcttgtagttcatcgaagaatggatgaattaacacctccaactggtgcgaggagaaaaaaaggaagatgtaaaatgagtacatagaaacatttacaagagatttcttgatatatgcattaatacttactgcactgcaccggaggtgtggtgagtactgcagaagccgagacacaagatctacagcttcagatggcattcttttatgaaagatctggtgaaagtatgcataattagaatacacattataatttataaatagtaagcaggagacattaactctgaaaataagaggaacaaaataaatgtgaaggctcctaccttgtgccatgggtgagctttgatttgggggaacttaaactcagtgtagttcggattcatatgtttgatttcttcccttgttggagtacccagtacctgaatgaagtacagtaagtctcctgcatgagctaaaagaaaagggggaaactacatagaataatattccactaaactaaatcagatgttaccttgataatttcaacaagttggtcgacgccactgtcaccaggaaaaacaggctaaccaacagcaaataattcagagaagttgcttcaagaaattgggtaatgtatgatgacaactaggttgacttcttacctgccctagaagtagttcagcaagaacacagccagcagaccacacatcaatagctgtcgtgtactctgtagccccaaatatgagttctggggcttgtagtatctagaacagatatatgaaatatttggttcccctttcacctatggacacggcaaggtaaatttaagaatttcagatagcttataaaagatatgtgacctttttttatgaaaacatatgtgagtgaagattactctaattgatacaggggatcataccaggacttttgcactgccaaagtcacacaatttcaactgatgattatgtggattcacctatgacaggaatatcttgtcagacctcattaagctgaaattatcatatacggaaaataatgttgctagtatgcactactcagacaaatgataaccagttaaccacagtacataccaatatattctgtggctttatatctctgtggcatactcccacacagttatgaatgtatgccaaagccctacaaatctgaaagaacagaaatgacaatgaacagttttcagttaaaatcattatcaaaactaatagtgcatagctatagttgtgttgtaaggcgcctgcaaccttacctggtacatataaagtttaacataaatcaatggcatgcgttggctcatcttattgtaatgtctaataacacgatgaacagtttctggcacatattcaagaaccaagttgaggtatagctcctccttcgcagtagtcgagcaaaagtaatgcttcaagcatgcaacatttgggtgatcgagaacttgcatcgtttgcagctcccggttcttgtatctcgcatcttgaagaactttctttacagcaactctctcaccagtttctagacacttagcctgtcaaagataatttaattagtaatctctaaacagaaaggtaatgacagaatggcatataccaatggcccacctggaagacaactccaaatgaaccacgcccaacagcacgctctgcgatgtaactaattgtctgcaatccaataaaaatccagtactataagtttttagaaatagacaaataatggcacataacggcaattttttaataatgtggtagtgtttgccacataaattctatctattgcaacatgaagtactacagtacaaacatagtagtgatcaccatagaccaatgctatgtcagtacctgctttggctgcccatttcttccaccaacagttgtcacaatagtgtgacctatgtccatacta

SEQ ID NO: 11247 - DNA, 8131 bp, Oryza sativa
gatgaagaatctactagacccaccgatgtcataatagccaagaagttttgtaccttctggttcactcctatggaccaagatcctttgttacagagctacacacaatccacctgcaacaacaatcattttagcaggacacataacctaggtactagtagaaaattgcacattagaaacatatatccctgcaaatctactaaataaaaaaatgttaatggttagtcctaactcctatgaattagaagggccaaaacatagttggatcttcaggtacccatgatgccaaactgctgagcacttggttacaccaaacaatttgataagaaataaaacaagctcatattagctttgttgcgctcaattcgtatatcgatgaccctatgaaacactatatcttcccaagttttgagaaatgaatatcttgacagttgggtatacagaagtactgcaaagaaatatactaaagctggagacttttcatccgaatccagatcatcaaactttggtcaaaattaaaagcataacttaactaacagctacttattagaactcatacttttaatcgtcaataaaccttacatccaaattgggggcttttaggcaatgcatcatatttagtccttaaaaggagatggggccaattttgcttgagaccctcactttggaggatcttttgaggctagttttatgtagacatgttgtacacatgatcttctgtaatgaaagtgtacccttttgtacagatgtctactatctgtgtggttcattggtctcatgcgatagtgtatataacacatttttcagatttgagcatagtaccccccagacgcccccatcctcacattcgacatgtattaacatgaaggacttcaccaaagctcgaactttctaagttcttaggtttatacactacaaagaaatgtgtgaggttccgcccccacacactaacaagcaaaagtacatgacacagaacctaaatagctgaattctccctgctcagaaatttgagccgtactgttatagcacatagagcctcttcggcattccaattcaaagcagcacaatccgaattatccctgctcggtaattcgcctctcaccttatagtgtaaagaactctccttggtttttccaatccaaagcaaccacaccactctcttttttaaggtaccaattaccgacaaagacaccattccgaacaataactaaccaagcagatggagattccaaacgaatcgcttttgcaaaacaaataactaaccaagcagagatagatagagagagagagagagataccaacggatcgcttcggcgacggcaacgcaaacccggaggaggaggtagccacggacgcgggagagcgccgtccagcagcgggcacgccctggaggccggatctggagcctggagccgagcgggcgtagtacgtcggcgatgcggcgggctagggcaagcccgcagctgcggcgagggagcggggcaagatcggcgcggggggaggaggaggaggaggaggaggcgggattcggattcgatctaggcggagggcgatgagcaaaatcgccccccttcacctcactaaccctagttcgactcctctcctctctctcccgtctctccgcccgattccaatcgggaaggggattccaatctctgtagccgccgccgctcatgcgcaggccgggctgggccgaactgggcctgtattgggcttctgcattgctgatggccccgaaacggcctgcgacgtggcccaacaagatggctacactgtcactcactcactccgccgcttttcccttgaccccttcctctcgtcgtcgtcggtgcggcgccgccagggaaaatggagtcatcgaggctgcggaggcggcggcgctgccgcgtccggtgcctcctcgctcctcccgttgccgcccgtgcgcagcagctgcagcgcgtcgcatatttctccaaacccacgcagatctccgctttttcccggcggcaaccacgccgcggcaagcaggtgagaagagctcaactcgctgcatgcaagttgctcgatgaaatgcttccatggagccagcttctagtttctcgtgtacatgtacaatttactttttttccgttttctttacaggaattctctgcttcctagatctctaatcatttactttggagttcttagcaatgtttttgggtattggattctatcacttgagaaaatgagaaccgccatcccgcacacaccaaatgatgaagaaatggtatgcatacgtttagtgtgtttgtagcgttgttgacctttgagtaatgtgctgcaagtgagatgaccgattctttgttagttcctcaaggcaaccaacacatgatccgtatcctagcttagattgaagcatacggaactaagcagaaacccgggcgatagtaataagtttattgcatattttctgcacatggacttaggaaggtttcctcaatttttttaatgaactttggagggacttcttcagtttgtttagctcaattttaattcctcggtcagaggaactaagcagaaacccgggcgataataataagtttattgcatattttgtgcacatggacttaggaaggtttcctcaattttttaatgaactttggagggacttcttctgtttgtttagctcatttttaattcctcggtcagaggcttttaaccaaacacgctcaaagtcaagagtccaaatataactatcatagtttcacggcacgttgacagttgacactagattgccagcttgctcatcaaccaaatatcaccatacaatttccagtaggaaaaccaactacatactctataattgtttaacccatcttgttgtactttagtctagttaattgatagttatacatgctaaacccaggactagtattagggtgctagctacgcatacaagatccagaaactgctcacacgttacaggaatcaaataccaaagcatccagtgactgtgtcgctgttcgttctttggtcagaagtcccttacatgcatatatctcattctctttggctctcctcctcgcaacctaccacaaaactcatccttcaagtttccgtgtcttctcgattcagtctcacaatccccaacatgtatttgccatggctcattgtgttactctttgtcttggctgctgcaggtgtggatgacttcatatatgatatactttggtatatgatatacttcatatcttcatcatgttgcatatgtgttccctcataatttgttgtgcaaatgtgtggttttcttaacaactaaaactgtgggtttgtgaaactgtttcttatgaatgtgtggttcactgattgccttttgcattagaacttatagttttctgaaatttatcttactctgtttgttgttcttgcagttctagttataagcctgtgcagaatatgcagaagaaagaagtacaagatacacgacgcaggagatttgcagcaggaaaacatgttctctgtcttaaactttgatggtggaaatgcatacgagcaaattattgaagcgacggagaactttagtgaaaaatattgcattggagcaggtggttatgtgtctgtctatgtagctaaattatcaaatggtaaaaattttgcagtcaagaagataaatgcaacagagaatggccgtttgataaacgagcaaatgttctatcgtgaaatagaggccacaatgcaaatacgccacaagaacattgtaaaagtctttggctactgctgtacagcacgagataagtttattgtctacaagtatatgaaaggaggaaacttgttgacagctctcaagtcctacagaagtgcaagcgagttggattggaagcgcaggttatgtattgctcaggatgttgctcatgccctatcttacttgcatcacgactgttcagatcctatagtccatcgagatgtaacaaccaaaaacattctgctagatctggagttcagagcttgtttatcagactttgggatagctaaaatactggatgctgatggatcaggacacacaaggctcgctggtacaaaaggatatcttgcaccaggtaaacaaaatttattatgttgaacctactgttttgattattatttttcttatcttatgtatttttcttgttgcatgaagctgcattatattactaaaaaatatgctctacgctatacttaatatgcatgaagaagttaccacaatattaacataaattaatatttagtacattttaatctgactgaactcctgatacttcagagctggcatacactacgaaggtgacagagaaatgtgacgtttatagcttcggggtggtagttcttgagctgttgatgggatctcaccctggagactttgtttcgtcgatctcatgccctagcaagaaaagcacaccgatgaaggatttgttggacaccagactcccgcctccagcaggtgaagttgcaagcgagatatttggattgatcacggttgctatacagtgccttcaccccaatccatcaactcgtccgacgatgccatccgcaattcatttgttctccaagttttctagggcggttgatcttgattatctgcatgctgacatcatggagttctgccttctttgaaccttgacctttgtattcattttctacttgtggaatgttcccgaggataaagggaactacacaggtattctacatcttatgcctttgttgatgtgggaaggaagggagctaataggtgtgttgttttacaagaattgctatcatctttctttccccataattgtggtgttgtttatagttgaatatttgttttactttgatattgtatatctcatttaatatgcaagtttacaaaataatgtttaatgatgtaacctatgtttaacaacgttgtagaattgtttcataaattttgaaaaaaaaatcattttacttctcggaactatttcaccggagcacttaaccctctaaactattgttgggttcattttacaccctcaagatattgaaagcggttcacttcactcctctaacgctatctctcttttttgtttttatctatagaagtcatcgcactgaaaatttggtagaaaatatagttgcattcacaacttacgcctcaactttttttatatttttttctcactgtttatgtacgttggaagcagttaaaactgatttaaacatcaacattttaaagttcaagcaaacagccatgaaaaaatttcaaaatatttttgaactttgataaaggtgtcatctatggctctaataaattttagcttaaaatataacttttataaaagagtaacaaaaaaaatagagctgttattaaggagtaaactgaatcatttttaatagtttaaggggtaaaatgagcccaaaaaatagttcagggttaagtgatccattgaattagttcggggagtactaaaatgaactttttttctaaaatttttatggcaattaggaataaatgcaaagtatatatgggtgtaattgcgtaaaaagttgtgtaaattcggtcatgtcagacaaatgtcagcccaaactaggcccgtttaatgctaagacttgtcagtccgaaggcccaatctaacttgcgggcttgtggcctgtgcgaaaactctcgtggtcaaatctgaatatccgatacttccgtttcaaatgcaatccaaggccgaagctgagagagtgcaaagccgagccacggtggaatggcggccactcttttccccaccttatcgccgccggtctcctcctccgacgcctcatagcccccgccccctccccgcaggtacggtatcgtaccttccgctccctctccacaatgccctccgccgccggttcacgggccacccccgatcacggcaacctcctcatgctcggcatcgagaccagctgcgacgacaccgccgccgccgtggtacgcgcggctcatccccccccccccccctccctttcccccatggcagaccgcttgtagctgtggtggagccatgtctaggatttgttcttagtgccttggctctctgttgcctttgttggttgcaggttagaggcgatggcgagatcctaagccaggtggtatcttcccaagtgagacactatgccccccacctccctgtccagcacacttcatttctgtatatttgtcatgttatattctgtgcgctgctgatagtattgctttgtgcttacaacatttggaaggaagatttactcgtgaggtggggaggcgtcgcaccgaagatggctgaggaagctcatttgcttgcgattgatcgggtttggctttcagtttcagagtttctgttcagaagttgtgcggatcttgctgttttttacatttatgttaaagagttgctaactttttgtactttccttgcaggttgtccagaaagcacttgataatgcaaatgtgtcagaaagtgatctttctgcagtggctgtcaccgtaggaccaggacttagtttatgcctcagaggtatttgatgcttttgtatgtttactcctgatcaataggattatctggtatttactgttatgtcttaaatgctggcatggttctgaattttcagtttgttacagaatcttgtttgcatctttcaatcattccccacaaccaaaaccccgtgttctctctattagttcgcttattttaggtgcagtgcatttttcatcactaacttgtttgccctttagatggtgttacttgttagtagttctttatcttgtgcagtcactcgcaatgtcaacctgtaaaataatcgactgttgaaatgatacattgcatatactactatttacacagtcagagtgaactttattgaatttactttttaaccttgctgagtctctcttacatttctttaaaggctatttaacgaaccatataaattgcagttggtgttcacaaagctcgaaaaatagcaaaatcatttcacctgcctattgttggagttcatcatatggaggcacaggcattagtttccaggtatcgccttggtttttatttctgagttatgaagatgacattctcaactgatgaagcataagttcctttaccagttcaccgccaagcaatagtagatttctttagctcaaacgatggaatgttgtttactgttcatttgttagggattttacgtttttctctttatttttgtggatttagttttagagcacgactagtttctgttgtgaacttttgcacttccacttttttctattgtaaatttgtaatgtccactgggtagatatgttgtgttatccacctatcgtgactggtaggtcaacatgatgtttgctttccttctccttttgtgaacttccaggtttcgatgcgacaacacaaagattgcaatttctcttatgctggtctgaagactcaagttcgattggctattgaatccagaaacatgtatggctgttttagtccttgtgccattgtcttcatcgtacgattaatatgcctgctggtgtgtcaaataaatagtgtatttggcatgctgtttgctctccttgactacagtattctagattaacaagcagagacttgactttaactctcaataatctacaatacttgtttttttaattttactgaaatgtttttatatcaatcactaggaaattaacatgaaactattgcagccgttcctacaagtttagtaagtctgtctcaaccatgcaaggtcattgttctttttattaattaaagaacacctacataggcattatatacaataacctgtgctggaaatgctctagatcaaataacaagaacaacaaagtgggaacaataatgttaacaactaacaagaggttgcaagttgctagaaaactgattgttagaataggtatagaatgtttctgtttctttattggagaaggaacatttttcattattacatgaaacagacatgcaatctcattgattgtaacatttggtctcgtaactcttctgttgtttttgtgctatggtagatcaacagatgatattcctatttcatctgctacaaaagatgacagacaaataagggcgaacattgctgcctcttttcaggtttttacattataggggatgcattttcattattcattaagattttggtagttttctgatgttgacctctg

SEQ ID NO: 11248 - DNA, 1379 bp, Oryza sativa
ttcaatgaacattgaaatgtgaggcttggatagattatatcgtgttcttgatcttaatttgggtagatttggcatatatgtccttgtagtcccaagtaactgcatttggcactatagttgaaggtcggtaattccgtttacctcaagtcatccagagtcttttttttttttcaccctcgactcccaaatctcaatactcaaatctcaaaagtagcaaattacctgccaaatttggttttgttggcattttcatcttgtggtctaccatattataagctttgccatatggtcatcgaacaggtgagcttgtgttatgtcaaaatcgaatccaagccagtcaaacagtcaaaccacattttcaccatcttccccatccctatagctgcctttatgttcctcctcatgtctccttcaatttgacacccagggggattgatcaaatcggcttggcctgtgagcagagctagtcagtatttatgatatcagtagccatgtgatggtggcaggtcacgaagatcaatttaggagttattttttatccaaatgtttcctataattaatatcatagaagatggaattcgcacatcgtcagaacttagaaccatgccgtctaattttcttacattaaattagaacacacttcagatcgacctgctgtgtatttatgttatggaaggaatcttatacttggtaattttactctactcctgacgttaatacagtgtaagttctatgttttataagactgactggctgttatcatgcctgataattgtcttaactggtacagtatgacctgcgtccaaggtggcctcttggtgaggaatattcagatggaagatgtgttgcacggtcaatgaaaactgctcgagtccacccatcactcgcatggatgatacagggttctgttcattagtagtttagtgaaaattgcaggagcaatacaaagatcctgttgatatagaaattggattgtgtttaggaagtatgctatactacattgatagtttgtatattttggtatattccattcacttttatttagttgactcactctttgaggtatcagtaccagacacacaaaagttacttctggcatttgtattgtttggactgctatcctttacattgataatattagcaaatacactctcctaaacaagtggcgttcactggagagaagacacttcctgtttgatttcagttgaatgcttgcattgctcttttaatatttttgcgtgtaggatccactcgctcgtccgttgaaaaagcaaaggcaatgccactcatccaactgttgtgaagctaagaacttgatgcatttgcccattgaagctagtgtttccatgtgccatgtggtttatcagtttcagttttag

SEQ ID NO: 11249 - DNA, 1846 bp, Oryza sativa
gacggcgagattcattcccgttaagacaaattatagcagtgctaagctagccgagttatacatgaccaggatagtatgtcttcattgtgtaccaaagaaaattatatctgatcggggcacacaatttacctaccatttctgggagaaagtccatgaagccctaggaagttatctcgcatttagcacagcttatcatccacagacagatggccagacggagagaaccaaccaggtcctggaagacatgctgagggcttgtgctctggattttaacaaggattgggagagatgtttgccctacgccgaattctcctacaacaacagctttcaagcaagcctaaagatgtcacccaacgaggcattgtttggtcgacgatgtcgtaccccgctaatgtggtccgagactggagaacgggcggtatttggacctgacattattcaagaggccgaagaaaaggttcgcttgatccgcgaccgtctaaaaatagcacaatcacgacaaaagagttacgccgacacccgaagaagaaacctggaatttaaggagggagattacgtttatctaaaggtttctccgatgaggggaacaaaaaggtttaaggtcaaaggaaaactggcaccaagatatgtgggaccattccagatcattgccaggcgaggagaagttgcatatcagatacagttaccagagaatatcgcggatgtacacccagtcttccatgtatctcagctaaagaaatgtttacgagtgccagaagagcaagctccgctggaagaaattcacattagcaatgatctcacatatccagaacacccgatccggatattggatgaagccgaaaagaggactaggagcaaagtgtggcatatgtacaaggtacaatggagcaatcacactgaggatgaagccacctgggaaagtgaagaatttttgaggacggaatacccgcacctattcgaagactggtaagaaatctcgggacgagatttatttaaggggggtaggtttgtaacactctgaaaattcgaccgacaaaatcaaaactctaaaaatacagatcttcaaaaaaactttttaaataaattgcatcatgccaattttattcgacgattttattggattttgatttcggaattcatcgatcacaaataggggaaaattaattaggaattaaccctgcaattagatttggttaaagaaataaataaattataatttaaaataaagattaggtgggatagaaataaataaaatattatcgcgaccatatttggatcaattaaatttaaatacgatggaataagaattaaccctaaataaaactcaaataaattacataaaaataaaataagagtaatattaatctagggcaaattcattagttgagataatacacatattgagtaaacttcatttatgcaagatttagaaattataaaatcaaattcatataggaaataaactaaaattgggaaaaataggaaaaagacactattcattagcctctaggtgttcgacgaggctccctagccccttcccctcccctgccatgcgcgcctcgcgccccgagccgtcgccgtcgccgcctgccgccgtgccgctgtcgcctgccgcgccgcgcgccgctcggccgtcgccgtcgcgcctcgcgcctcgtcccgccgcgcgccatcgcgttgccgcccgcgtgtcgccgtcgcctgacgcgttgccgatgccgcgctgctgcgcctcgtgccgcgcgcgccctcctcgcgccccgcgccgccgcgccgcgcgcccgtactgtcccgctgccgcgccgccgctgtctgccgcaccgcgcgccgcgcgccgtcgcccgtc

SEQ ID NO: 11250 - DNA, 10612 bp, Oryza sativa
ggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaaataaaaaataataagttttattttttaagttgggcattaaatgattatattgcttgtattttgtataagtttatttttcatatgaaaatttattgggtaggtaccacacatatgtataatatgggtaatatagtcattttaaaatatttaacggtcaactaatgatcaactaacggatatgggtatagaggagatcaaaatgaaaactcaggggtatataagggataatgtcaaattcaggggtattgaagggattgagtaaattttcaggggtatatagggaattttctcttgatcttttgggtgtgcagtgtgctaacatcttggtgataaactatgtgcaaagctctggtttacccgactccgttggccgggtatacgcatacagaccgatccgcgtgccggtgtcaggggctctgcctgcgcctacccgcgctgtaggctgtagcgatggcagtcatgtcaccacggtgcgacacgaatacacgatgctgccgagtgcgaactcgctctgcctccaccgagagagcagcgtgtggcacacgtgtcgtgcggcgcccgacgagcaaagctgttgtacacgcggagtacgcacgctcctctcggcgcctcgccgaagcgcgcgagttgcggtggtacacttgttcggacgctacgctatctgcttcggctcatcgcgcggttccgcgacacgaagcgtaatacacgcgcgcgagccaaaatcgaatcaaccaaccttctgcaacgccttcttttcttttttttcccggtgaaacgcggccgggcaggcaggcggccacgcacacgcacacgcacacgcacacgcacgtacactggcgcgcgcggacgatgcttttcccgtgtggcggcgggagagaaacggcgggtgggcgggtgggcggcgtgggtctccgtggcgccgcccatgcagatgatgcagtgtagcacggcacggggaacaccgggaagaggagaccgaagaagaggaggacggtgtggttccggcggcgcgtggcgtggcgtggctgggcagtggccacactgctctgctttgactcgggggtcgcgggaagcggaagctggtggtttttgctttcgttgggcgccccacgtacggggttactagtacgggaaggcgcgggagaaaacggagaatcgcaccggttgactcgacgacgacgccgccgcgtagggggggaaaccgaaagatgaggcagggtggcgtgcagggtacgcacgcactgaggggcgccgtcctcctgcgcccactccacggatgacggatggatggagagctgccctgcgccgagggggaaagggcccctctgacttttcgcatcggctctaattaatcccaacaccgttgaaaagttacgcacgctagctacgccttgatccttttgattgtttgattgattgccatttgaaaaaatgcttccgtgggtgtccggttgtatataaagaattactgaccatagttcacttaaagtagaagtgcatatcaaacttacggtgaatattggatctgtaccctctaccaactatagctattagcagacttggcaaattgatgttagggggataggggcacaattttctctccgccgtttttcttctagtcaatatgcctagttattttctgagtattttcgttaataatcacgagaggctccccgcaaaaaaaaataataatcacgagaggcaatcggtcacgaatgaaactatgaaagcatgagctcaattgtatatagcaacaagaaaaggctaaggctgtgttcggacccagggttcccaacacctctccatcgttttccgcgtacacgcttttcaaactgctaaacggtgtgttttttgcaaaaagtttctatacaaaaattgcttaaaaaaatcatattgattcatttttgaaaaaaaaattagctaatttctaattaatcacgcgttaatggaccgctccgttttccgtgcgaagaagatttgttcccaacctcccccagcaaacacagcctaaatactcatgtgtttatgctagtatttaggggtgggcataaaaaaaccgaaccgaaatgactgagaccaagaaattcggtcctaaacagtaaaagaccgaattttattcgatcaattcggttagtctcatcgcttaattgaatagatcgaattaacaaaaaaaaatctaaatgtaacctataatccactaagttcaatatgattaaactctaatttccacaatcctacttcttctaggcatgcaacctaataagagtctttactcatacgtgcttacttttttttatgttgaaaattttcattatttctttgcatataaaaaaatattgtggaattttagtcaggaccgagaccgaatttgtcgatcctaatatttttgtgttgaaattcggtcttcacttttcaaagatatcgagaccgaaattttcagtcaaaccgaatacccacccctacttgtatttcgaaattaacatacatcatttttttaaaaaaaatatagccgttatgttaataactgccagtgtaaatcctttacattcctcaactactaataacgacgagtataaccgtacgctaaaaattcctacaccacataacggaaataaacggcattcctaatcgagtttcttcattaaaaaaaagcaaaataaaacccctaaaaacggacggtctccggtctccacacgcgaaaggcgtgaaaccagtgcacgcatcacccatctcgtaagccttagccaaacgaaacacacccaacacaacaccacacaaggtcggcaaaccaaaccccacacacggccacaccgtcgcgcgaacgcgcacgtgccggtaacaccggtacaccccccgcgcgtcgccacttagccaagccggtcgcggccacctgccggtcacctccgcccgccacccaccggctaccgcgggtggggtttgggtgcgcgtggccccccacacgcgccaacgcgcgtaaataggggcctccctcttttatctcagccgctttgtttgtttctttctttctttctcctcttcggatcacgcaagaagaagaacaagtctccgtgttcgtgttcgttgtatgttttccccggaaagaagctttgattgcagccgagtcaaaatctttcgagagagagtgctttgcgtgtgatcgagagaggtgttgttggaagcttggttggttgggggagttcttggtttggtttgtggggggtggtttccggttggatttcgcggttggggaggacgagcgggttgttgagcggttcgggggaggaggcggtgatggtggccggggcggaggtgatgcatcaggtcgtgccgctgctggaggcgtcgttccaccgccggtgctccgtgaagggggtcgacgaggtgtcgccgccggtggaggagatgtcgccggaggctgcctcggaagccgccatcgaggtgcctgaactggtgagttcttttttctttttcttaataagctaatagggggctttggctatctttttcagtttgacgattcgctaattctagagctgggcaataactcgtgtttcttgattttttggtaaataaatattctaataattgttagtgttcctgttgttaattctagaatttttcttgcttatgagttgaaaaaacaggagttttttcttttgctttttaatcttggtggaatttttacttgtgattgtggcaaggtggtgagtacttactcgagtaataaaaattaatccaacaaaattggcagtacggacgcaataccgtgtcgtggttggattagattacggttataccttatttgttcaagtattgcggacttttactttgaaattgaaattcgcacatattgagtccatatttgaccaattcagtattgaaatgttcacgtggctaaactttttggttaatctagccagttagatattttcatgaaacatccctaagaaaggatgaaaactatttgaatgattggtcggtgtgatggtgggaaactcaagactaacttaaaaggtggaaacattttccacgagatgcagtgtagaatttaaaagctgaaaacgtttcccacgaaatatagtgcaggatgtctctgtttttagtcggcatactaaagagggcatgctgttcaccttggatgagcgtcaccataattaactcctttttgtgcttaatgcagatggttaaggcacccgtggaatcactacagttttcccccaacattcgatctggtagctttgccgatattggacctaggcggtacatggaagatgaacatatcagaattgatgatctttctggtcatcttggctcactgttgatgtgccctgcacctaatgccttctatggggtatgcaagaaactaataagagcttcaaccgatttttatcatattttgtactgcgaattagttgattacgccgttgtatttttaggtctttgatggccatgggggtccagatgcagcagcctacatgaaaaggcatgctataaggctgttctttgaggattctgagttcccacaggcattagaagaagatgaatcattttatgaatcagttgagaaatctatccacaatgcattcttgagcgcagaccttgctctcgctgacgatttggctatcagccgatcatcaggaacaacagctcttgctgctttgatatttggaaggtaatgtgaacatgcaatacatatctgtgtatgctgcagatcaccatgcattatgcttgtatgtgtgctcatttctgtttccatcatatgtgcaggcagctgttggtcgcgaatgctggggactgccgcgcggtcctgtgtcggaaaggtgtagctgtggagatgtctcgtgatcacaggccaacatatgatgcagagcatgaaaggattaccgagtgtgggggatacattgaggatggctacctcaatggagtactatctgtgaccagggcattgggggattgggacatgaaaatgcctcaaggctcgcggtcgcctctcatcgccgagccagagttccagcaaaccacactcaccgaagacgacgagttcctcatcataggctgcgatgggatatgggacgtcatgagcagccagcacgcggtgaccatagtccgcaaggggctccgacgacacgatgaccccgagaggtgcgcgagggagcttgccatggaggcgaagaggctccagacctttgacaacctcacggtgatagtcatctgctttggatctgagctcggtggtggttcaccgtcttcggagcaggcgccgatcaggagggttagatgttgcaagagcctgtcttcagaggccctttgcaacctgaagaaatggctggaacctaatgagtagatgatgatgataatgggcaggctttttgtttcctgctgtgtaaataccttatgacggctgttctcacacagccagcaattttgtagggagtcgtttttttttttttttttgttgtttgccccttcatcgatgtacatatatactttatcgggttcacccgttcatgtattgttaccgtgccccctcagtgaaaatttgcagtacatttgtcgacttgttctttccagtttattctttattgtcatgttcaattggttatactgcttgattagacttagctagattgcctatccaaaggattgaagacaatgtggatttttgtccttcattgtgttctgctcttggtttgcatccaccttagatgtagacagtactttctgtagcatagtagcgtgctactctagaacagaggaatatgcagtaacctgttggatgtagaatgggttgtgacgagaataggagatcttatgcaaattccgacagagaaatcatggagcaggagtaacaggcgaaaaaggtttctgctctactccacggtagctgccatcaccgtgatggaaaggaaaacaggggcagccgcgttgtttgacgaggctgaaaagataaggagtttccgcgaccgcgcgacggcgcagttgagttgaagatcccatggctttgacttttgatcgactcgcgttgtatttacctgcctacttggtcatcagaagtacacctcggaagtgttacaaggctgacctgaatttgtaatgcttgcaatgagcgttattttcgcccccaaaacatgcttacgaagtcaagtctggccgtcaccttgcaatccaaaagaaatcgtagaaacattacatacatgaatttatatacaagttcaccccgaaacctagtcagagtatgacaatattgcgaccaatattgtctttttggtgtggtgtggatctctcataggtaaacttgtccaggcacataaacttgtttgattgttgtgcaaaagacttgagtacttcagattcaggggacaggggacgcgtcacggcaaacgtgtggaccgggggctctgcgaattcgtcgtcggccatcaccgaccgcggtgctccctgagggctgggccatgctacggccggcgcgcgtcggctggcctggttggagttgggccgcatgggccgagatggcgcaccgtttatttgctgcaagcaacggcagcaaccagtccggactccggacacaacacctaccggtcaaattgtcaagtggtaactcgacaagaaggcagcaaagccagcaactagtccctgtgtggctgtgtgcacttgatcactttgatgagcgatcgctcgcatgatctccttgagcttaaacccagcttaattagctcctatggcaaccctcagctatgccctctgtttcgccatcgtcgctggcgccatcgcggcgtccctctgggcgatgctgtcctcccgcaagcgaccgccgtcggatggatcgtcaccaccgcacgcggtggacgacgccgccgccgcatcgatcggttcggccggggcctccgcgatgtggagcagccgctggagcggggtgcgcccggcgtggctgctactcgcgtccagagccgccgccgcggtcgccctcgccggcgtgctactctgggacgcgctgacctacgacctcaccatcatggtgtactacacggagtacgtgtctagtgtcaacaataaatcgcgtagttttcttttcccatacctctctatctcgacaacaatatttaatttagtcttatttacaagtaaaaatgaattgatttcgtcccatcaaccttctcgcagatggaccttcatgctagagatcgtctattttgtggtactttctccacctcttttgcaaagttttcacgtactctatccgtcccataaaaaaatccaatcctagagataaatctagacatagtgtatgtctaaattcttccctagaattggattctttttggtacagagcgagtacgactcaatcgatgcacgcgtggaacttgcagatagctacgctcttttctgcatacggatgcttcatgtactcaatgcaccaccgccatgtcaccatgctacccgagatcgacgagagcttggtaggactcagcggcagcctaatggagatcaaccatggcgccgatcagaagggaggagctggactgaaccagctggggcgcttcatgcagattgtctaccaggtcagcagttatatattttaaccttgatcgtttgtgctggctgccgcagtgcagcagcagcccagcttcaccctgttgatgctgctgcaaatcaactgttctgtgtagatctgtgttggttggctgcagctgccgcagcaagcactaccgatcagaccctttgcctctccttcaatttcggagtgacacggagatgatccatcatccatggaactcgtataatctctctggcgtttcgtcttcaggtcttgggcggcgcggttgtgctgacggatgtggtcttctgggctctgatagtacccttcatgtactcctctcatttcagcctcaatgcagtgagtgacagtatgttgcagtagtcagtgtacatatatatcagctagagatgtgcagtcgtgtagaaaataaaaacaaggattaggcttaacattctttttgcgaaactaattaacctaaccattgagatatgctccatcgatatccatattttcatctgacctcagttttgcaggtgatgggctgcattcactctttcaaccttgtgtttctgctgatagagactactcttaacaacttggtactcaaaatcgaactaaacaaacttatgcccaagcaatttcgttcagaataacatatttcgttcttttctgaatatatcccaggagttcccttggttcagaatgacgtatttcgttctttggacatgctcgtatgtaatcatccaatgggtcgtacatgtttgtggcttgaaatggtgagatcaaataataattccatcggttgattctatttggtaaaaaaaaagttaacaacaaattttagtttgcatcctctcaatttgacaaacaatattctctataccgtcctattaccatccaatatttcagtggacaccaacggaatgggctacacacaatattcaagtagtactaataattcttaagaccaggttatttcgggcttcaaaatttttcagctgcatattaattttctttgaaaaaacgtacgtgcaggtggccgtacccattccttaaccctgcagcaccatgggctccactatggtacgtcaaacctatcatcggggcattagacatgtggtaatttggattcaagtcgattatgcttgaaccttttgaaattttgaataatcatgcaggtatttctgcatcgcactactccatttggcgtgctacaccgtgtattgggccattgtaaggggaacgaattggtggcttagatcttgtactatccccacgcgttaattatagtgtggatatataatggaatacaatagtactagtatttgtaaagggactagctatacagttgtgatttgtcgtcaaattttataactaaatttttttgacaaatgcaaatataatacaatcttaatataattacattgtaacttgcatttaactatagtgtaactttcaaaaatctctaattgacatgctattttcgtgaaaacggaggcattggtaccgaatcccctcacatgtgcgtgggttgtgattttttcctacccccgcacaaattttaaatcatttcgaacggttcaaaatcacattataattgcatgcaagttactacatagtagttacatacaaactacaaaatagttacattgagattgtactatatttctatctatcaaaatttttagaagaaaaattatcaataaatatatagcaaaatcgtttgtaaatgccacaatacagagactgcatccatatccattgttgatcaggtttatgtgtgtgtatatcttcggcacttcattgttttctgtaagcatgcttgttaccaaagatcgatgcgtgcagggcgagatacaaagcacgaagggcgtcgccgccaacagcgggcagcggtgggcagccgggcaggagcacctcgccgccggcatcgctgttccgagcccatccagcgtgctatgtggctggccaaactgcaatgggccgcagggaaaattaacaaacggcccgacaaaacttttagacccattaaagatggccctcattgtatcgcgaaccaagaccagcccgtggcaaattaataaacggcccgataagtgttgcggctggcgtgtcgcgtggaggatttcacacgtacttttttatttgtaaagttgcaaaaaaaaaagtctacgtttagtttgttaccaaatttagtaaatacataagaaatcctgctaaaagtttggcaatattgtcatcttgccaaaattttagtattgacaaaattttataaagtttattttggctacaatctgaatgggacgatgggaatcatgagccaacgtagattcactcccaacagtgttaatctctcttataagtcattttcatttccctttgtacatttttttcccgattataacttactctgcataacttcaaatataagtcgatttcgatttatgaatgaaaatcaagaaaagtatactacacaaaaagtttaatattttatttgtcaaaaaataaacattggacggagaaaaaggcaatgctaataaattcgaaagcaattaatatttgtgagtctcttttgttcacataagacacaatggcacataaacacccaccgctaacacatgctaaaagagaaatatacaagtggcaaatcctggctaactaatttaatttattaaaatcgtacttacgcgtgtgtaattattattgatacatctaaaacgggagagtaaaaaaaaagcaccatgggtataccgtagtcattggtaaatgatgctccctccgtttcgaaatgtttgacaccgttgactttaaagcacatggttgaccgtcgatattattcaaaaacttttgtgaaacatgtagaattatatgcttacatccaaatatatctatcaagg

SEQ ID NO: 11251 - DNA, 2179 bp, Oryza sativa
cagcgaaactaaagacaagtagcaacctgctgatggacgccatgtaccctcatcgatcgagtggggccttggcttgcgacgtcgcagtccctgcactacaaaatgcactgttgtcggctggcaagcgatccatcgatcgatgaacattgcggatctaaacaaaactggtatctttcactggtggagaaaccctttgtagtctcggttcataacccccttttagtcctggtttccaaaccgggactaccaatccgggactaaagatcgctatctttagtcccgggtgaaataaccgggactaaagatcgatctacaccaaccgggactaaagatcgagctgaccttttttttttttcatggcccggttgctgcatggcatatatatgtttcagtacatatatgcatatatatatatatatattatattatatttatatatgtttcaatacatatgtacatgcataatatatatgtatttatacatatatatgttatgcaaatgcatatgtgtgtgtatgaccaaaatatatttacattatagaaaatgtgtacacatgcatatagaaacatatatagtcatgtattaattacaatccattgtatgtcctagctagctacgatttcgacgtagtagtagtcgctagctcagaagctaaggacctatgaattgtgtttccgtcgtagaattcacccttgggatcaaggatttgttcgttgatgaatcccatgagttgttgttgaaccgccgcgataaattcctttgtgcatggtcaggttatccctcatgcgaataaactatatgaatgtatgaaattgattagtaattaaacaagaaatcgatacgtaatgaatttttgaatttatttgtacgtacattgagctctcttgtggtgatgatttggtctgcaagacagtggcaatattcgcacacgtaatagccgcacaagttagttcccttcttttgctttgcgcactacaaataaatgacaaacaacgagagatctaattaatatacacttgtatgtatttgaatcggaaaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataagttcgaaaaccttgtcaaacgtagactcttttttatccattgagtcatatatgttgacagtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtatgaacgtcttgtaatgctgcgccttcaagagatggacgagattgtcctctgtggcttgcggatattggtcgagcattgcgacgtttactttccgagggtcgatgaatccagtatcgaaaaccccccgccgtcgggccctttgaatctccattctacaacgataaaagggagtatattattttctatagtctacttatatacaaggacctaattaattaaaggagacgcagtaagaaatctaactgaacgatatacttacaaaatccagcaactcataatagagacgtcgagggcgtccagctggtatagttcgtagattcccttgaaattgatccaaagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcaccaatggctcgatctcctggtttggttgctctccaagctgagggactggtttagactttccagaagatgctttcttcagcgttcgctcatagtccgatagcttaatggcctccttggcaggtg

SEQ ID NO: 11252 - DNA, 6998 bp, Oryza sativa
catcagtactcctcctagtccttgccttgacgcatcacaatatataacaaagtctttcctgatgtcgggaagaactaaaataggcgctgaggtcagcttttccttgagctgctcaaagctttcctgacactgttctgaccacacaaacttcttttccttcttgagtagttgtgtcattggtcgggctatcttagagaacccttcaatgaaccgtcggtagtatccagccaagcctagaaaactccaaatttcagtcacagatttgggtgctttccattccgtgacagcctccactttagcaggatccactgctactccaccggccgagattacgtggcctagaaaagcgacttcttttaaccagaactcgcacttgctgaattttgcatataacttatgcttccgaagtttctggagaaccaatcgtaagtgttccgcatgttcttcctcatctttggagtagatcagaatgtcatcaatgaataccaccacaaacttatccaagtaatccatgaatactttgttcataagattcatgaagtatgctggggcattggttagaccaaacgacattactgtgaattcatacaacccatagcgtgttgaaaacgcggttttggggatatcctcggtcctaatcttcagttggtggtatcctgatcgaaggtctatctttgaaaacaccttagctccctcaagttggtcgaagaggtcatcaatccgtggtagtggatacttatttttgatagttacttcgttcagtgatcggtagtctacacacattctcatgctaccgtctttctttttaacaaacaacactggggctccccaaggtgacgaactggggcgtacaaatcccttctcttgcaactccctgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgttgcactactggcattccctttaggggtagcatggtaaatatacctccggcacgttcggttagcctaggatcttgatccatggttgctctcatatccgatccccagggtgtggtcagggtaacttctctacgtctacagtcaattactcctctatgctttgctaaccaatccatacccaaaatgacatcaagagtttggggtattagcaccataagattggagggaaataccacatccctaaggcggatgggtacgttaatgcaagctgtatccactgctatctcacccccaggtgagtgtactaacattggttgtcttagtttaactctggttaaattgtgttgttgacttgctttcaaagatataaatgaatgcgatgctcctgaatcgaagagaactttaactggagtggagttgagtgaaaacatacccatcagtacgccttggtcttcctgggcctcttcggctcgaacgtggttcacttgcccgcgtccaaatcctgtagcggtcctgttagtctgcggggtcctgaatagacctcgtccagcagcaggggtagcagtcccgtgaatagccgttgcattagttccggtgcgaatgggtgtcttgtttggatgtggacatttattggcgaaatgcccatactctccacagttgaaacagcttcctggccttactgatccagtggcggcctgatttggtgcaggagcgcggttctgaatggtaaccggcctgtggaaattgctagaggcggcaggtcgactggttgtcaccactgttggtctccatgccgaggaggttgtccctttaggacgctggggtgcggtctgaggcgtgcggttcatggcaagcctccttttacgattgtgctccacgaccttccggtcgttctccaacctaacgaccttattgattaaactctggaaactatcgtggtcttgtccaatcatgggcccgcgtaactcatcattcaagccttcaatgaatttgtcgatcttttcctcctcgtcggcaagatctctagttgcgtagcgcgccagctgagtgaaacggttcaggtactcttgtactgtggtattcccttgccgtagtctcctgaactcattcttcttcatccgcatcaccgcggcaggcacaaagttgtcacggaaggctgtggtaaattcctcccagtttggttctccagcatcttcttctcgggcttctttgtacgtgtcccaccaatctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggttgccttggttgttcgcgatagcttgcagaagttgagtttgggtggccataattccggccagagtgtttaagtcgggtgtctgagtttcgtcattgctggttgttgcccgacgtcggcttgccatctgtgtaggttgatggagtaagtatcctaattttctaactagctcctatggctttatcccattaagggagttgtgtcgatatgaactttgtttcgcaagcatggtggaataaactcatttacaacacaacaacaatagatatcataaataacatcacagagtttcacaaatggtacataaatcatgatgcaattgactgcatacatacacagtccaaataaggttcatccaaacgatacatcaaaccaatcatcaaactactcgtcaatctaggtaagggaggggggtgtctcgcatactatccaaaaaccatctgatacgagatcggagctgcaaggagtccgtcagtctagtcctccagccatccgcaggatctcggggcaggtagagggtggtcgctggctcgcgcaaaccgtagtccccacggctcagaggtagtggcctctggatctggcttgggcctcttgcccgggggtcgtgtgctcttgcgagcagtgctgagggtgcgaggtcctccaaggaaggtgatgcggggaacaggggtctcatcctctgaaggatcagtgatgtctggctcgatctcaggctcggtgtcggtcccctctgtctcggagtctatctggatcggagtctccaaaccggaacccagctgcggagaaggtgtagggatcagtggagtgtgcaccaactccggaacaggtggctgtgccgctgtagggtccactaggtagggcgctgactcggtagctagcatactagcctctcccagaagagcgtggaacgccggtgggtacggcggggtgaggaagaagtagcggtcacggcctactgctgtggaagtagaagcccctgtagtgctgatcttggctactcgaagctgctcctccagctggctgacgtgctcctgactctctctcagctgctcctcaagagtatccatcatcccgcggcgatcgttgtactggtcggataactgctggaactgatcgccgtggacctggagctgtgccttcagtgagtctatctcactgccccaagcctggtgctcctcctccaactgaagctgctgtgctgtgaggtcggtcacctcagtctctaactctcccacacgtctctggtggtcgtcaatctccaacagagcctcctcgtagtagtcatctactgcctcagcccatcgtgacaaccgagtcaccatcgggttgtagcagcagggcgtgtcttgaactgtgcaaactgagttgccctcctcccggaacgggtgatgagcaaactcggtactcactaactcagctcggtggatagagctgagtcggaggaaggcctcccgggcggcatcctgcatcgcggtctctggcaggtctcggtggtgacgttctggaagctgtagtccaactcggaagggactcggggatgaatctcgacccgagcctcccaaattgagccacactgtctcactcggtatgacgggaacccagggtatcgcagacgcctcaacatccgatgcagctcaatgacatacccctctgattgaggtaagctcaacttccaggtagcgggtgaatccgaatctgccatctaattttaagaaaaacccaaggtcagttgagagtaaaacttgttttgtaaaggaaatagttaagagtaagatgaaaagtgtaccgagttttgtaaacatagagtttttatttttgaaagtattgctaaatgggaatttctcccttggccaacttagaaaaggggtggggcgccttttggtcttttcctacagtcgtatggttctgataccagctctgtagacccccgtttttataacaggagtcaatcgtgtaaacagtaccatttccctggatcaagtagtttggtacacacggattcatagctggaataccaagtgcacatacacgagtgtctaatacgaattattacattataggcccgcaggcatagtcttaaatcatcggaccgagcggtccggaatacatccaaaagcagaaatagataaggcaacggaattcaggcagcggcatgccattgccacaggcaacgaccgtactaagacctactggacgccttcgtcttcatctccctcctgatagtaggcatagggatcctccgaggcttcatcttccgcttctgataaattttatatttgcaaggatgagtaccaaccgtactcagcaagccaccacagcaatgatgcacatgacagaggaattcaaaggatggctatggttcttttgcgcaaagcaaattttgtaattcttttcacaagcctaagacctagcatagattgatcaagttttaataccagtgttcatattaaacaatgacggttctgtccaccatccattgtgatcccaaggatagcttcccgccattgaatcgttatggttttctgaggacgtccacattcccgcctctcaggaagtggctccgtcagcataaaaatcatcatgcaatatcccatcccacacaagttaaagaatttagagtctagccaagtataatacatgtcccggtgctcaataaccgcgagcacggctattcgaatagatttggtttactcacactgcagtggatgtacactttacccgcactccgcgactgcccaacacatgagcctcggcccaacacatgagacgcgtcacggcaaagctttttgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctctcacacactcatggcagtcctaccaatggcgacaccgatgtagggcacgcctctcggccctacctcaacggctgtcccaacgtagcgcacctgcctcactcagaggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctttcacaaatcatgtcatcaacataatggcaatgtggcgcttatgtctccacatgccgcatctcaattaccttcccaaaggtaattgccccaagcatatagcatttgataaatatgagtatgcatgattctagaatagcatttctaagcaattgtcatagttgactagggactcatacgtaaacatggttacaaagatttaagggttagcaataatcaaggcatggcataatcacaagtaggatgttcatcattgtatgcaattttatttgtaaacaaaacaattttgcaattaggatcaacatgttcaaggaatagtgatgacttgccttgctcaaagtcttgcgggtcttggccttcacttggatccgcaactccctcgggctctatagttacgtgcaaaaattgatttgaattcggttagaattcaaataaaaatccaaataaatccaaatgaaagtcgaatgcgaaagttgattcctttttattaactttactatctgcgaactacggcaaacccaatttcgatttaaactattttgcgggtataattatttcgttgtcaataatttagtttccgcgagcattgtatataataggttagaaatttctaccacgagctaaatattggacgaaatcctagaaatgctatacaatttaatttagtctatgactaaatgattaaatataatatacggctaaaatccctagtaattaaatccgaatttctaccgttaattgattacttatagggattacccaaaaataatctataataatttatgataattcctatttttacttaattacatctaaattattaccgcgaactgatctcctattgatattactaaaaataatctataacaatctataaagattcatctaattgtttaattcgtaaataattaattctataatcaaatcctagcactttaggtatttaaatagtaggagttcatccaatgatattctcattaatcctataatcaaattctaatattttttttaaatattctaaatctcttaaatttttcctttttctcttttctttctccctctcttttcctttccttttcttttctctctccctttctcctctctttcttcttttttttttcctctcttctctccctcccggctcctttctccctctctctctcggcttcttgctctcccgggcggcgacgacgatgggcgcgagggggggtgggcggcggcttaccgacggcggcgtcggcaacggcggcgacagcgacggtggcggtgttggcgcaaggcgcggtgcggcggcttctaacgac

SEQ ID NO: 11253 - DNA, 5829 bp, Oryza sativa
ggcacggggctcggggcgggacgcgacgggcgccggcgtgcggcgcgcggacgagcgacgacggcgacggacgagcgacgcgacggcgacggacgagcggcgacgggacgggcgacgcgatggattttagtttatatttcctatatgaatttgattttataatttctaaatcttgcataaatgaagtttactcaatatgtgtattatctcaactaatgaattcaccctagattaatattactcttattttatttttatgtaatttatttgagttttatttagggttaattcttattccatcgtatttaaatttaattgatccaaatatggtcgcgataatattttatttatttctatcccacctaatctttattttaaattataatttatttatttctttaaccaaatctaattgcagggttaattcctaattatcttacaataggttagaaatttctatcgcgagctaaatatcggacgaaatcctagaattatcttacaatattatacgatttaatttagtctatgactaaatgattaaatataatacatggctaaaatccctagtaattaaatccgaatttctaccgtgaattgattacttacatagattacccaaaaataatctataataatctataagaattcatctaattgtttagttattaattacatctaaattactaccgcgaattgatttcctttagaaattaccaagaataatctataatttatattaaattttgcaattctacgactataattaatctataattaaattctaattattttaaattttataaactattaacctccctattctatttccctttttctcttttcttttctttctttttttctcttttcttttctttgtttttctcttttcttttctttccttttctcttttctctcccacgttttcttttctctttctctcctccctttcttttctttttctctccctcccggcttcttctccctcctctctctctcggctctctggcgacggcgaccgagcaaggggaagaggcggtggcttaccgacgacggcggcagcgacggcggcacgacgacggcgcacggcgtggcggcacgaaggcggcggtgcggcggcgcgagggcggtgcgacgacggcgcacggcgcggcggtacgaaggcggcggcgcagcgcggtggaggggaagggggaaaaaggaggggaaggaggggggtggtgtgggatggaagggcgaccggggagggggggtttatagggcgcgggggaggggcggacggcgcgcggcgcgtggggcgcgagacgatgggacgtcgacggcgatggatggcgacagcggtggcgcgcggctcggggcgggacgcgacgggcggcgcggcggcacgggatgggcgcgtggcgcggggcggggctcaaggcgtcggcggcatgcgcggcgcggcagtgggacgggcgacggcgacggcgtagtagcggcgatgggacggcgacgcggcgacgggacagcgcggggcttggcgcgcggcgatgggacgggtgcgcagcggggcaggggcgcggggcgcggcagcggtgatggtgacggcgcgcggcggcaggcggcgatggcgacggcgacggcgtcggacggcgacggcgtcggacggcgacgcgacgggcggcggtggcgcggggcgcaaggccggctagggcgccgtggtgagagaggacggggaagggctaggagaccacatcgaacacctatgccgtaatgaacagtgacttttcctatttatcccgattttagcccattttctatttaaatatagccctataaattctaatttttgcataaatgaagtttactcaatatgtgtattatcccaaccaatggatccactctagattaattgtacccatattttatttttatataatttacttgattttaattagagttaattctcattccgtcgtatttagatttacttgatacaaatatgatcgcgataatattttattcatttctatcctcacctcaacctttattttaaattgtattccaattatttatttagcccaattaatttttttagggtttattcctaattagttattctttattcacgattaatgaacttcaaaatcaaatccaaataaaatagacgaataagatcagcatgatgcaattaatttaaaagttttcgaaggcccgtatttttagagttttgtttttattggtcaaattttcagggtgttacacgggctcaccattgcaggaggaatggtcggctggggatcattggaccgatgtgcggccatgcgttcatcaaccttccttgccacctcctcttgcatgctgagctcgtagctcgatactctaaactcaaaatctgcaatcttcgcctcggtatctctcttgctcctcatccgactcctgtacgtgtggatgtcctccttgaacccaatcttccaaggaatcacccctttccctcgtgttcgtcctggatgctctggagtctgcagggcgagcagctcgtccctctctctatccggtcggaacgtgccatgagaagaggcttccactgcgtctgttagtcgacgcgcagcctctcatatctgatcgccgaagaccagtgagccatcagctgggttgagcgttccaccgtgagcatagtaccagaacttcgatcgttccggccaattagcggtggccggttcgatacccctctcaagcaagctagcctccatctcctcccacttcggcatcgagacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttcttgtacaactctcccttgaagctctgaaactgttctaccattttcttcagagtccaccttttcactttgtcctctgtacccgcgggaagggtgaatgtctcgagcattgtggtccacagcatctctttctccgaatctgggacaaagctctcatgatctccgcgtgcccttgttcttcgccagtacaccgtactgacaggcaagttatcccgcacaacccaaccgctgtgacgtacatagttcttggcggcttctgccggggcactaggtcgtccatcttcttccacttccgttatgatgtgccgaccctcaagcttcttcgcggcacctcgttgcccgcgtgccctcttctgtccaacggagggttgacttccactagcctcctcctcctggttcccctccacatccctttccacgtgcccctcctggttcccctccgcatccctctccacgttcccttcctcgttcaaatactggtttggatcctcgttcccctcttcttcgttccagtactggctgcttccctccacgattgaatcgtacaatatctgttcctcatcgcgatcagccatctgttcatacaggaaacatctgctaagtcatgagacatttatgttttaacaatcttatattaaaactcaaataatcttatatgctaagactaaacgaacagtcatgtatgctaagtgtaactgtcgtatattagaaccctacacaatcttagaagctaagtctaattacaaatctaataatcttatactaaaactcaaatagtgatgatatatgctaagactaggtgacgtatattataggaccctagctagtcaataattatatactaagtctaattacaaatataataatcttatattaaaactcaaataatcttatatgctaagactaaaatagtcatgtatgctaagtgtaactgtcatatattagaaccctacacaatcttacatgctaagtctaattacaaatctaataatcttatactaaaactcaaatagtgatgatatatgctaagtctaggtgacgtatattataggaccctagctagtcaataattatatactaagtctaattacaaatataataatcttatattaaaactcaaataatcttatatgctaagacaaaaatagccatgtatgctaagtgtaactatcgtatattagaaccctacacaatcttacatgctaagtctaattacaaatctaataatcttatactaaaactcaaatagtgatatatatgctaagtctaggtgacgtatattataggaccctagctagtcaataattatatactaagtctaattacaaatataataatcttaattgcattacaaatataacaatcatatatatatatatatatatatatataggaaaatggttctatactcctagggagtacgtactccctctcccatccaccgttcatctgatcgatcagatatgtactccctccctcatcataacgggtttggctcggtggatccgattagtttttctaattaaaagaccggactgcttatcccgtaatttggggtttgctcccaacaggccaaacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttcgatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcatgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattataattgactagagaattttttaaagtttcaaatcatgcatgtggcatttacatatgttaattagagtttttcacaatttaatttactatcattcatatgctaattatatatgactattcgaatttttaaaatttttaaatcatgcatgtggcatttacatatgttaattagagtttttcacaatttaatttaatataattgctatgctaagtatatatgatgattacaatttttattaattttaaatcataccgtatgtatatacatatgttaattagagtttttaccaatttaataatatcattcatatgctaagtatatatgattattagaatttttaataattttaaatcatatatttgcttattacgttttatccacttaatttattacagacaacaataatttttcgaagtaattgtcattaatctttgtactttaaataattgtaatgcattatcttctattttagaaacacatatgtaatggataataatatttagtgcgcttatcagtagtctcggttcttaaccctaaccgggtttaaaaagaatttgaaaatagcgggaaaatatctttagtcccggttgatgacaacaaccgggactaaagatat

SEQ ID NO: 11254 - DNA, 3454 bp, Oryza sativa
cctcgtcacgacacgacgccgcgccacgacgacgccgcgccacgagacgccacgacgccgcacgccgccgccgcgccacgccgatgccgcgcgcggcgccacgccgccgccgccccgccccgccgccgctccgctgccgccacaccgagaacgtgaacgagcgaacgaacgtgaacgagaacaaggtgaatgaatgtgaacgagaacgagcgaatgaacgtgaacgagccaacgaacgtgaatgagaacgagcgaacgaacgtgaacgagaacaaggtgaatgaacgtgaacaagaacgagcgaacgaacgtgaacgagccaacgaacgtgaatgagaacgagagaacgaatgtgaacgagaacaaggtgaatgaacgtgaacgagaacgttgtcggacgaacatgaacgagccaacgaacgtgaacgtgaaatgcaattataggcaggttaatgaacgtgaacgaacaaacgtaggtgaatgaaacgtgaccttaacgagaacgcgaacgtgaacgatatcgtgaacgaaacatgaacgtcaaatgcaatatatgttacttcgcgtttatccttatacatctttttgtatcttgtagaaagacgttgtcggagtcgtccctcaagccggagtggtagagctagccctcgaaggaattcgcccaggcaagtgacataatatatatatatatatatatatatataggaaggctattatgtactcccgggagtacatactccctaccctcataccgttgattacctttgagatttgtacctgataacgggttagcagtgaaggggacgtgcggtatctacccattagtggatcgtggatggcattttgttttaaaaattgaattaattgactgctcgtgtataactaatccctgaagaatcggtctgtacgcaggtagtgggcggtgaggaatggtatttaaatcatcaaaccacatactgcttcatttgttcagggctgcaggaacttggtttggacctccgtagtccagctcgaggatacgccgccgcgcggcggtgctgatttaggatggataaacaagtgaagaaccacagaccttctgatggtacggatggatcaaggtatgttgttctgtttcagtgatttatttcagtatgtgccgctggttttttttctttgaatttcgccgtgtgaacttgagcgattctaaatcatcaattcagggaaattcttatggacgagcgcaaccctaccatggacatagtagatggtattagtcaatctgtccatgattcacaaccggatggtggtcagtcaaggttggatcgtagcttccgtgaatttaaaactctgtaaatggtagccagatactgacacatcttgattgtgttatgaagccgtgtagcaatggaggaggacgtgccgtcgcgggttggctcacatgattcagggcatggaattccagagacaaggtatgtgcatggctaggtgtcagctgagcattcactttaaagcagtatatactacatagaaatgttcagtatgtgtcacatgagaaagttcagtatatgctatcttctaggaaagttcagtatgtatcacatagaaaagttcagtatgtgctatattgcataggagttcagtatgttgcacagaaaattcagaacatactatatgctgtcgtataacaaagttcagtacatagcctcccatagaaaaatttagtatatatgtgaaaaattcagtaaatactggtgcgtatcaaagttcatactacgaatcactatggaaagatttagtatacatgtggaaaatgcagtatatgctatcgtctagagaaattcagtacgtaacccatagaaaaattcagtacatactatcattcaacataaatcagaaagaacccctccattttaaaaaatgagtatatacaatcatctaacaaagttcagaacaaagctccccatatttttttgttagtagtacaacatatattttttttaaatttgcagtaagtactgattataaattaggttgttttttgtaaactacattttcagttagtagtagtatatgctatttttaaatatagtgtctccaatacagaaatttggtcccttcactggattggacagaaggaaacccatatgaaaaagaaggagctgggataccgatggaaaggtttgtatcagcatgttacggatttttacgattttttttgagccaggatattggtggtattttatgaaaactgattgtacattttcttttcagaatggtggtagataatgttgatagcagtgctgtcatacctcctgagtatgctgatcctcaaattcttactccgatgctgggacaaagatttaagactgagagggatgcctataatttttataatgtttatgctgttagtaaaggatttgggatacgactggacaaagatcgcaagaatactaaaaatcagagaacaatgcggcaaatatgttgttctcaccaggtacatacattatgtaacaatatcttagtagcagaaatttacctaaataaagacttgacgtactatgtgttaatttcaaaatcttttatgcaggggaggaacccaaaaaccaagaagccttccgttcgaattgggtgcccagcaatgatgaagataaataggtctagagctggtagtggctggtcagtaacaaaggttgtttctgcgcacaaccatcctatgaaaaaaagtgtaggagttattaagaattatcagtcgcacaatcaaatagatgaggggactcgtggtattattgaagagatggtagacagtagtatgagtcttacaaatatgtatggtatgttgtctgggatgcatggcggaccttccatggttccattcacgagaaaagctatggataggctagcttatgcaattaggcgggatgagagcagcgatgacatgcaaaaaacacttgatgtcttgaaggatttgcaaaaaaggagcaagaatttcttttatagtatacaagttgacgaggcttgccgtgtgaagaacatattttggtctcatgctgtgtccagattgaactttgagcattttggtgatgtcatcacatttgatactacctacaaaacaaacaagtataatatgccctttgcaccatttgttggtgtaaacaatcactttcagagcaccttctttggttgtgccctgcttagagaagagactgaagaatcatttacatggttattcaatacattcaaagagtgcatgaatgggaaggttcctattggaatattaacaggtatgtgagtatttggccgaatttataatttggaatgaattcgttatactttacttattttaagtatatgatgggttattcattggatgcttattattgtccttaattttgcagacaattgtccttccatggcagctgccattagaacagtatttcccaatacaatccatcgtgtgtgcaagtggcatgta

SEQ ID NO: 11255 - DNA, 3013 bp, Oryza sativa
tgtgaccggacagttccacgtacgtctaacgaagagaagtgtgattccaggaattttattaaatttttaccgccatcaatggctctagatgggatctttgaaccagagcataagtttaggggagatagctctggcacatgggggttgttttctattggttccttcatcaactgaacagcatgtatatcggaaattagctaaattttgcagccagaaataggcatattacagccagggtatagtacatacctggagtttcccataacgagggaaggggaatcctgggttatgtttactaactacatcttgttgaatcatcctagcaatttgatcatcctcaaactgagaaatgtgacatgttttaacacatgtgatcccaaccttccggaactggagatttctcaaatattttacctgcaaaaatgattcacaatgacaatatgtgtgttgattgtatgctgcattaacaagtcagttttaaatgctaaccattagaaagatgatacacccgttaatggatagttgagccttattcggaaagtaggtgggcattgattctgctgctttcttcacctcatctacaacgaattgggaccagttgtactgttttatattgtcaacatcagaaacaaccataatatacctaggagatatgaagtttgcgcaggattgcggtgccaaaagcttcgttgtgacataaagcacaaaagccgccatgaaaaccctcttttcatctattgtcatgggataaccatactgcttctttaggattctctctaagagtgatattttcatgtgtgaaaagtttggtatctcaaatatttcgcacaatatttgtttcttcccatccaattcatcttgagagcaagggataataggttgacctgagcatggcaagccaaaaactgcattcacatcattaggaccgaatggcaactcctggttgacatctttaacaatagcgcatgatttcggatcaactttgctcagtagccatgcaccaaactgcctgtttaccttagtaagcttgatatccaaaagtccatcaaacccaacttcaccaatcaactccttcttcctatcatcgaattctttaatgatattcactacgcatttgggctgacacctgcagttgataccaaaggtagtgttgtctttcttctgtctatttaaaactctgctttgccgatacctggataccacccgtgcagcagtcttatttaggctgccccttgtgccagaaaccttcaaagcctgcagataattagttttttcatttcataaatagacaatactacatggaccagtgtatttaaaaattcaacatatacttctgtttttaaaaaaaaacagcatacactcatatatgtatggaaagatgaagtacaaaatactgcgtagcaaattctacctatgtgtaccctcttaattaaaaaaaaatcatgtgcactgaaagaaaagtcagaatatgcaaagtttacagaatattactgtgtgtaaaaaatcagcatatacctctctatgtaaaagtgcaggatatacttcttcgtaacaagggtccagtatagtaaaccactatggaaaagcctctgttatatgtggaaaaatgcagtatatgctatcttctagaaaagttcagtatgtaccacatacaaaattcagtacatactatatgctgtcgtataacaaagctcagtacaaagcctcccatagaaaaattcagtatatctgtgaaaaattcagtaatactggtgcgtatcaaagttcagtctatgaatcactgtggaaagattcagtatagatgtggaaaatgcagtatatgctatcgtccaacaaagtagagaataaagctccccacataaaaattcagtatatactattgcctaacagagagttcagtaagaaccctgccacaccaaaaatcaatacttaataccgtctagcagattccaaaaagtttccctccaaagaaaaaatgagtatataccgttgaaaattcagtacgtactaccatctacatttttctttatgggggtgggggctaaaacaacattaacttcatccacccaaaaaaccatcatatgcactaaaaggggaaaaattagcatctgaaactgagagagtacatgaaccgaactacacctaatccctctctacaggcatacatgtattcaatttcaggtggcataccttggactgtggtgacaaactaattttcctgtgaccctgcggcaaagaagaaaattttaggcaacgtgtcttgatcttgccgtacaaaaataaacgaatactaacctgctgctttggatgaaatccactgctgctttggatgaaatccactgctatggcccatcgattttgccattgttgccccgctcctgcattcagccgactctagatcgattacttctgcttcaggaacacatgctgttgagagaggatccatcgctggaggaaggggaggagtcatcactggaggaaggaacgaactgctatctctgtactgccgccagccacacagtcgccgctgaatcgctggtccgtcgccgcgccgccccccaaaaccccgaaagctgaatcgctggtccgtcgtcgcgcaggtccgtcgccgcgccgccccccaaaaccccaattttcgggataatctgtttggcctgttgggagcaaaccccaaattacgggataagcagtccggtcttttaattagaaaaactaatcggatccaccgagccaaacccgttatgatgagggagggagtacatatctgatcgatcagatgaacggtggatgggagagggagtacgtactccctaggagtatagaaccattttcatatatatatatatatatatatatatatatatatatatatatatattaaatttgtttggtgctccatggtgcccgggcaccattgttgaaattgagtatatacccaattcaaatgagtatgaaacttttttaattactttggtattaatattaactactttactaactagttcaaagcaac

SEQ ID NO: 11256 - DNA, 2128 bp, Oryza sativa
catccatgatcctcaccctcgccaagttatgggctatcaaaccggaaaaaaacgaaattaataagaaaacatcacattaattacagcgataagaatgttgaagatctctcccaatttttgcgcgtttgatcgagtcttatacggcactatactatacggtgcatgatttctttgatagttgctctcacacgcggcagaacgcgcattattaagagatgctccgcacgcaatcctagtttcatttgtggagacttttattagcttgatttcgacgaaacaattttgcacaataaggcataaataatttttaaaaaatatcttttgaagacagcaactctatgacaatgtccatgtgcattatcttttcccgtcgtccaataaaacgtgtccaaattgcgtgatagtaaatgacgtagcattatattaagtatatagttgtgttaactcctcctagaaaaaaacaccaaacaattttgctatacgtttatcgatatttttttaaaatataaaaaaataattataatgtaattacattgtaaacttacatgtaactaaaatataaatataatttgtacataattaacgttcatgtaattttggatagctagatttactccacatgaaaaaaaatacacggtgcacatggatgagggcattcgatccaacgacctcttgagaaacgtttttgaaattaatttatagataagttatattgtagaaacatgcaaactacaatataattatactcaattatactatattatttacatttgataaattttcgagaggaaactacttgtcaatagatatataggtagtcccataaccctgtatacatatgtgcacacataatatgactatatatcacgtgccttcagaaatatgacttatttaaaaccttatttagaattatgtaaaattgttgaaaaaaatttcttgattagtggatttaaaatttataatgattaaatatcaattcaagtttggattgctatttttgtagtttaataataacaaaaataaaactatgaaaattgtcttaataatatgggatattagtacttccttggttcatatccttagtgaaaaattggtaagacaaaacatggggaattgacattttttttaattcaaagcatttaatttgtttttttctcaatgtcaagtcacaatgttgatatggttgctcgggctttgtgtttgattttgggccaactagagcaacaaacacaattgattgcaaaaaattggcatcttagtgcatggattgggcaaagtcaatactttaacaaaccaaatgaagccaaattgcactactaaaaaaaaaattctaggcggacattcactctatctgtacttcaaggcctgcgaaaatacgtccattttcacaggtggccttcagttcgcctacaaaaatcattttcacaggcgtcctctccatcttcgcaggtgctagatccactcgccgccacccccccttgggccagatttagggttaggtttttgggagggagagggagagggagaggtaggggagtcgcaccgtgccgtcccatccggccacgccgccgccgtcgccactcccctcaccagatctaggagggagagggaggggagccgcactgccactgtcgcccctccccttggccggatttgggagggagagggagtgggagagggaggggagtagaggggagccacaccgccaccgccctctctggctgtgccacggccgctgaccctcccctccgcctgatctgggagggagagggaggggagccgcaccaccaccaccgccctccccccttcggccacgccatcgccgccgcccctcccctccgccggatctgagagggaaggaaggagaggggaggggccgtccgcgccgcctcctccgccgctagcaccggctgtggctagccctccgccgttgtctggtagagggagagggagagaggagggagaggaaaaagtgagggagagggagagaagtgaaggagaagagtggagcgagggtgaggcacgactgtggaacttaatacaatttaatagtgttatcatatcttgcaggcggaccacttaaggtctcgtatgcaaaaatcatattattttttcatgcgaaaaataa

SEQ ID NO: 11257 - DNA, 5163 bp, Oryza sativa
aaatataagaccaacattggtaaaaatcatttttatagttgtgttctattgttagtaccaaaatttttgtaaggttttttcgactaccaatatgtaaacatgcttgattttttcaatctgcataattataaatggatcccaccaatatgggtttttccatatggaaacactgtttttttaattgatgcagaagtttctacattgattttcttttaatttgaacaattatagtttggtcccctaaatgcatgactatattcattgactgttcgtaattatttttaacaattttcttccacatatattactcccccgtcgctaaatataaggaaattgagtattcaaaatttatccccaaatatatgtaacgtattgggaagtactacttatcctatcaatgatcacacccatttaattttcttttcatcttatctcagaccaccccctccttacattcattaggcatacggttttttttcctttatccttattttctaaaaactacttaaaatccctaaaatttagggacggagggagcaataaataaataagttaaaatttacatacctccaatccaataatgatgtaattaaccatcattcttgtgttaaactgaagggaacacatggaataatttatttgatttgtcatctgcaacgtaactggcattcaaaagagaactaggtactaactgacaaacatgtgcaagaagagatccccacctactgttctttggggcccaccacacatgcactgatcagattgacaagtacacacagtggctggataatgcagctagtggcacgtaatagaaagtcatagcgtaaattcaaaggtgtttttgattattattctgtgatgaataattggcattggagattattggttttgatatttggaatttattcaagaagtggttttggagatgattggatttcacaggtgaatctacaggtactgctgttatttcatgtgaccggtcagaccggcggtacgtgcgtggtcagaccggctagcccacggtctgaccggccgactctgtgtcggtttcggtttcgggttgtttgttcggatatacgtgattgtttcattgttacgacttctagatggatactatacgtatgtaatactgttgtttgctactaatgagtcaagttagagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatatttatgctagagttgatgcacgtggttggtgaagattccatatggcatacgatataggtattgtgtgcgtatgggatgcggagtcgaatttggaaggagtccaaatttggtatgattggttatgtaaagtttgtttcttgtactataaggtttcctaaggtgtttagaatttctagtatgagtttggttcgtgactttaggctgcctacctcgggtataaatagagggggatcgtgaggcttcccggtatcgcttttgagagcaattgagttgagtttagagttagggtttcgagtttagtcgaaattttagtaaggagtgctgttggtgcactctgtaaacacagagagaatcaataaagtcgtcatccactttaagagttcttcgatttgtgtttcaccgggtttcggcggtctaaccggtgatataccaacggtcagaccggcggcaagcggcggtcagaccggcgtcggcgacaggaggcagcgacaaggttcggcggttagaccggtagatcaacaccggctagaccggcggctacgcttcggtcagactaatctactccggtcagaccgatctccatcgatttcgagggtaacttttatttccgctaaaagttttcggtttttgcgtaccaaccattcatcctccctctggttggcttagttattttgattcgttcttacaagtggtatcagagccttattttcttctttggatttttatcgatctagaatttttgccatggctgcttctgttaggttttcaactaagcctcttgtttttgatggaacagatttttctcattggtgtagtaggatgcaatcttacattatggctgaagattatgatatttagagaaaagtttctcatccttatgtgattcctgaagtaattaatactattgctgcaaaaactgagtttgaacaaaattgcaaagctcgcaacattcttttgagtgggatttcttattatgatcgtgttgctcatcttcaaactgcccatgagatttgtaattctttgagtaattttcatcaaggaacaaataacactaaagaacttcatcgagatcttttcaaaaaggaatacattaaatttgagatgaaacctggagaagctttggatgactatctttctaggtttaacaaaattttgagtaatcttagatctgttgattcttcttatgatgctaattatccacaatctgagatttctcgccactttttgaatggtcttgacatgtctatttgggagatgaaagttacatctattcatgagtcagttaacatgtctactttgactttggattcgctttacacaaaattgaaaacacatgagatgaacgttctttctcgtaaagttgatactaagtcgagtgctttggtttcttcttcttcttcttctttggatgttgatgcttcttcatctaagtcttcttttcttgctatttttaatgccacatccgatgatcaactcgaacagatcgaggaggaggatttggctttggttgctaacagaattgctcgagctatgaacaatgccaggtccaggaaaagaggtggtccaaatcgttgctttgaatgtggttcaattgatcatcttcgttcgcattgtcctaagcttgggagaggcaaaagagaagacaaagatggtgagaagaccaacgacaacaagtcgaagggtacatccaaagggaggaagatcaaggagaatctcaagaaggcttttgatcaagtctacgccgtgtttgagccactaagcgatgtggatggtgatagtggagatgaagctaagggaaagaacatctccggtgtttgcttcatagcgcgtggtgactaggattcagagtgtgagaacaatgaggtaagtgcttttgaggaagctattaatattttgagtgcaaaaaataagaagtgtgagaagatgtatagaaaataggaatttatcattgaatctctttattctgaaattgctagattaaaatctcttattcctaatgatgatgattgcaaaagttgtgaggttttaatgaatgagatttcaaaaatcttctcttggatttaataaatcttctcttgcttgtagttttgctttgcacacacgtacgcagggtgagttgtttttaactaaaaagttgttgcaaaaatatcaaattgcttttcatgctagtttgatgtttaacatgatttgtgctaaaaagttaaaacaatctcatgatgttttggattgctcaacatgtcatttgaataagatgaaattgaaagatgctttaggtcgtgttgagtacatggaagacgttgtgaaaaacaatgaagtactttcttgccccaaatgtcgtaaaagtaaaggtgtcttggtagattgtgaaaattgtgctaatttggaaaaagaggtttcttatttgaaaaattctttgctaagattttctgatggtaaacagaacctcaacatgattttagatcaatctaaggttagcacaaataatcgtggtttaggtattatgctcataattctagacatcctcctgttgtgttaggtgttggtgctagaagtggtgagattttggttaaacctgatactaacaaaactgtgtttaaatctgctggtatcatgtctactttgagtgcatcttcttcaaaatccaatgttgtgcatgcaaaacctcctgttgttgcttgtgttgctaagtcttctaattctaccaatgtgtctaatcatcgtgaaaaatatacttattctttttgtggcaaagatggacatattgttggtttttgtttcagattagctcataaacagaaaaaggagagagagattacttttgcaaaatcgaagtggtaaaaatctggttttccctcaaggaaaccagacagaccgcagtaggtcccgcggtcagaccggcgaccggtcagaccggctactgtgcctcggtcagaccggtggtgaagcggcggtcagaccggctgcacaccctcggtcagaccagcctcggagaaatttttctgaaaattctcaaactgtttttgcacgtggatatatgcctattggatctactggttgtgtgtctcagtactagataatttttattaacttctaaccccagtactgaggcttcgacttctgcttgtgtgtaggctttggtggcaaggaaggaaaacgtgtggatcgtggattccggttgttcgcgacacatgactggtgataaaaaatggttcacctctctcaaaaaggcatcaaagactgaatcgattatctttggtgatgcttctactagtgccgttctcgctataggtttggttaaggtaaatgaaaaatttgaattgaagaatgtagctttggttgaggacttaaagtacaatttgctttcggtttcacaaattgttgataaagattttgaggttcactttaagaaaactggaagtaaagtttttgattcttgtggtgattctgtgttgaatatttctcgctatggaagagtgtttaaagctgattttgacaatcctatttcacctgtgataacatgtttggttgctaaatttgattaagatgtgatgttttggcatcgtagacttggacatgttggttttgatcatctcactaggttaagtggtttggatcttgttcgtggtttgcctaaacttaagaaagatcttgatttggtttgtacaccgtgtcgtcatgctaagatggttgcttcttcacatgctcctattgtttctgtgatgacggatgccccgggtcagctattacatatggacactgttggtccaattatagtgcaatccgttggaggaaagtggtatgtgttggtgattgctgactatttttctcgatattcttgggttttctttatggcaactaag

SEQ ID NO: 11258 - DNA, 708 bp, Oryza sativa
atgataagctgtgctaaatgcgagataacttcctagggcttcatggactttctcccagaaatggtaggtaaattgtgtgccccgatcagatataattttctttggtacacaatgaagacatactatcctggtcatgtataactcggctagcttagcactgctataatttgtcttaacgggaatgaatctcgccgtcttggtgagtcaatccacgctcacccaaatggaatcatgtcctgttgcggttttgggcaatccaacaataaaatccatacctatctcatcccatttccattcgggaatcctgagaggttgcaacaaacctgccggcctctggtgttcagccttcaccttctggcatacgtcgcagagtgctacgtattcggccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgttggttgaaaattcctttgcacgtcctgcagctaagcgttccttcacctctcggacttcctcgttgtccttctgggcttcttctatttgggttctcaaaagaggttgaatgtccagggtgtttatctatccacggggtactatatg

SEQ ID NO: 11259 - DNA, 1250 bp, Oryza sativa
tgatgggcgtctaggactccaccaccgggcctgcctccatcgccgccgattggtgtttccgcttgcacgttggcctattatgccaccgttgatgggcgtctacgtcttcaccgaccggcttgccttcgccgccgccgactggtgtcttcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcttcgcctgcacggctggcctattatgccgacgttgttgggcgcctacgtcttcaccgaccggctcgccttcgccgccgccgactggtgccctcgcctgcacggctggcctattatgcccgcgttgttgggcgcctacgtcttaccgaccggcctgccttatttgacagcgactggggcctccgcctacacagttggcctatgatgccaacgatgttgggcgtccacgacattaccgccgggccgcgtccgtcgccctcgactggagtcctagcctatacgggcggttggtcacaccatagttgatgggcatagtcatatacaccgccggactgcctccggcgcacgagactagtgtcatcgtctatacggctggtcgggcaaaccactgaccatgggcgtgcatgtattaaccgaccggatggacattttgccgcctccgactggtgcttccggctgcacggctggactattatgactgccgtgttgggcgtctacttcttgaccgaccggtttgcctacgccaacggcgactggtgtatccgcctgcacggttggcctttatg

SEQ ID NO: 11260 - DNA, 9747 bp, Oryza sativa
  unsure (1)..(9747): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggtgatcggctctgagggaggtagctgcttgcggttgtcgacggccttgaggcgacccgtcacctcttcgatcgtgagctcggtgaagtccagcagcgtctcgatcgacagagccagctgcgtgtacttctcggggacgacgcgaaggagcttctccacggctctctccttgtcgatggtggtgtcgacgagctgcgccaaccgctgctgcaaggagttgaagcggagaacgaagtcgtcgatgtcctcacccggcttgaaggccaggttctcccaatcctgacgcagcttctgaagcgtggacctgcgggcgcggtcgctgccgatgcgtgccgaagcgatggcatcccaggcgtccttggcgatccgcttgttcacaatggaggactgcatctccgtcggaacagccgcaaggagcgcctccagcgcccgccaatcttccccgtagtcgacgtcgccgtaccagaccgcgtcccacatgtggcgcgcctgcaatttcaccttcatcaccatcgcccactcgacgtagttagtcttggtgagcatgggccatgcgccgccaacatccttgacgacggtctgcacaacgggaggagagccggagggtccacggcgaccacggcgcctgtccggggaaggggaggcgcgctgcctgcgagggctccgtgcgccaacgtcccgtccaccctgctcccggtcgaagtccagttgtgcctcaatcgccgctgcctgctcccggagtcgctgggcctccagggcgcggtctatccgaggatcgcgccatggatcgcgccgctcctcctcaccgcggtggagatctgctcctccgcgatgggggctgaagtcgcggtcgcgtcgacctgcgtgtcgatcccggtccgcgtcgcgtcgcacgcgggccgcgtctgcccgctccaggtcacgccactcctcctcctcctcagctcgcaaaacagcagcagcagctgcagcctgcctggctgcctccgcggtgcgcgctgcttcagcttctgccgccgcgagacgcgccgcccttgtggctgcctgcagccgcgcctccgcttcctcacacgccgcgcgtgcttcccgcgcagccgcttgcgcctcctgcgcgacccgcgcagcagcagtcgcatcgccgtcgccctcagcgtcagccgccgaccgcctgctgcctcgtccactggaagtgcttgaggcatgggacgagagagagggggaacgaatggagtggagagacattttggatggggaatcgatggaactcagataaaccttgctctgataccaattgttagcaaaaggaatacaggttttgggactagtttaatttctattctccactcaatcaactatggctggttggatacatatatataggctagtggcttacaccataaggtataggctagtggcttacatcctaagaaactaggagtggcttacattctaagaaaaactaggagtggcatacatcctaaggaaaactactagtggcttatatcctaaggcagccaactgttattccaaaaatagatgttaaaagcatatagtaaaaacaagaattaatctgtcaagtagtacctcagttaatatactaggctgagtctaaggtgcattggaccggcaactttcttgttctacgtgagcacatttcccgaactgcttaatgatattctttttttcaaaaaaaggtatataaaaaagtatcttttaaaaaataaataaatccaatttttaagtttgtaataattaatattcggttgatcatttgcggcttgtcttgcttctcgtgccgctgaaaatcccaatccaaatgctagaacaaacgcagccttacgataaaatttcaaatcaacctgatttgtttgaattaatacagaagagtaatttacttgaacttcttccatttgcttattatttttctttattgtcttccaagaatttctcatttcatattctttaaaagtaattgaaattgtgttctttaggcttagtaatgcttcatgttgcacctaaaagctgatgcccagaatttttcgtatggttgcacctaaatgctgatttgacttaattttgtttgtttttgaaaaaacttaattttgtttgttatactgtagggatgtgactgcttgggtcttataaaatattttgatgcacattttacaaattttactggtggtgtggagaccattgagaatgttgtttgcttccatgaagaagaccatgggatcctctggaaacatcaagattggagaacaggattagctgaagttagacggtcaaggaggcttactgtgtcatttgtatgcactattgctaattatgaatacgggttctattggcatttttatcaggtgagtagttcaccttttcagtggaatgtctacagacacaattatactttcgaaaggaactctagttcctgatatgtttttttgttggttgcaggatggcaagatagaagcagaagtaaagcttactggaattcttagcctaggagctctcatgcccggggagcaaaggaaatatggtactactattgcccctagtttgtatgcaccagttcaccaacatttttttgttgcccgtatggacatggcggttgactgcaaaccaaatgaggcctacaatcaggtaggctgcttatcaaccatgttgtgtgggcttctattttactgtaattttgacttcaaaatattgccgacttacttgtccacctgcactggctgcttctagtacgatattgttccatgcctttgtactttgtttattttcgtcttactattacccgtctatattatgtataaacagctaagcttcctttacttttctgagaagtatgttagtttattctagtccacgatttcatgaagtcctccatttctttgcattattatatagtaagatgtgatactgctgcctccttttccattccaggtggtagaggtaaacgtcaaagttgaaagtgcaggcccaaataatgtgcataataatgcattttacgctgaagaaaaaaaatttgaaatctgaactacaggcaatgcgtgactgtgacccttcatctgcacgccattggattgtaaggatttgtgtgagaaacattgtatcgtcgtgcaaactcaaactttctgtgtgactgacactgctggacgcatgtttgttcaggttaggaacacaaggactgtaaatcgtactggacaaccaacagggtacaagctcgtacctggttcaagctgtcttccactggccctgcctgaggcgaaattcctgagaagagctggatttttaaagcataacctttgggttacatcgttcaaaaacgatgagatgttccctggaggagaatttcctaatcagaacccacggattaacgaaggtttagcaacatgggtaaaaaaggataggtccctagaggagaccaacttagttctctggtaagttgtcaccttctaacaattgctgtcgatcttccatgttcatctgattttctagcttaattatggcatatctgaaataaaaacatgtcatatgcaactacaggtacgttttcgggattacccatatccctaggctggaagactggcctgtcatgccagtggaacgcatcagcttcatgctaatggtatcactttggccttcgtttctttctccattgttctttatattacttagatggttttttgctgcgaaaagatagtattcttgtcctaattgcttcagataacattacgactttacaactcatctgaaaatggaagctatatatattggtttggttgtccagcctgatggactcttcaactgctcgcctgccatcgatgtgcctcctgggcctgatgtttagtcgcagaaggatattcaggctgagctgatttcaaagctgtgatgtgctgcagcttcctactgtggtgtggtgttttagcaagcgaacttgtggtgttacgatttctttgctgtggctctcgtgctgtgcgaatgtatgattgctttgctggtatatatagctcaatatttctgctggtcagttataagtttgtaaaaagtatttttggtagacgagcgccctgtcgtcctcgcgcgggcaaccggggcgaaccctagcccccggccgccgtcacacttcactccccttccccaccttgccgccaccgaagcgtgttgccggaaaccgcgcggcctgccgggatggcggcggcgaggctcctatccccggcggcacggctgtctctacgcgaaggggcggcgcggaccgtcgggaaggctgcgcagcggcgagacgttgtggcggcggatccggcgccgccaccgatggatctggcactcccgcggctggatccggcgtcgccaccgccggatcagggccatggccacacgggcgcggcgttggtgcgatgccgacgccggcgaaggtggcgaggcgcggcgtcggcagcaaaggcgcgggcgacggtgatagtggtggaggcgcggtaggcgcgacggcggcggaggagcgggcggccgtggtagccgcggaggcgcgggcgacctcagtaggcgcggaggcacgacggttgtgactgtggcgtgcggctgtgcctggccggcaattggccggcaggcgcggtggctgtggctagctggcggccaggcggcgtaagacatcggcgtggagcttgtggcgactgttgcgacagcggctggatggcggcgaggtggctggccgtgactgcggtcagcagcggctgcggtgatggtgaccgtgattgtgattggaggaggcatggcggtctcagacggctagccgagggcgtggcagacggccgcacctggctgcacggcagcgattggaggggtcggaggccggcttggcgcagagaggcacagccgatggcagtagtggccggcaaggcgcgagaggcgtggtcagtggcgaggaggccggcttggcgcgagaggcgcaaccgatggagggaggccggactggcgcgagaggcgcgtccggtggtggaggaggccggcgtggcgtgatgaggcgcggccgacggtaaaggtggcgaccacggtgcgaggaggagctgccagtgggtgtggcgcggtcttcggcacacgaaggctggctggcagggggtgtcggtgcagtggtcccacatgtcggcagaggttgagcgatggtggagcatcgatgtgtcagccgtggactcgcaagtgatgagcagccggtgaaaacccagcccggctttggccggaccgacaacgatggttcattccccctcccgagggcgttgtcgtgccatctcatccctcaagggtggttgcctggtgaaagtccagtcttggcacttttgagcccctgacggacggcggcagcagttttccgctacttctctccttggagacgtcgttcaggcatccccttaccgaaaccactcgaacgattagggcaatcacgctctagatagagttgggctttgtgttggttgtaagggcgtttttttgggcgttcccgtttgtgttccgttgttcgtctagcggcggtcggtccggtattagccttctcgcgattatgtgtgttggcgctgtcggtgtgtgggtggtataatttttttttcctttatcttggttacgacctctcagggttgtaatcttataattttttttctgctctatcaatagaacttcgcactgtctcgtgcgagtcgttaaaaaaaagtttgtaatgaagataagctggttcagattttgtgtaagatcatggtaatgaaccagtatatgttttttttccctgtctgaatcttagcaaaatgttcagtccattttcttgccagtgggtcggcaacttgactgggcatttcccccagctgcccagtcgacaaaccatctggctacatgtccccgaatatgtaattcttaaaaaataagagctagcttctcaagaaaataagtagataaaaaaaatcgtatgttgcttaagatgcttattgcgattgtttatccagttattaatataaacaaaattgctcaagatgattgagcacttatgcgtcttcatttttgctcgaatcaagtgcaatcacccaaatacaacttttacagtggtatttatcctctgtttttggttctttaaatttttatatgtatgcagtaaacagaactacttaagcacaaatttgctctgctttagaaagtagttcctggtggtggctaatcatggccgagttgctagaagattgcaactttgcaaggcttttagcataaagaaggatagaaagttgtatcggccatgaaacgatggctgggaaagcctgggattgcctattggatgaagcattgcaattggggaaagcagcaatgggatattaattaaccatctactctctcgtcctatattaagtgtagtaataggttccatatcgtctgaccgtccattttatttgattttttataattaatatttttttattgttattagataataaaatatgaatagtactaattattttttttaatttttttaaataagatgaacggttaaacgttgaacacagaaatctataaatgcattttaaatggaacggagggagtacttagaaatatccttaagtggcaatccatcaccgttagtggtgtactgtttattggtatttaggtgcatatcatccagatatggaccttttaaatggcattggcttgttcaccttaggctagttatggtttgtggtcactagatgaatgctatcatcatcatcatgctcaatgaagaacgtatttactctcattcagtcgccttctcactgattgtgttgggttttctctggcttacctttttttttcaggtataatatatctgatgttgattatatttattttcttttgctttatcccttctgtgtgctgtattcctccacaggggcagacggctaccattactttattccaattggggtaggccaggtagtcaggtacgtggtgtgtgctttgcatcaaggtagcgctgcatcatatccgatttgtgccgcactatacctagcaagcataaacttacctttgcatccttttcgtgttaccatcattttatatctgcaaatgtttttgaccaactaccaagccagcccaaaattaattgttaccacttcataggatgaagacactttgaagccactactctcttcacagtacatgctatttttaatgggacctataaatattatatatttccgtcccttacatttttatatcaacccttgtttcattttaatttacatatgcacgatagagggtgatgtggagccgcggagccgcctcactgatgcggcaagctagagccagttaccatagcggtatattgttcatgcacctacatctcttttttttttttggtaaaaatggtcgctaacaacacgagccaggccgtcccatactaacaaccaaataacccttatgtgccatttagactccgtaaccctcctcctagttctgtcaccgagttcgaacactctatggacttggaggaatcactctagctaaggctatgttctttttagcctattcactaaattattagattattgaagcagattatttactctacctttcgagaaatacatttccttaagaaactttattttactgtattgcttagaccgtttgttttaaaatatttgctaagtttatttcaagatttttagtttagactacctccgtccttttgactacgtatctaaatttgttggcagtgccagtatatatataatcgactagatgatctgtggtaaaatttcactcaatcatatagatcaaacagaacgttacgaggccaacagatcgcctaaacaggctaccaaaaggaaggacagaaagagaagcacagcacaaaggtgagcaccactttgtgatgtgatgcccttgttcagttctttgtggcgtagtgctgcagctggtgcgaagcaacctgccaaataaaagcacgcaaattggctccagccgcagacccaggattttcctttgaacttgttctcgtgggatcatgctcctctaccttcaaaggtaggtgtctttatcactgacacgtgcacctaataaaccatggacccacttatcagtgataaaagtacggtgtctttgaaagcagaggatcccaatccgttctcgtgatgactgttcgtctggttttttattgaggatactcgtttggtttaagtccgtaatatcgtgttgtgtaagtatatttagttggatggtttttagtgtaattaagattttgtgcgaggaactaattcacatgttgatgttaatactgttaaaagaattttttttcatcaaagaaatatttacatcgaagtagaagaaaatgttctcctaaaaatgctctacaatacaagagatatataacattttagagtttatttgaggctctgtttaaaggaactagatattctaagaagtaactaatgaataactagtttgtgataagagatcttttaaggtgcttgggcggtactcagcgtacctttcaaactatcgaatatcaaccgttgattgctaaatgtgaatttagaaatagaaaaaacacgacgatgggtaatttagtaattttttctagtcctaacaacttctaacttcttcctgattgtttgccgctagcccctactctattgactgttgctcttgtattacttttgctcactaattctcatctctcgctgttgttgcttacattattactttttttttgcagggacattataatagttacttattaggagataggaatattacataaatctatggtcattcacagtatcacatctgctagtcttttgaaggcatttttcttctctatctttcggacgacctgagcatgccggtgtcgaccacgtcttaattaatccatgaatgagctaccaaaacttcaaataatatgacattccccgttctgtgtagatcaattttcataacaaaataaatccgtaattgttcacaatttcatgtaatccatattagaaacttcgtaatgaaacaaattcgagaagaatcgaagaacttatatatgttatagtcatttccttttcatatctgttagattgatataataccaagggacaaaattacctatataccctcccacttaatctctatttttgtacctggcccaccttttttaagtacctttctatgggcaccttgtatcgtaaaccattggattgtacctaatcaacggttaacgtgattttcaagtaccggaaaaagtctcttgtgataatatggaaaagctaagtttcacaactttcagctcctagttcatttaatctaaagttgtaggtggcggaacctcggctaaacagggccttgagtaaaagttacttggtactagtgtcaatccatgattgcactgtcagtactcttgacgacgatgtgttgaaaaagatgatacatacatgtagggtacatcaccgacctat

SEQ ID NO: 11261 - DNA, 18914 bp, Oryza sativa
attgaaaaatcggatacatttttactggaatttttttcattgagcggtaaaacatatataatatttttgtacattggatgaaacgccatccgataatttacaaatcatcgtgtgtccccgtagctatgtccgaatatcaaaggatataattaattgaacgacaaattattatagaatcatgacacagcgcaaacataattcagtggaccctagtctaatagcccccaatcagaggaactagttgttactttcatcaaagtaggcaagtattagccatattaatgctacagtgacacatcaccctataattttgtcacgtaatgactcctattcttggtcgtgtctaatcgataagaggtagtgtttgtctcccataagcgaagaatagttgataagaagtgtcaagtgaataggtggcacacagctggataacatagtacatcacttctaccttgtagaagcaaaggaaaaaaaacaagtagttacatgggggaagatttcctggtccatgaaaactaatatctccttctgaatggagaagttttagagaaatttcatatgaacggaactaatttttatagaaataatataaaatatatttgtcccagagggtgtaaacttgtatcccttattaagaaaaactaattaaggttacgctcacaagtgctggttgtggctgccaggtgttacaggaagcaagccacattttttctaaccagctagttgggctgagctttttagggggatgcgaaacgaggcaagcctttaatgcatgattaatcagtttaaattattataaattcaaaaaataaatttattttaataaatttttgtgtccaaaaattttgtatgaaacatatcgtttagcggttcgaaaaatacgtttacgaagaataagaaaagtagctaatctcaaaatcattttagaacacactctaagacctcaggtagcctaataaactctccaccaagcataagactagtgtgacattatgcttccaaacaaaaccctgaaacttgtagctagagctgctagtttcatggcacgagaagtatagatgcaacctgatctcctctaccttgcaacaagctagtgccagccagccaagttgccaacacagcccagatcagctgaagccaacagaaagcagcagccactgccagtgccaaagcagcggccaaagccaatgggctgaggaggcatgggtgacaacgccacgtaggacaaagtgcacaaacaaacggcgccatgagagcaaggctaaaaatatagccgagccgttggctataaagttttttgtagcctttttttagcttatccatagaatagttagctcatccatttgtctttctcacagattgtctcgtaatttaacagaccgttttttttctctctcctctgttttcttctccatctcaacatttagccggcttatagcctactctgactggtccgtacgtatctttgctttcagcgggctggaggtcactacctcctgcacctgaatcctccgaccacccaactccgtagccccatctgtgtgctgtcctgcttgctgctctttgcccctcttttcttggctttcttcgtgcgtctggtatacatacacacccgctaatagtatccattcggagatatttatttgtccccataacatggtcaagcctcatatgttgtgatctttctcaagttatgtgttatgtatgtcgatgatttctgttaattatagggttatctattttctatggttgataatagaatattaatgtatcaaaactactttaaaaatatgccccgcgtcatcacgttgtagaaatttattttatcgagtaaaatatgtggaaggcttcgcggcgcgtcacattgagttcccctttaccaaagtgtcataaactgagcacttcactaaaaattttataacctaaccatatggtttcaagttcaatgaaccttgtttagaaggtaccaaggagtacagtggtacaccacaagggtactgatgcgctgtagcactcgtactccttatgacccaaataaaaacaaacatcaccaaacgacgaaattgaacaggcggagaagatgaccatcggacgtggtagggatgcctcaataagagcaagttgaatagtatagcccactactggctctaaatcatctatagccaatataatagccaatttatataatagtttcttactatactattaatacctagtcccacatgtcatacacatattacatcttggagtccgtgctacagctagctatagatctataatctgctgctcttctctcttttcctttcttttttttaaaatatgtttatatctggcctgctatcgtaccggctctgagcagagcggaccaattaaggccacagcacatgagggcacagtggatctgcacgctgcaagcgacaatggagtcctccccagtacacgtggagggaggagagtgaaaggagccaggcttgcctgggccactgtgctgctggttgatggactctttgcctagtgaagcctcttcaattcctccattgatctttctttctgctagatcagcatggtcatggccatgctccaattagagtgctatacactggagtacttgcggaaatgcttcagcaactgggaagttaattaagtgagcatggactcaatggactccactgtggagataaaaaagagtggcgcttacttgcttatactcaatattatcttggagtggagctcatgatcaaccagagtgatctaaatctaatcttgtcgatgcctagcttaaaatgtgggctagaggttggacatggcaaatttgattgacatgctaccggcaagattggggttataaatgggatgggacttggccaccaaatataggtgctgcacaaatgatttatgcaaggcgcagatcaccacttttaatttgtgtgactaaattttaaattcctaaaaattccatgttaatttataattaatatagcttatgtaattacattgtttgggactaatttgatgttagcctagtcgacaactcatcatctaatttgatgtcctaaagcaaattttgtgttgcgttgtcgatcggttcgtctaatgatgattgtaagccgtacaatttactaaaagataatttatgggtcaattttttatgtataagtcattagaaatttaaaagataatgctaaaaaataaagtacaataaaaaaagacataacaacttagagcaagtataataataggttgtaggccggctaaatgctgaggtggagaagagaagagaggagaagcgggctgcaaacttacaaccggcttggacaccagaaccaagaaactctgtgagagagacaagtgggctctgtattaattataaagagctaactattacaaatcggctgtattattagccttgctcttgtaagttgcagggcaaacgatgggggaggcttaaaatttaatggtgtggacaacctttaagtaacatggtccaatttcaactacaacagtattctccctaacaactcattttaatccgatctctcctgaaacaaatcctggtgacatgagacaatccctatgcagatggtcagatttcaacttcaacagtataacccctaatatcactcgactacattttcatcctcttagaattttcaaaatgcaaaacaccgtgttagtgacatcccactatcccaatcgatcaaaaccctgcctccttaacctgctccatcagcgcaccccacacgcacttcatcctttaaaagcacacaccacccctctccagggagaagaaaaatccccaacaaaaaaacaaaagaagagcttgatgccataggagagcacaagagctcaaccacacacacacacacacagagattttgactattaattttcatcgtctttggttttaagttggtgtgtgttcttccatggccggcctgagtgtccttcttgagacacacaagaacgatcaccaccccaacatgaggcctccccaaatcatcagcaaggccaccctccatagccacccagagacgatgtcctcctcctctccggcgactgcgacgacggcgacgatgagctccttcttgcagcgctgcttcctctgccgcagggagctcgccgacggcaaggacatctacatgtacaggtccgtccgtctccatccatggcatgcatctaagctgtctcttctgttgattactctgtccattccatagtactataatagattttgaaggacatattttaatactatgaatttagataaacttactggttagattcacagtaccagatacgtctcgcctcttcaaaatttcttatattttaggacggagtattatattactgctgaatattgatgtatatggctatatatatgcagaggggacagagcgttctgcagcgtggattgccggtgcaagcagatcttcatggacgaggacgccgccgccgccggcggcaactgcgccgcggtgcgcgccggccggcggcgggcggccgtaccgcgcgagcaaaccggcgccggtggcttcgcgtactgatcgatcgaatcatcgatcagcccagccgtacgcgcgcgcgcacgtagattaattagcacaaatgaaacgaaaagcagaagatatcaagcacgacgatttggggaagatcaagatgcttgattcatcatataataataataatttattattcactcgccaatgaaaatgtactggttgattaattaaatccctttctttggagaatggattcaaatcgagcatggagtggagtacgtggcagctcatctgcgtggggcccacgtgtagatatgtgtacatacgtgtctcctctcctgatcctctgctggtcctggagtagctgtaaataagggataagatgggccaaggctgggacactcttggaccctctcctcttgaagcggatcatgaccgtaattaacggcgacaatgctcttttttaaaatactccatgtctttgttgattactctatcttttttagaagagtatataattttagcttaataatttatctccaaaattatagttttagagtggtctactagatatgtttaacacaatcaataacactctcttctcctcgtattaacaaaggacataatagtgcccaccaagtcagacacttcttgcataccctctgcggtctccctgacagcctaggggaaaggatgcctgagaaacacctacgctgatagtgctcctacgtagcgcgtgaattcgtctacgtgatggaaaaagcagtggggtctatagctacgttgggttctccgtatctcaacaaaggctgtgtttagtttagcacaaagtttagattttggttgaaattaaaaatgatatgactaaaaagttatgggtatatgacaagttaatatgatgaaaaaggactgaagtttaaagtttagatacaaactttgaatctaaacacagccaaaggaacgaacacctcgcgcaaaaaactctggcacaggacccacttggtgaggactcggtgaggagaagagttgggagatgttgtagcgccgactagtgtggccgccgttgttctcccaagctggtgaagcctcatccaagtcccccacctgagaaaatccggcggcgctgatgcggccgtcaccgtcaccgctcggaacgagggagttccggaccgccaccgctctgcgtcgagatggccccttgctgctccgctcggcgcttgctgaagatgccagaggacgctgtcgctgctccgtgtcgagaaggcccgcccgctgctccgctcgatgctcatcgccgcgtcgccgggggagctcctcgaccgccggccttctaggcttctccgcgcgcgagacggtgttggcgccggtgccactgagggttgaggggagagtaatcgggtgccgccatgaatggagaggaggggcaccgaccgggggagctcgtgcagctggtggagtcgccaccggggcacgccacgaccacgtcaccgccggcgctgacgaccgcgcctacttcccgtcatgcccgtgacgacgccatcgtcaacccgtcgacaacaccgccggccatcgccccggttgcggatctcgagcggcggtggcgtcgtcctcccacgtcgctccactccagatccgcgccgccgccgccgccgccgccgccgctccagatccgtggcgccgtcgtcaccaccgcttgaagcaaggacgagcctgacgacgccgcctcctctccgcttcggctcaacaccagtaaaaggggaaaatgggagagagaagcaccgggaaaggggaaaggtaaaaaagtggttggcttgggaatcccgtgaagtaacttgcatgagaggagtggattctatgtgtatttgttctacgtggcatggggcttacactgctactgcctaatagggtgctccttgggttggcggcaccgaagtcaagctgatgtcgtatcggtgtcagatgcatatcaaatggaaatatggcgatagagagtcggccgtctcctgacgggattcctccgacatgcttgtagtggctgcagttttgctaggctcagcgccacggcctcctgcacgagagggcgtagcgcgcagccaccccgcacatgtctcgtacggatagcaagtgtcctcgatgagtttaatggactaaggctttgtttgatttagcttaaaattattataatttgagttattagaagtaagttgaaacaaacaaatagcttattatgatatattattacaacctataagccagattactataatctaataatccactataagatgctttttttagattattaggtggctaacaactaacaaataactaataatccaaagaaataaacatctaacaacttactctatgtaggtttattataatctagtttatagtaatttggctcaataatctagattgcaataatcttaaactgaaacgaacgtggccaactcgagtcttagagagttgagtcgagttcacttttaaaatcatttttttaacaaatcaagccacgcaagctcgtcgattcattatgaggtgagtgttagccaaagcaaaactgagaagagaagtacattgataacaaaatatcagcatggggaaacgtcattttgttcataggaggcaacaaaaaggaacaacacataaataacatacccaaatattaggtcgatccattcatgcaaatgagcggagacatgatcactctcaagagctttcctgtgtttacatatgaaatcaacagggttgagaccaaggaggcaattccacggagcctgtaatacagaatgaaataacttacatagctttccagaaagttgagttgaccctaagtcaaccaaattcacattagtgtaactcagtaaggtaaaatatctctggaatctacagaaataatcaccataattaggttccaccaaagattctgattagacttccgtgctaagcaatgcacaatataccacagtgaattgagggcacagtttttaacaaaactcactaacttttttacattattcatgtcttcaaggacactgttccatgttctgttgatacaagaaaacgtgtgatcatattgaccaaacctgccacattgctgctgaatagaaagggccgtaaaaggctctatcctgacaagataatataacacctgcagtagatgcttatgtcaacaaccaatagcacgataacacctgaagggattgtcattgatgaacagtagagaaccgattaatcaaatgggatgacaataaattaatctaactccaaacaaaaggggcaacacacaagcaaaatgctgacacaaaacatgcataatctaagaaaaggtaccatgccaggacaggagcaatgtgaacggtaggtgaaattttgggatgattgggtcgttgaaactagagtaatgttcttggggtttctccagtcatgcaggattcagagcgccaaccggctgcattgaaaattttgaagtatcactatcagcagttattgaacaagatatcatccccagagtaaatgaatggaaaagaaaaaaaatgcacagaagaggtccaaattggcagcaaggaatgaggtacagaatccacttttggaagatctcagtatgcggacgccagacagatcttccagatccaaaatgttttggagtggtaatctgctaatatccatggaaaaacagggtattgcataaattactagtgatcatttaaacacagtagtagatttattagatcagaaaatgagagttatgaagcaaacatgcatgtgcaatgtcgttgtaactgcgcccagcaagagtgttcagttccatcaggtagtcaaaattgctaatctgcacaaaaggacagatctacttaaatcttgaatacacttaacatgttgggctgaaaaggtggttgattgcatatcaacctcccatctagcccagcactctgtcaattgcaacttcttacatatttactcaggtctcaaataaaaatgcaattgattaaaacttccagtaagagcagatttcaacattgaactttgcagaagaacaccaacctgggtagctaggaaaatgttgttcaaataaggaggttttgtatgaatggttgcccgataaataagcatgtttacatgctttctgtatcctagataaaaatcatatgcatctttaaaatatttaggcagctgtagtgtgctatatgattccaacaacgcaaactagagtatcatcaaggatgtacctcgaaatcgaagaaatttgacctatctaccatgaatagctctaaagcactttaccgtaacaaatacctgcacagttcatttaaatcagtatgacacacaagtactataaatggttactgctgactcagtagtccataggtatatgagaagggcacagctaataaaagcgcaaaagttatattagctaacactaaagacagtgcagcaacaagttcagtgtacaccttcatactagataataaagaatcatttaccttctataaatttgatgaagtggagatatgaagcagctccaatctttatcttgctgatcatattggccagtagtagatgcagcatcatccatctaactgtcactatcactaatatgctcatcaattataaagttaagcatcttctaaggaaaaccattactacctccatcccaaaattttgctacctagtacgaaattggacacccctgtccagttttatagtactaggaggtgtccagttgagtactaggtaactacattttgggatggaggtagtatacagtatacactagggcttaatatatccattcccatattacattggagatgaagcagaatactaccatcaatgaatataaatacaaaaaaaagaacttctaatgtcaaaaaaatcaacatggcaaacataactagtcactatacaaaggtgacatgatgaggggtgaaatcagaatcgcctgtctcctctgcagatgaggggacaccattatagttagttgccctctgttgtgcctgggttttcctgttcagcaactagtttgacatctgtgtcctgttgtggggtagatgagccagtaacttgggtggttggatcgacatttccattgactgcctttgctacttcacaattctcctccagtgcctgagctgacgggctggatgagagcacattgtcggaatcattgtgatccacacatataggttccaccatcagttcaatctggtccatttcattaggattttccagatgtccatcttgatcaaaatcagtgttctgctgtggaattacagagtctggagcaggagtggctgtattacactcatcgatggctggtgtagctaagtgacaatgttcctccaactccagtgaaggacatggacagatgacattgttgaaatcattgttctcctcatccataggctcaagggtcattgttgcatcatccaccatgtgaagctcttcctcttcctggtgttgagcttcttgatcggcatccacaatgttctgttcagtttctagcaaaagtagaggcatgtcttgagtggcagctgattcaacatgtggactagtagctgaaccaccattttccttgatctcgccaaggtcgtgaagaacatcttgaaagccatgcagaaactcaaagaccaaggcttgtgtggttgtatcagctgtggacgccatggctatcttggccttctttaccataccatgcagtttatcaacctacaacaatcagcagccttcaagttaaatatattagttaaattatgcatggactgcttgtaaaaactatttgaagtcttgcaaaagacagcacgtgtatctgaaacaaatttaggtccaattaactttagaaactgatcgtaggaactgaatagataatatggcttactgctttgcggatcataggagccttggcttgataatgaagattaatggagtcatcaggctgtaatgaagatcctgcttccacatcatcactgattgatggtacaagataccgccgtgtagcccctgtgtaccaatgcaggtactcctcataagaagacgggtcatactgctctgactctggaaatatgcgctgtcggcgggcttcccattcctgaatgtactcatgatgtgtctcttcccagttctcacgttctctgccacgtcgactaatacgatgcagcgcctgtagtgtaggccgaaaaggtggtggaatggattggcgaagcccaaattgccgcatcactcgctcaggcaaatacatctcgactattggaaaatttattagtggagcttgtgtaagccacaagtcagcattttttgtacaaagcagtggcaagcttgcagactcaatgtgcaagtacggctcccacttcacctgatctgctcgctgcagattcagttcatccctgtactgcttaagacagcgtgtagcattctcactttgtgtgcgagcacctacccaacgaaagccaactgggagcacatcctgtggaatgtctgtctctgggcacacgggagaccggaccaacggtctgccaacatgggagcgctcccagctccaaagctgcaagagaagcaatgaaccaccaatgttcttgatattgtgggaggaagcaacagaacaaagagaacggtataggaaggccagcactgcagatccccagctgtatgtcccaacaagagaaagatcagcaatcagtggaagatatatcagactcatccgtcctgttccatctggaaatagcaccccacatagaaggctcaggatatatgctcgaacatgcctctccacagtctgatcatctgtcccttctggtaattcatagaaatgcttctttagccatttgtagtgcagaaaagattttccaggcattgatggtcctcttggatcatgacctagacaatcaatgaccatctgcgcataatcatgatcagtggtagaacaaactggacggccatcgataggaagagctaacaacattgagacatcttgtagtgtaactgtcatctccccagaagccaggtggaaactatgagtttctggtctccaacgctcaacaagggcagtgatcaatgccttgtccaactgaggcatcttctggcaaatttgtgagagcccaagcaagccagcatccctcaaataaggacggtatctctcatgaaattttaaaggtttgtgatgtcgcaacttcaactgttccacagcctgcaaaaaaacattgacctcagtcagactgcaaagtttattcttcctacaagaacttgttactcatgcaactatgacaaaacttaattgctcttagattaacctgatcaccgaagattgcgtccgatcggtggttgatctttggattgagtaatgtgttggatacatgctctactgatgggcttacaagacaaggtagtgggctttgctgcggagtaaactcaacattgtcctctttatcagaagtagtacttggggaagaaggtgtggaggtttcatgaaagtccatgtcattttcagccaaagcacttctcccacggccacagccacgaccacggcggccacctcctcctctctttgaagacatgatcctgtactgttctagtatttgggaaattcatgagaccagtcagggaaaaggcacagacgttgacacttgacagtaaaaaaaacacaagcatatgttgagaatttatgcagtggtgaagccctgaaagctgcaatgggtgtgcacactttagtagcgagtctgaagtcttgaacaatgcagaggggggtctctccactaacctgatcacgaaaaaagagggagaaaaggggggaaaacatgcatattcctctttatgactcgcttcgaaaagagaattttcaaaatgaattctgcaaaatcatttcatttcgagtgtcccagacgagcctacatcgattgaacttgctatattgatctacatatgcatgccaccaaacaaacacaacagtggattccattttcgtagtatgattttccagtgacaaccaaggaactgagacttgaagagtgagaatctacgggaagatgacattagaggattgtacctgcgccttgtgccgagacgcgcccttgaggacgatgtgcctagctctagcaattcagttcgccggccacccacggctccgtccccctgccccctcctacaagtgtggctcttcggcttgctacgcccgttgctcgcccctccaccccatggccgctggtggcgaatcaccgatcacacacaccctaggactcaaaatcaagctataaccatgaccggcactaaatccggtggccggaggtggaagacgagacaaactgtggatataccaagtaatgacaaagtaaaagttcaattatgttgacagtattcagcaaatgtaaaacatcagaaaacatgctgctgtgtagagtgagcagcgagcgacctagcttccactccttccatgttgatactcaccagatcaagattcatcaaagaagaactacgagctacaactgttccatgttaatattcacaagatcacgatttcgtcaaataagaactacaagctagaactgccatccaaggagctagcaatccgccgctgcaagcaaaccagggagtgaggtcccatgtgtcaccgactcaacgcaaccctaggaggaggaggaggaggaggaggagaggaagtggacgaagcgaggagcacgatgcatcctcgaggctcttctcccctcctgcatcctcccgcttcctccgtcctgtcactgcggaaccctggagaaaagaggagaggggaagaggaagaagaagggctcacctcggatctcgagaatggaggcgcagaggcggcgtctgagggggagggagaggcctggatgagacgtcttgccggaggaggaggctcggcggcgccggcggtggcggtggctcacgagagcggcggcgccggcggtggcggtggctcacgagagcggcggcgccggcgtcgaggggaggcggcgcgaagaagcgacggaaaaaaaaaaaagaaaagaaaatcccgacctcccgagcagtgtgcttgcctacttggtaggacggcccaagtagcaattctacattgcggcccaagtagcaattcactctgcggccagcaacagtaccagcaaaatttatatcaattgaaaaaaaaaaacatcagttgcgtatttgatcctattttaaaagctaaaaaaaactaccattcgattaattttttagattaaaaatttactttatatttgtctaaattcacacaatcactaaagtaataggtaaggaatcaacatgatgcatattttaaaacattcaaactcacttttgacaatagcatatatccaaatttctccaaagcagacgaggcgtggtagggaggtccgggtccctacagcctactcatatctctgtgtcgctcaggtgggcctcccgctgcgaccagcccattaacttgtccaggaccagcaacgcggcccatgccggtcggaactgcccgaatcgcaacgctagatcgaacggctgtggtggctcgggagatgcggcacggttggcttgttgactttttccggcccggattgacgccgcaagccgaatccacgagtagtgggctgcggaattttgttttgttttttttttctccccatcccatcccggccctgacgccgccgcacgacggccggccgcggccgccgccggggaggtcgccgccgatgagccccaccgcgccgtcgcgtacgggtcgtgctctcgcccttctccctgtcctggtgctgctgctcctcgtctgctcgccagccgcgtcagctggtacgggacaatcgccaccccaccgcgactcttcttccgatctcggtgctgttcttgcttagttttatctgtagcttttgttggtcgttagctgtatgtgtttgtttgttacttggacggttcgtggtgcccttgagtggatccttgatgcgttctgtgcttggtcgttgaaattgggtgtgtgtttcttttctacccagagacagtagcgtaggtccctgtgggctcgtagattgagttaagctgcgtggaatttggtgtatggtaaacgccgcctgtttgcattttaggaattactgcttaggaatttttgtttgtacttctgatggatgttatcagtcattaccagcctttactaggggaaaatatcacagtttcttcaaattgcatcctgctaggagtaggatgagcaatggtacctggacaccaaggtggtacttgagtgaaatctatagttttttatgaacattgtggcttgagatcgaatggagtagtttatgttaatgaatttaggcatgtttaattattgtttgagcctctgcaaatgaaaaccatggtagtcatacttctatgactaaaatcattattgtctggcatcacaggagaacagaaaggtgtatgtgtttcgcctggtggacgattccctgccttctcatctgaaggtaagcgtcctggaagagcagctaaggggcgcagagatctggcactatgtagagtattccggcagaacacgtgttgcgatgtgtcccagacattttctgccctgctctcagtgagaaagcttgcatcgactggtgaaggtagtcaagaatgccttcatctgtgggaactgctcgagtgttcgatttgtgatccacgggtgggtgttaggcctggacctccagttatatgtgcatcattctgtgacatggttttcaaagcttgctcagaggcgtacttcgctatcgatgtgaaaacacaggtaaagggcatctctttaagctgtgtctaaataaaattttcttgctataccgatgtggtactttacaaggacagttgcagttgccagattatacttgctcatttcataattcatagtttgatctagataatattaggtgaaatttgatcatagataaacagttattaatcgtgcttacaccaatatacatgccacgggagtttttaagttaaagttgtggcatgttaattgcttttgtactttcttatagctacggtagctcctctctttttttattcctttgcttgcagaactgtaagtagctgtgcctctgctttcttgtgatatttttgttggatattattttgttgttcggttctgatatctcccccttgctgctttatcaggcattgtctccatgtggtttaggtgacatcctttgtggcaaagcacataaatgggtctctaatggcacagagctatgtcgctctgctggtttctctgtgcaagctttggagaccacctcgggtggagtggatgacactttctgctatggtgggaaagcaagttttgatgccatctctagttcatggacatcttcaaaagagcgtccagtattaagtgatgtggcctcttggaatcttgaagattttcgcagatgggcaagagaaatgcctgctagtgaaagagtttcatgggcaattggaggaatggttcttacagcaggccttatatttatcaggttttatatctctttcttattttcatattctaaataacaggtataggagataagtgtgactggtcggaacttgatacaatatctgaagaattggttcttttcatgcctatttcaaacaaaaatatcttatgaaagatcacacaaaactttggattatgtccgtgtgttcgtttaaacttgcaattttcttccttggctctctagcttaatgccatacacatgccatttccccctttcagatgcttgtgttgttacaaaaactaattttttgtagtttgtgcagtaaacggaagagctacattcctggccaaaagcaagctgctatcgcccgcaatgtgagaaagctggaatcaagagttaacccacagcagcttaggcgaaattaggaatgcgtaggtagcatggattcctatttccaccactttgtgattcttatatttgaatctgcaatgaatttactgttgaagatgtcctctacactggtggtcagatagatggatggcgtcactggttacaacctcctttgtcatccttgcgtagaagagcagaagagatctattaattcttgttcaggttatttctgtctgcaggatttatagatttgcttgaacatatgtatatagttttggaatggaatcttcagagattttcttcatactccttcagtaactcttgcattctgtctatttttaatcagcacgagttaaagcactcgttcaaatatgttttgctccagatagcccttaaaagaaatcatgtttgctccaggcagccctaaaagaaacttacaaacatagggaaagacagtacgttccgtgttctgataatttgaagaaaacaaagaacctcttaataattgcatgtgttttgtctctctttggttcgtgtattcattcaagaatttaaaatttagtttccatgtccttttcagattataatgtaaaatgctgatttttgtagaaaagctccttgaacaaactgagaacaggcacagcagctgctttccccgtagggcaaccacgagagttgtaactttattttgtattgagcttcatccatactttataaaagcaaaataaagaagttacagagttgcctaattacaacaataggcttttgagaattaccatagatttgatactcgaatcaagaagctatagaatgttatgaaaatgccatccatctacaactatgtaacattaagaatgtttgaaaatgcgaatacgggtggggaatgctcctgcattacaaacagtaagaacaaaatccgtggaccattctatcttacggcagattcaactgcagaaaactaagacagattcaatgcaagacaggaacacttttcctcgttgaaaaataataaaataagattgtcagcaagtgaggttacatatcgcaatctgaaattgatctatgcagatcaaccctgtattacaccctcgttgctcaggaatgccctggcaagtttcatttgtagttaaggagacaaaataatcatcatggggagctcatagaaccccaaaatgaacctaaaataacccgccatccaacagcgaatatgaagatcttaatctttatgtgaatgcgccaggtattggctggtgtacttgtccaccttcggtccagatgtgcggtacttcgcgtcatagtactctaccattgcagatcccactaacgctgctagtgttagggcttgagcatgcaacctgcaataataacagttatattaattaagtatgtgggctgtcaatttgtagcatgattgactttagtcacaactcattggtgtataatcatatggaatgtagttaatcgtacataaactgcctacatacatgaaaaggtacaggcattcagatccaaatatctgatattgccacccaatgcgttagatggggttaaggtcgtgccaattttacatctacgaggaaaaacagaacttcaaagatttaatacatgactcagtgcattactacattgactgacttcaaaaaagaggtggtaatatcgctagtagatgcgttggaaaatagcaacttagaattctaaccctctggtctcaacaatagtaatcaaaccgttcaaaaataaagaaggtggtccgtatgtacatggcttctatttaggtgtcattgctttatgcacctatctaatctagcccaaaaaaaatggggaacagaacagagaaaattatgagggccagcagtgaagggtgcacactttcacaggacaaaaatgctacaaggtacaagctatatatggaattggacaatgcatttctgctgatctaagttttgacttgctggatcggatggactagtataattgtaagtgcactatacacaaaaaaacgaagctattgttgcagaccaaggaatctttgaaaaccagtccataataatactgatacacttccaaccttagatatcttagtgacaaaaggtcacgtgaattacttcgtacagctagcgacatataaaaatagtaattacaagcaacgttttgtcataaaattatatatgcatagccacctaggtagaatatcaagttaaacagataagttactaaatttcaagtttcctgcgtttcctgcagaatggtctgcattgcaaccttaaaggataactaagcccttcagtgttgaatgtaatcaacaaaatcaaataattcaccaaataaataatggtgcattcttaagtctaccctttttttttgaaagaagggcaaaaactttgccacttttgtattgataagaggaggagaaaagcctcaacagtgaacctttacaggtcttatatctacttgcttggcgggataattgtcaactaaccaataaagacctactgttcacgaagaacaaattatgaaccccgtggactataataatatcctacgggtttgataatctatagtggtccccggctgcctgctaataatcactagcttg

SEQ ID NO: 11262 - DNA, 50683 bp, Oryza sativa
  unsure (1)..(50683): unsure at all n locations
tatgttcaatcgaccttttaattatcatggcaaggttcaaaatccttttatcttattgtgctaatgttcacaaatcacaatgcctacaaagcgttctcaagatgaataatccgtgtattcttaatcatggtaagacacgagcctgaagctaagatagatgagacaaaggcacaaaccttgcatggatgatcttgacgctagtcttcatattgggcctcgaccagttgtacgcaatcgagctgctgatcccagtaagccataggcaaccttcactcacaaacacataacataagcaacgtaaaatagttagaaaatatccaaaaacacgaggggaaaatcaatctcaaaatttggggaaaaggggaatcctaaatagaatacacaacataatttttttcgcaagattgagagataaaatcatataaagaaagccgatgaacttctatcgggaagacgcatggattggggatttggtggtgacgcatgtagcaaatcgtacatcagaaaagaaaagaaaaaaaaacaacagaaaagtagcagatccgcgcggaggagatcgaaatcccaggaaaaattcacgagatattttacctacggcgcggagcttgtggtcgatgacccacttcctcatggattcaatcttgcccggggcttccgccatttgcttcgccgcctcttcccccatcttcctctccgatttctctcgcttctctttacgcgctttgtttttcttctttcttttttttttcgagctcttttcttctctctcgttgcaaaattgcaattggagaaagccagcctgcctctagttatatcggaggacttgtttgtttccggtcctcaatgaattcggaaattcgtttagtatccgggtaaattatttggattcctttcacatgtcccagcttgttgttgctaatttgttattctccacttgcaaaaagaaaacgtttttgtttcgttaagcatgttctgtatttcttgtgaccgaagaaagagagagataacggttgcgatatattctttggaaataaatcgtcctaataatttttaggtgcaccctctgtgaggaagtggaaatgactttatgattttgcgaggaaacagggatatgattacaatcttgagcgagaagctaggacacactccctagagcctgaaaacgccacaccgtatatggcatataatttgaaaaacccatatgacataaatcacactctgtcgtgtgatttaaagagacgtaactctctagtattattattggaattctattaaagtatacttatatataatatttgcgagtaccaatatattagaatcgtgcaccggccacaaccccgtactatagcgctgtacttcccgtgatgatttaatttaaactcattatagattgagaaaaaatactagaaaaaggtaaataaaagagaggctttactcaatgaaatacacaagaagacgcatgcatcactgtaaaagcttaaagatatgaatgtcataacgattaatatattcgatctcatgaaatttgtactgaatcacatttttttatacgtaatatttatagacactaaatttaaatattgataagttaagtcatgcaccaacgactacaaaattttgtactcacaataacactaagaaaagttaggtttttactggtggtctctgaaaaaaatggatttgctaaaagccaccgaacaattgtcatattctactcgcgcagtctaaaggccattaagataatgtttccaataaagttggagagagaatttgactaaaatggcttcgctacccttcttactaattggcattatttctcctctccctgtcttcctcttgtttcttcattcacgcaagatggcattgatggtgagcatgacaacaatgttgccatatctagttacctttgagtcttctagtgctcgatttgccgattatcaaaatccgaactctaatgcttgaactagccctatcgtggctcggtgaagagaatggtctatggataaagctggctttatagaaccagtcactactccatcctccctaacctaagagccaccacctaagaaccactttgacatcataagacctgctcctataaggctactccaccactaccgcggcaaacacaaggcccactcgacatgaggcggtgcccaatggctcaaatcagctccatcgcgactggtaccccttcgcaagaggaatattagaagaatgaacaagaaaggcgaaggtataattttcttgggttttgtcattactaaggtggtgttttaatctcctgaagataaagattaagtgtttcacgcaaaacgatgtggtaataatgtgcgactaattgagttttaattattacaaacttgaaaaatgaattaatatgatattttagaataactttcatatagaaagttttcgtacgaaacacaccgtttagtagtttgaaaagcgtgccacaaatatccgaaactttatcctctccttacggtggattcgaacggggcctaagtggatattgtattttagtactcacgatgccctgcagtaaattgccacactttttagatatcattagacaaattttcccaaaatggcaagcaatataatgtgtatgaaactagttattacaaagataatataaggtgtatgaggaccaaagtacaagatatagtcatccgtttaactaagagctttagtatatatcttctcaaagaaagtccaaacatcggtagatatagtatatactccgtattaacgtcccgaacaacaaaacaactttgcagtctctgaaaaaaaaggtacaactataaaaatatttgctcataaacgacaatgcatgagtaaaattgcaacgtcgttcttttcctcctcataaaaaaaaaagagaaaaagaatcaacgttcacgcccttcaattttgtccggctttgcaaaactttttgcagccctcgccaacgcaattcgtacaaaccggaagggggtgggtgtgacagcgcagaggccaccgaatccaacgcgaaaacggcacgtttctgccttggacggcggccgcgcggtcaaacctcggcctccccctccacgcagctccacctgacccggcggcgactcgtgagtcgtgacacccccccccccccctcgcggaagtggctcggcaggtggcgaggccacggcggcatagttggattcgccacgtcatgttaaaggaaaaactttagtcaaattatacataggtatcacatcactcaaataagatgataataatatggaagaatctcatttacacttgttttgtaagttagaagatccgttgtactcccttcgttctaaaaaaagaacctacgatgtgacatagttttgcggagagagtatctggttttcctgtttaagaatgaaaattggatttaagggctatttactttggtgctaaaataaaccatactaaattttgacaataccaagactttggtaaggttagcaatattgtcaaattttggcaagatggctattttggatgcgttcattttgttgccaacatacatgctactcacacatattgctgtgcagttgctaaattttagttattactgtgcagttgccaaatttctgatatatttatcaaaagttagtaagaaactaaacatatgcaacttaaaaaaaaatggtatgatttaaaatgacatcaaagtgaaagttaagggatctcaaatgagcttattcccgttccggtttggttggcgtagcgaatttgtcggccgttcgacgagcagctggctgggccggctcactcacaccagccgcatcgaggcccaactgagaggctaatgggcctcggccctcgggacggtttgcctccggctccggctgcggatggccaccaccaccaccaccatcatcatcggtgcccgccgcggaagaggaggagaaagggaaaaaccccgcgctgtgtagggttttaggcgggtcgaggtggaggggggaggatggccggcggctcgtcgccggcgatacggccgatcggcaagtcggcggtgcaccggatctgctccggccaggtcatcttcgacctctcctccgccgtcaaggagctcgtcgagaacagcctcgacgccggcgccaccaccgtcgaggtcaccctccgctcctacggcgaggactccttcaccgtcgccgacaacggcaccggcatctcccccaccaatttccaggcacgaatcccccctcttctcctctcccatttgctgcttcgctctcgcgatttagttgctgaccgccatgtgcgcttctcaggcgctcgctctgaagcaccacacctccaagatctcggacttcggcgacctcgcctccgtcgccaccttcgggttccgcggggaggcgctcagctcgctctgcgcgctggggaagctgacggtcgagacgaggaccaaggacgagcccgtcgggacgcgcctggagttcgcgcactcgggcgtggtgaccggcgagaggaagatggcgcggccggtcgggaccgccgtgaccgtcgagaagctgttctccacgctgccggtccggagcaaggagttcagcaggaacattcggaaggagtacgggaaagtgatctccttgctgaatgtgagctgcccatcttattagtccatgttcgttttgcgggcatttcaatttgcgtaaagctcatgtatgttattagaatctagttcatctcctgatacacatgtttataccactctgctgttttactctacacatgtttcgttctggttctgctaagaactgtgatttattttttttctttccctaattaggcctatgcgttgattgccaaaggggtcagattagtttgcacaaatactgttggcaagaattctaaatcggcggtgcttaggactcaagggagcagttcactgaaagataatatcattaccgtatttggtctgaacactttcaagtgcctgcagcccttcaatgtgacaatctcagaaggctgccaagttgatggctttctttccaaacctggacctggtagtggtcgcaattcaggggatagacagttcttctatgttaatggcagacctgtggatatgccaaaggtttccaaacttgtcaatgagctgtacagaagctcaaatgccaagcaataccctgtggctgtattgaatttctgtattccaaccacatcttatgatgtgaatgttgcgcctgataagagaaaaattttcttctcatctgagcatgccattttgctatctttacgggaaggtattgagaatctgtactgccctcaacaatgcagtttctccatcaacagcgttgaagatcctgggaaggaaatggacccagccatcgatgggtctgatgaagacatgtgtttaacagaaaaggagaatgtttcagctcctgaaaatgacgatgacatggatgaaacagatagtgatgatgaggttacaccagagaatcagaaagtgccttcttcagtgacaacaagggtagccactggatctacacccaaagatgtgagccccttgtcaagaggcccacctgctcagcttgatagatctactttgctttcagcctaccggtatgaacaacgagaaaagacgcctacacgagtaaaaagttatccagcacaagcaaatcatgttagaacagggcttgctgcaaagtcttctccttcaagtgctgttcaaccttctattatgaaatttctatcacaaaataaaaggaaacacgaagacagttgcaatcttatttctgaagctccagtgctgagaaggggaacatgcttggagcaagtgaggagaacagatttaggagtgaattcaccaactgcactaacctcaagagtatctaatattccagaggttaatgcacctcaaggaacaaatcctttgcggcaccattccctgcaatcttttgtacctgagatgccagaagattcaccacagcattctgaaccacctaatattgtttctcatcgtgatgaagtgcctcagttgcgtccatgtgatgttcacgctacagaatctgaagtggtaaggtagaattttttggagtgaattcttcaattttctccattatcttttatttttattacttttattgctttatttgccttgactggttgttctgggcattcttgttaagtgtgtatgctttgtgatcttatcttttaaagaagttcatggtgaatttctcatctgttgtcacaagtcatcttcaatctactcttagctattttaacttctgcttaatttggatcactaaacaagtactccaatgtttgtagaatagctttttttctgattggctaaattgtgattgggcatgtgtccagttcaaagaaaagagaacctagtttaaacatatgttgatgagatttactatacaatgaaatgctgcaatcctcgcaggataaccagcatgatccatgccattccaagtttggtgctcccagtcgatgttcagaagtggaaccccaaaataaactgacaaatatttccttgcctgatgctcattatgatggtcatgacactgcagcacattctggacaatcatcttatccagttatgcaatttacacttgctgatcttagaagaagaagaaggcatagttttatgatatcacatgcaaaaaaaggaagttttcctgagaaatcaacaaggtagcacttgaaactatttttatagaaaagttatgttttcaccaggcgctgggctttatgaattactagtttatttttcctacctaggtgttataaagctgcgacactggataactatgtaccagataacgaggagggaaaatcgaattctttagctgcagccaccagcgagttagataagcttttcagtaaagatgactttggagaaatggaggtgcttgacttaacttcaaatttgaatattatcagttttctaaggttccttgtgagattatactgctaatatactgtcaatgaaagaacacttgttatccaagtgataatgttgcttattttccctgcgcgagtgttttcctttttgtcgtttaagtgctatttcaaaaagaactcttttatagttatatactcagtagctcagtgcttcggaggaaccccaatgacttttgtcaatcatgaaattaagttgtaccaatacattttgtttctttagtgggaccagccagctatataactgttatttgttgtataattttggtgctttgatagcttgcttctgttcatggccctatcaagtacgataggtcgtgtgattcttgcaagttcctcgcaagacatatgttgtcttttgttaattttatctgaaagcattttattattgtgaacatttgttttttacttgagtggtgtgatttcattgttctaaataggatgaaatattaaaaaaagtgctgtatgaattctatatttctatttgcagtactttgctaaagaagtttatgaacactaaataactagtacaccttcaggttgttgggcagtttaatcttggttttatcattggaaagctggaccaggacctatttattgttgatcaggtatctctctatagtctatacatattctattaattgatgtcatagtattgtataaacccctggatatctgggttgcaccttcaagataccttatgtagtcatgtctggtgattaatgtttttttcttcttactagcatgctgctgatgagaagtacaactttgagaacctttcacagtcaacaactttaaacatacagcctctccttcagtgagtaagcaaaacttatcatttccatctgttattttggtacattgaactcattcagtacctattaaatggtagggtgttttgtggtttgtattcagaatgttgaaatcaggtttattattaccttttgttatgtatctctggtactgtatatctgattgtattcaaatacagaccactgagacttgacctatcaccagaggaagaagttatcgtttctatgaacatgagcactatcaggtattacatttattgcgtattacaactcagttctgtctactaccttcggtcacaaatatttgactgacatttaggacaagatttttcaaactttttgaaatctgacattgataatttctcaaatgcttagtgtaaaaacaaaagaaatggtgtacgcagatttgcctcaaaaagtactactatcataataccataaacttattagattttatgaacctattctagtcatataaaattgacggttggaatataaaaagtttaaccaaatcttgtccttagcatcaaatattatgaccagaggaagtaattaacatgtcggtcagtcaattgtttcccacttagtgcataacacctggaatcatgcacgatttgtttttttctcactcaacaatactccctccatcccaaaatataaggcacaactaccactaacgcataaacccaatgggatcactccaataaatacaatgcatgcacccaatgggattagagattttaagggtgggtgattttttttttaaaaaaaaagaaataaagaggagagggatgtgctagttaattgcatgcatgcatgcatatgcatgcctaatattatgaaacatcgaaaaaaaggtggttgtgccttatattatgaatggagtgagtagttgataattaagagtgagcaaagctttacttgctattttttttatctgtcagaaagaacggttttgttttagcagaagatctgcatgcttcaccttgcaaccgctattttataaaagccgttcccttcagcaagaatattacatttggtgctcaaggtatcacttattctcatgtctgaaatgtacatttttatgtgcgttgaaaagtggtttaattctaatttcccttgatttagatgtgaaggagttaatctccatgcttgctgacagtcaatgtgactgttcaataatcagcagttacaagctcgacagaactgattctatttgtccttcaagggttcgtgctatgttggcttcgagggcttgccgaatgtctaccatgataggtgatccattgacaaaaactgagatgaagaaggtaaccacagatcaaattgttttttaaggataatttttggagtaaattagctttcgatgaagtaacctccaaatgagctcctataaaagaagtgcaaaccttgtatggtttctgtctattcagaaatttaatgtcatgatttagttgtgatcagtgctcactactccctagaaacaattattcctttatatttaagaacctaactcaatgaagccctcttgcatttgcactccagatacttaagaatctaactcgatggagcatttttcttttgcacttcagatacttaagaatttgacaggattgaggtccccttggaattgccctcatgggaggccaacaatgcgccatctagcagatctccatgctataaaaactgaaggtaagagattgtcggccaacactcatattctctagtttacatgcttgtatatgtctcatctatatctgaagaaaaagagtgaagttttcttgtttcattgcaactccaagtagttcgagtcattatcatctgcaaatgtattgttctaagttctaaacattgtagacaaggttgtatcagatcatcactgttgtaatttcttgacataaacaaaccactcttctattttttcactgaaacaccaagattgaaatgtgtagccaagttcattgtgttacaaaaaccttctagtgtaaaaaaaaccccactaggtttcagaaattacgtcagtcagaagctcacaatcgtttctgtattttttgcgttctattcttttttttttcacaaaaagtggcatgattaatactcttaaggattttagtggcaactcccttgaattatccagtttacagatctcatttcagtgttgcaaaatctcgcaggatcgaaggcaactttctcatgatgtctggcagagtttaggttgggtttatgatggatgctcttgcctttgcgctgctaccattccaaggaaattaggcgctccatggccaacattccttgatgtgtatagatgccagtctctcccacctgtttgagagcctgtgtgacctattcgtgtactaacttacatatgtgatacatacatgacatgcgtgatagtggagaaccttgtttctaagccttcgaaatgggatgcatctccttgcccactagaatccttttgctcggagactaatgccggaagcgaaatactccaacacctttgcaaggatgacgagcaacaaaggtgacatcaggttatcagggaaagctatctggggaaacataaactgatgcatgtgcttacctttattgtgtggttaaaatccagacaagatgtaacttaggtacttgtgttgaaaatgcctcgagtttctgagttgtatgcaacaaagctcttggctgtatttagttgcaggcttgcatttttaacgccttaccttatctataaacagtagacacttgctctcagggtatggattaccctgtgctatttatattatctttttgagcctggaacggctggtagatcatagagaaaatgttgttggaatcagatgccggaaattggctctgctgtccctagatcatacagagagatgagcagactagtcactgctctggttgtttcgtttgctttgcatagaagctactacaatactgtagccgtaagcaacgttgcagtacagctttcctgcgctgaagaaactactagactgtttacatccgtagcataaattctgcagataattttgtctcttgttgagctcactccagcagtctagcttactgatatttgatccaggaattctgtccctgagttgactttagtttatttcaccgttctagaaactggcgataagtataaggccctctttgtttgtttaggattataagccaacttataagtcaaaaagtctaagactaaataaacaagcagcttttttgtttggcttttttaagccataagccactcttacactattaagccaaaagctaggttggagaagcttttttggcttatataagatagatgtatgactccaccactaaacttaggacattaaatttactggcttataaatcatataagccaataaactgacttaaaagtctaagccaataagtctaagcctaaataaagagagcctaagagcctttttggttcccatattacctaataagtcaaaacggtttattatgaaaaaaataaattatagataaaactttatatatttcctcgtaagcaaatgctaaaaggaaattacgttagaaatatcttaaattcaattttaaaaattcaaattctgacttttgtttgacttattacgtcaattgatggggctccagaggtttgagtactagcagtacactgtttttctagctttggatagagaaaccttgagcttcataacagcgtgatgccttttgcagctttcttagcgacatctttacgaagttgcttgattccaatcacaaaaacgatagagccataatgttataaaacctcctaaatttcaaagactacctatttatttatgcaacaattttaatccctcgtaccaaaattttgccctttttttccctctaaaacctcttagtatatttttaaggtaaaatagcatacgggaaataaatattgcttatgtgttcttttgtgttgaataaaatgaaacaataaatgaatgatttgtgaaattattcgaatgtgcaaatgaacgaaatcaactattactaagttaaaaagaatatgttctaaaaaggtttttcaagacctggaaagtttttttatttttaaataggagttcacgaaacatgcatacacactcgtctcaaaaataagtttatttttcactcctcctacacatatcaatataaaacaaaaaaatcaggatacagtcactttctcaaatcccaaaatatagttattactctctttatctattgccaatacattttttacttttacaaactgatacataatgattaaaaaaaacttaatttactacatattggggagcaaaaatgaacttatttaaaaaataacgcattgaaaaaacataaggtgtatatataatctatgggcatgtttagttggtaaaatgaaaattttttggtgtcacatcggacgtttgaccggatgtctgaaggggttttcggacacgaatgaaaacactaatttcataactcgcctggaaaccgtgagacgaatcttttaagcctaattaatccgtcattagcacatgtgggttactgtagcacttatggctaatcatggcctaattaggctcaaaagattcgtctcgcaatttacatgcaaattgtgcaattaatttttctttttatttaatgcttcatatatgtatccaaggatttgatgtgatgtttttttgaaaaattttcggggaactaaacaggccctatatattcatccgttaggtagaaaagacacaggtgaatttctacacagttccaacacgcattaaaagaaaaacaaagaaagaaagaagaaaaaaaccggccattcttgtagtacctctccaagagcttcttcggttcttcctcccgtgtgccacccgcttgccccttcaccgcgccacacgtacactaaccaacaccggccaggatccgacgcgacgcctttggaaactggaatatccccccacccgtaaccgtctcctccccagctccaaccatttctcccgtcctcctcctcctccgccccgacctcgctcgcccgcccgcccgcctccgcctccgccaatggcgacctccacgcgggcgttgctcctcctccccctcctcctcctcttcctcctctcccgctccctctacctccgcgccgatcccggcgccgccgtgtccaggatcgccttcggctcctgcgccaaccagagcgcgccccaggtgctcgacgaaatgcgcccccccttcgccaccctgatctgggatcaatgatctgatgggatttgtgtctgtgtgtgtgtgtgtgtgtgcgtgcagcccgtgtgggaggccgtcgtggggttcgacccgcaggtgttcatctggctcggggacaacgtgtacggcgacaacaagaggccgttccgggtgttcgggagggagaggacggtggggccgtggaggaacgtgccgcggttctacccgtcgacggaggccgagctgcggaggcgctacgagatggccaaggccaagcccgggtacgccaagctcagggagagggctcaggtgagagcttgtgcaagactcgctgccgctctttctttgttttttgttttttttttgctgcattggtaattgcgcgttgaaacctcgagctttgtgtctggtgctcgtgatgacatgtgggatcttgtcaccggtgttttacaaacaagtataggtgctcatttctcccatgagtccacgtccttgatcatacaggcgcaggagaattaatgaatcacttccatgctagaaaggatcataagatccaactgaggatgaatggcaaacaagagtgcttgttcattttgttacttttatcatgtttgggacagtttctgtatcatccaaactgagattttgcgacattgttatcatttccaattttaacagctcctcttttaaaaatttagtggttggaaacactatgtcaatatcatatcattcactaaattttgcaggttattggaacatgggatgatcacgattatggactgaatgatgcaggaaaagagtttggtgggaaggtgacctctcaaaggcttctattagattttctggatgaagctgaagatagttcacggtatgtacttgggaatatttgaactgatttttattttcctaatgttcatttgttatgttgtcatttatttatattattgtattctaaaattgcctttattcttcttattgtgttaaatttctttctttcttttttgtttttttttccacaacatatatgaacatacctgtgtaggttctacggtctgaatacatagttgtaaaccatcagaaatctcatagcgctctctttcttgtttatttaggaggcagcaagctggtgtttatgcctcctacatgtttggccctgaaggaaaacgggtaaaggtaaagttatatcgtgtccaattttttctgccaattttgtttttcttggaaaccccttgttcaagcaagcatccccatgcatgaatgtatcagttctcctttccatatgtggcatgttcccctgttaaccttatgatttgcaaccatgttacatatcaatctcctagatcacactgtgaattctgcacttgccattcttgttctggattacaaagtgccctgtgctgcaacttcttgttaatcagtagtctttggtttgttgtttcagctccttaaatggaattcatagcatcttttaaaatgtggtagtatgtgatatcaaggtttacagcaacttggtactatgtgaatactgaatacagatgtatattgtgtctagttgatatttgttttcctatacatacagatttaatgttgggtgaaactattcagttcaaatccatatagtgacgcaccacaacaaatatataactagtacatgagttgagaagtttcacccatttgcagaactggttgcaggcactgctccattgttactttacatgtattaaaagatagccatacattactataggtaattctgttggacaccagatatcacagagaccctctatcaagtgatggagctgtactgggagatcctcagtggcaatggctggagagggaactgcatggtcctcgatcagagatcaccatcattggatcttcaatacaagtaagatattgtctgccttgtcctaattgaaagagcggatctagaatactggctaaaaaatggatctgccagagaacaatgagtaatcatagtgaatgccataaactaacatcatacataaagaaaactggcaatatgataaaacttgttatcttgtctggggtttgcaaacatagccagctgtccatcttggacaatttcgtggcagatgatagtatcccaattcccagctaaagttatgtatcatttgttacatagataatttttgataaaatcttcgatctatagttgctttcgattgaatagttgtaacaatactatttttcacctctttgtatttatgttttgcctttgattcttcatcttgcatgtgatagaattgtttcaaaataatacaattttcttcctatgcactgcaggtaatatcaaatctatctgccaccactggacctttgttctatgtggagtcatgggcacgctttccaagggaaagagaacgactgttcagactgatcgatagcagtaaggttgcttactttactttcctatgcagacaagctattccttgattctaatctttactgaaaactcagttctcctttacctgtgctaaagtaaaattcattgatttagtagtagctggcgtacttcctgcattatttttagaaacatttttttatcaacaattcacaatatatggcctatgtagaatgcgaaaagaaaaaaaaattctcctggcaagcaggtgcccttttcttgtaatacactgtgaagtttagttaccttttctcttctatatagctgtgttaaatttttttctttttgcgatctatcaatagacaatactccctccgtcccagattataggacggcctcttttcaaggaaaatcaaaatcggtaaattttgactaacaatcatactaaccatatatatgctaagtattatgcatgttatatcactagatttatattttaaagtactttcatgtgatgctaatttcatattatttcatattcgttaggaaaataacatggcataaattaatggtcgaagtatgtcattgaagaccgtgtaaaaaaataggccttgtaatttgggacagagggagtatcatctaaaatggatacttatcttatgcatttgttatttctatggaacatatgttgactttgtgcagagaaatggagtgttttttatcagcggtgatgttcattttggagaaatttctcgttatgactgtggagctcaatatccattgtatgatattacctcaagtggtcttacccaatctgttgagaattccgtgccatcagtatttcaaccacttatgagacttgtggctttgttgacaccaactaccttgcgagtctttagccctaactgtcgttacaaatcatgcacatatggtaagctttcctttcttcgaaacaaataactgaataagtatcaacagggcaaatttacccatgagcataataatgtgtccatctaatgaatttcttctgtatttgatctcacgtgtattactttatcaattggtgttttgctgttgcatttatcaggtcaaccaaactttggagcaatcgaaatagattggaatgcagtgcctccccagattaaactcgaactaagagatgtagagggaaactctgttggtggtgtggagtttcctatatctgaactggatccatcaaaagcacatgccattacaaaacaagggcattcgtaccaacggcattgcgctctcgaaacagagcttccatggctagtgtggcaccgtcttgctctgttgttgtttggtacaattgctggtatgctgtctatatctatctcaaacttttcagacatctcttttcttcatactccctccgtttcaggttataagactttctagcattgcccacatttatatagatgttaatgaatctaggcacacatatatgtctagattcattaacatatatataaatgtgggcaatgctagaaagtcttataatatgaaacggatgaagtacataacaattgctcttgaaatcatccagtttcacggtctatttacgaattatttttgtgagatctagtttgtgttgatatatttcttgttttttttttgttctgtagttcttgtcatagccgtggtgttgctaggaattacctgcttatcagctgctaatattttcaccaagaaatccaagatggaatagccataaggtacagaggacagaagcagacacttcagtctaactacagatggaaaagctgatcacaccgtccatggacgttccagtgcctagaacaaccatgagatttcaataccaatataacccattgcgcagcctgttacgcatcacaagttttatgaatgtaactaacaatctgtatacgtgtatagcatgtttagaaatttctcatgtcaatttcgttgctttatggtgaataggatgactgttgtctattctctgacccctcttacatcattgaagtaggctccgtttgaacatgcatctgtttctgtttgaacattgaagatcattcgttttgtccgtttagaaagacatgaaagagctggtagcctggcatgtcgtccggcttcaaatctcaaatcccatagtgatgtctattatcgtcttctgcgaaagtggagaaccgaaagtgtggaacacgttatcatgtcgtaacagacagaagcagcctttgctcgctgacttgtgctcgtctgcatttggagcacacggattcagtgcccagacagcgagtgctaactggtcagtacgcggcgccaataaggctgtgtttagatataaagtttggatctaaacttcagttcttttccatcacattaatctgtcatacacacataatttttcagtcacatcatcttcaatttcaaccaaaatccaaactttacactgaactaaacacagcctaattcggttcattcgcccgcgacagagcacatcatcaagtcgatgccgtggacacccatcactctccatcagacgacgtgaacaaaccggcgacggcaccacgcacgcgcagggccgtatggcggcgaagatcccggtgatcgacctgcggctcgccggcgaggcgcccggcgaggccgcgcggctgcgcgacgcggcgcggcgcctgggctgcttccgcgtgtcgggccacggcgtgccgcgggagctccaggccggcatgagggccgccgtgcgcgccctgttcgacctccccggcgacgccaagcgccgcaacgccgacgtcatccacggcagcggctacatggcgccgagcgccgccaacccgctgtacgaggcgttcggcctctacgacgccgcgtcccccgccgacgtcgacgccttctgttcctgcctcgacgcgccgccgcacgccaggtaggtaatttccgtcgcagacagtgtagttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccaccactgctgataacaacaacgacttcaccgccggcctgcctccgtcgccgccgactggtgtctccgcctatatggttggttggtcacaccaccgttgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgatttcaccgccggcttgcctccgtcgccgccgagtggtgcctccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcttgcctccgccgccgccgactggtgtttccgcctacacggctggcctttatgccgccgttgttgggcgtctacgtcttcaccgaccggcttgccttcaccgctgccgactggtgtttccgcctgcacggctggcctattatgctgccgttgttgggcgtctacgtcttcaccgaccggcttgccttcgccgccgccgactggtgtccacacctgcacggctggcctattatgccgccgctgttgggcgcctacgtctacaccgccggcctgcctccgtcgccgccgactggtgtcatcgcctatacggttggtcggtcacaccaccgttcatgggcgtccatgtcttcaccgaccggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactataccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcctgaatttttctcgagtattatatttacatcagatactactcatcctatatgtttgttctgcaggatccaaatccagatatgcataaaagggattcatggctttaagcttatctcttacgctccaggaatggatcagtcagaacatcaccaccggctcgccgtcgtcgccgccgactggtgtcttcgcctatacggttggttggtcacaacaccgttgtcaggcgtctacattttcaccgaccggccgccacgtccgccaccgactggtgtttccgcctgcacgctggcctattatgccaccgttgttgggcgtctacgactccaccaccggcctgcctccatcgccgccgactggtgtttccgcctgcacgctggcctattatgccaccgttgatgggcgtctacgactccaccaccggcctgcctccatcgccgccgactggtgtttccgcctgcacgctggcctattatgccaccgttgatgggcgtctacgtcttcaccgaccggcttgccttcgccgccgccgactggtgtcttcgcctgcacggctggcctattatgccgccgctgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgtgcgcctacgtcttcaccgaccggcttgccttcgctgccgccgactggtgtcctcgcctgcacggctggcctattatgccgccgttgttgggcgcctacgtcttcaccgaccggcttgccttcgccgccgccgactggtgtttccgcctgcacggctggcctttatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtgaacctcgacatctcggcatgcaatgccatgatattttactacaaccagtgactctccaatattcaggatttctacttggacaccttcagcacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccaactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcatatcagaagctattcatatgagctacacttggtctatattacccggaagatttattactcgggagtatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttggatttttaagcaattgattagatacaatatcattgcttttcgccacgtaagtgtgcatttttattgaccaatattatggcttaggctgattatatattatggtcatttttcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcattcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagtagtgtagtgcgcgctcgctggtccatcactctgatcgatcgttcgatctgttgcagggaggccatcaggagctacgccgagaaggcgcacgagctggtcgtggacgtcgcggcgaagctggccacgagcctcggcctggactgctcgttcggcgactggccgtgccaattccgtatcaacaggtacaactacacgccggacaccgtggggaagaccggcgtgcaggtccacacggactccggcttcctcaccgtgctccaggaggacgaccgcgttggcggcctcgaggtcgccgacccggacaccggcgagttcgcgcccgtcgaccccctccccggcacgttcctcgtcaacctcggcgacgtcgccacggtatgtatgacaaattccgatgccgctgtgccgaactctacttgtatagtactacctccatcccagaatatagcaacgtatctggacatgactaatgtctaaatacgttgttttaggatgggtctcatctcatcctagattgatatattctgtgacggagggagtatatgatctttgtctggtttcgcgtacgtgttgtgagtttggcgcgcgggtgcaggcgtggagcaacggggagctgcacaacgtgaggcaccgcgttcggtgcgtggcgggggtgcagcgcgtctccatcgcgctcttcctgctggcgcccaaggacgacgtggtgcgcgcgccggaggcgttcgtgagcgccgagcggccgcgccggttcagggatttcggctacgacgactaccggcggctcaggcagtccaccggggagcacgccggcgaagccctcgcgcgattagccgcatgatgcagtaataatcacctttaccacggtgtgtaccatcatgcagtcacatacgggagtactacaattgagaggtttacttacagtatatgttcaaacgggagcgggtgtttactttgtttgatgcactgcatcaattaaaatattaaaatatacttgcattacaaaagttaatttgttgattaataatacatgaacaatacttaaagttaatcataatttggctctgtttttgtccatttgagcctctgacttactcaattgatgagtagtagtgagcgaagtaactcatctgagcaaacagaatccagttaaacggttgatcatggaaaattttgcttagtaactagaagtaagaaaaaaaagagagttggcgaggagggtaggttacattgggacctcctctatatgaaaagacctagccgaccataggctcgaccggagaccgtggtatacgtcgaggacaagagcgcaaacgaacttaatcgccgacgacctgaacagacatcacggtgtgtaccatcacggtgggcgcgcaccatgcctaaacactgtcactcgccaactctcctgccctccaattcaaccgtcgttggacaagcctgcgctaccgggggatggccgcggctttatcgggcgcgcattccgcgccggaaaccgatgtggggactaaactctggcagtggcgcactccgagatgacggtgggcggatcgatgataatcagcagcttgcctactccctccgtccaaaaaaaaaagacaaatcctggatttccgtgccaacgtttgactgtccgtcttatataattttttttataattagtattttcattgttgttagatgataaaacatgattaatactttatacgtgacttatctttttaatttttttcataatttttctaaataagatggacgttaaaacgttggacacggaaactagtgtttatctttttttttttttgaacggagagagtacttgcgatcgagtcgtcttctattccgaactgagatgtctcccactgcccccacacattgtgattgatgtgtcgtggtgtggtacggtgtggctgctactacagtggagatcaatttgcttttcatctttttaatcgaatggattatttgaattttcaaattttgcatatgctgtcttagctcttaacgcctgacaatttctaagttgacagggatccggaattttacatttgatgcattattggtctaatatactactccggagtatatgctgtgtcgtcacatacgaacgacaaactgtgatacgcgcatgcatcgaagtgatgaagcactgcaagctgcatgcggcttagtacacacacgaatgcttagcaacatgcatgcttgctctgttcctccgaatgtcgtttcatggtgaggcatagtgcttaactgaagcactgcgaaccgcatgcctgttagcacaattcataatcatcacgaaacttgtggatgtgggtatgtttaattaggaactacttgcttcgttttaatcattttagcattgccaaaaacggaaagacaatatatagaaacagaggaagtagctggtatcaaaaacaatatatagaggttcagaagaacaaatgaagaaaagagttggcatcttgggccatactccagtgcaacagcacccaattcaactgtcgttgggttagatttgtccagctggcacctatagagaaacaaaataacaaaagaggcaaggtgtggtttagagaaataacaaaaagagttggtagtgggggtttaagtgggcgaacccatgcaccacgaagaaggctttgcagcagggtggcgaagcgtaggctcatctcgtgcatcggacagagactctgtcctttgccatgagtcccgggggggaaccccggctccgtggaaatccaaagctgcacaactatcgggcctgggcttgaggtagagagccccaacccaattaacccgccagcctatacaggccgaccagcctggaccaaatacgccaagtcccctactccgaaagccccaatctcctctaccggctcgacgcaccgacctaacaccgacccaactccagctggctggtaaatttctctcgcggggggccttctctcttggcccgcgaccccatcagtgagtgagtacccattttctcttatgggcctctttttcaacgaccggcctgcaacacagcaggtgacctcggtccaacaagagcgcgagcgcccccacgccttttcttcccatgcaactatctgacggcggcggcctggcgacttccccccttccagggcacgccggcgcgcgtccgatttagggagggagagtttcgtttcggcgacctcgaccccggcgatttgccatgggctcgagcccacaaaccccaacaaccaactctttagccctccgaaagctggagtaacaggcacgcgcgaccgagcccggctggtggagatggtgggaagcgcgtatttaagctggtcttggcgtcgttcggcaagcggtatggtactaatcgagggaatagtgcttgtagaggacatcggtagtgagaagtgggtgcttgagctgacttgaaagcccatcttacatgggcctcttccttctctgtttttgtctcagggaaacatccgagatctgcagctgggcaggccggcacggagcccgcctctgggtgtccacgaatccgctgaatccccctggtgttggaacagcgaagcttctcgttagcctcacggcctcacctcaccatcgtcaacttcaccgagaagcttatgcaaacagccaaacagtcttttgcttccctgaccagtgaaagtcttgtgtgactgacaatcatgttccatttgatcatttgatgcattcttctcataactctgattaagttaattggtgtggtttctcatggtactggagttgcacaaggtaagcacttgagtaggcgtaatgatgggcggaaaactgatcgtactaaaaattgtgcgctctcccgggctaaatactacaaataccctcatcttttcgtttatatttatacttataagtcaaaatttaaatatttcacattaaatttgaagctaattttgagggtttttttatcaaagtttatttttcagcctttacttttattactaagaacacataaattattatcgatgggcgcgtaagttgattaattgaagtagaaatctctagcctgtctccgaggtagcagtcacccagtagctccgtcacgctgcctgttagcttgcggttcaatatgcgttgtgattacaacaggcaaaacattgagcaatccatttgtatacatcttacaaagacggtgagattagcacggcattaccctgcggataaggattgaatatggagtaccgaggtagcatgtaaatggcatggctgttgtgcgttgtgccagggctcattgccatcacgtgttcatgcttcacacgtaaagtacatacagacgttgtaattagatttgaagatgtgtttattgacaaggtattggcaaaacggccgcagaacaccaatgtctaggtcggcttgaccaactatgaacaatgttgaaaataaccaatcatggcaccctacgccagggcaagaaccatagccacactcatcaatcttcaactcgcaattgcagcatagggcagctagtagttcggaatgagaatggacaattgccgaatggccacgagaagttagaatccggcccaccctgatggttgctccactttcttcgctgctcctgagctgaatctctgggaggaactcccctgagcagtgggcctgttgatctgagcggcagtactccctggtgatgtcctgaaactatctggcccgaaaccccaaccatctggtgattgtcttgagtttgcgttccttgccaggttttgcgctccattggtagaatgatcaacctttggtctgacctgagcaggttgagatttggggtcagggaatgcctgccatgttttggcttcagagctaggtaatgagtttgcgagcattccttgctcaagctcccacaccgttccttcaatcttctccttacgctacatatgaatgcaagtctcaggtaagattctaacagaattaagaaataggttaaatacgttgtaccagatatacaaacggagcacgaacctgtggcccggagtctggtaatcttgagctgactttgcttgatggaggtgtagtctcggcaagagtgcgcttgagctcttgaatctcctggcgctgggagcggcatattgcagacaacttttcaaacttggctgtcatctcggccttctctgatgatgttttcttcaactgctccttcagattggacacttctgcttcaagctcagattccttactagcaacattggtcccagaatggagattgtttgcttcaaaatcagcgacaaagctgttgaagggatccttctctgattttggttgtgattctttagttttcaaagaactttgtgactccatgaacagatttgtgttagcaccacttgcaagcccattgtttgatacagagttacttggtgtaccccggacagcctggccagaacgaccatgtctatctccaggggcactgatgctgatatcccctctgctttggttatgctttgatgaaggtgatggttttattggttcctcatcaaacaaagagttcctattatctgcaacttgagaaccctgtgcatgctgtgttgcccaaaatgcacctagaggtgcatctcctgcctttgagcttccatgagataacgaactattggattgttctattggaggaggaggcgggttccttctaggcatcacatgtgttcttttataagcacctatacaagaaaaaaacaagacaaggctccaattatgcaaacaaattattgcaatcttacatgatttggtggcttctgtctgaattgacaatagcaaaataatgcagtaagcctacctcagccaacaatcacactatcttttagaaaatatttagaactaacaatcagactagaacagtaaatgtttattctagcatgcagtgcacatcatgatggcatggcacaaaggctgtatatcctagaggacaagaaggtaggtcatgacagaaaggttgcttagcctataggacaagaaaataggtcaatgacaaatgcagtgaagcaatgcccataatcataacatccaaacaaatcatagaggatgccaaaagctccctgatgagaaaaagatatacgagtgcataagaaataccaaaaaatatgtttatttgaagatggcccacatacatttgaagcaaccccacatgaataatgaagtgcattctagtgccaatagcatgtctttcagcataccttcatcttgcaaactcatggaaatgcctgacgaagctccatcgggtagatttttctgtaactcgagaggtagtagttcatttacacgaaaccagacctgtcaaatgtacaaagtctaacatcagatttagaaaaatatgcttatgtggttcctaaggctacatgcaacagtctatgactaacctagtatcatggagatgaatggccaatcaatcaaagctcttgcctgcgtgacatcaggtctgtcatttggagaggcttccagcatatctttgatcaactttgtgacagcggcactatacttgggttgctctggaatacgataattgccatgaagtatctgcaacttggactctccatcaaatgcagacttgaagtagcatattctatatagaaggcaccccaaggcctgccaaatgtcaattcaaaaaaattttataaacaaattcaccttggtttgaatataatgcattgcaggatgaatatatagatttcaaaaattaagaacagtgtgattcaccaagatgtatctaaatgctaagtagatatgccagcataataattaaagtggatatagcatataatagtacttgctgtgaatataattacacttacccagatatcgactttctcactaataacttctcttctgtaaagatcccacatctggaaaatgcatccatggggtcactgggggttacacaggttttaaaaactataaattactccatgggcaattgtttctttacctcaggggccctatatgctggggttgtatgcttccggatgatatcttcctcaatccccatctcttctggcctatcaaagcatttatggtttgttgatgtgcttccaaaatcgcacaatttccatgcaccgtctaatccaagaagaacattttcagctttcagatccctaaagaatcagaaaagaggcagaatgtaagatgcatgtaggtgataaacaataaagcgattgctataaaaccaggtccctcatttacacctaatctggaataaccctaactgattatttgtttgcatatgcccagccttgagaaaatagacaagctacaaggtgcaggagttccgcacttcacaacagaacataaatttagtacatacacagtttgctaatataccagcaattgcttagtgaattcaagtaatctaatcaaacagtaaaacagaacagcataactactgcaggaacgtactttcaaatacttgataaaagcacataaaacgttctagcaacgatgagatataactatctttgatactttaattttttttttcaacatacctatgtgcaattggtggtgactgaccatgcatagcaaaaactgcattgcatacatctctgagaatcaaaagtgccttcttctcctcataataaccagtacctctgctctccattgcgctaaccaaggacttctcacagaactccataacaagtagtgcctcctttgtgcggcccatatcaaaaacatcatgggcaactagtgtaaccacattaggatgccctttgaggaggttcatcacctggatctcctccattacaagatcaagcaattctgagtcgttgcagatgatgtgcttcattgcgtactgctttgatggatgcattgcgtcggatgccagatatacacaagagaaacctccttgtgcaatagcattgcgtactgtaatcttaatgttgccaacatcaatggtgcgaccttccaatccattttgtactttccccccgaagggattgaacctccacattatttttttttccgcgtgcccctacgaatataaatgaaaatccactgtttaatttttgtcagtgcgctcttacaaatatttctgtgtagataaaaagaaagagtgaagctccaatatgcagtaagtaaaactgtaattgtaaaagtatagcactatatctgtgtactacaagattaaaagaaatactagctgctcaaacaaggttatcaagctccatcacctaggccctaatacaattaccgtttaggatttttactaatctgaagatttaacatagcaactgcacatggcacacccagcagttaaggataaccacatttgacaaaggtaagaaaataagaagtaataagccatgtcatgcaatgagctgaaattttactttcggcctgtctgaattggataacatagtattaagctaggaccagcaaacaaaacgtaaattctttgttaaaaagaggagaacccatattctctgtaactaattaattatttaagggtaatccaagtatccaagtgaaccaaaatgggtgtgactagtcacccacaggtaaacccgattgctggcacagttctccactaagatatctgatataagcaatggcgttgctgtgaggcactaactccgcagaaatcacagaatccataagaccgtgtattctaaactggttaatcctaagcagagcggatgctatgaacacatctccagtacgatcagcctcatataagatcatctcgtcgaaaccgctgtgcatcctcgataaacaccagaagtaaagggaattcgtggtgcctttcagccagatttcaaccaagcatctaaaataaccaccaaacaaaacaaccaactaaatacgctcccgtgccacacacccccgcgcgcgcagatcgctgcgatcccattcccacgcacgatccaatccaatccaatccaaccatccctccccatgccaaatgcagatccgagcgccccgcccggtgaaaccgaacctacccacgcgggcgggccgcggcgtcgcgttccccagcgaaacgcgaatcgcgcggaagagcttggccaggccaggcgaaggcttacgcggcgcgcacctattagatcgaaggctcctccgtactcctctggggctcgcgtcctcgccgccgccgccgcccgcgggcggattcgcagcgcgatctgcggtggtggaggaggaggttgctgggggtgcgcctgcgttgtgatgcgacgcccgtggaggtggaggtggaggcaggcgagggagggagggaaaaaggaatggacgaggggcgagacgtggtgatggatggagtggtggaggtggaggtggtggaaccgtggcgtggggagctttgcagttgcagccttgcagggggtgtggccgggtgtgggggccacgcaagggggtgtgggctaaaatattttccttcttttttgcgcctttttgttttcgtttttttttttttgctcgcgtcgccttcttattggcagcctcagcaatcaaagaaaggtgttgtaaaattccaaatcagcatcatcccaacttgacaggttattagagcaaagttaataatacagctgacttgttgtatgtaagattctttatagtcttctctcagcccacccatataatagttagctctttataattaatatttcatccgtttcacaatgtaagttacaattaatgaatctagacagatatatatgtctagattcattaacatcaatatgaatatggaaaatgttagaatgacttacattgtgaaacgaaggtagtacatggttaatttgtcttctctcctctttctctgctctacctcggtatttagttggcttacaacctcctattatactttctcttagtagttccaaaatgcatggtgcattctcttttttttattttagatgaagaaatttcagaaggattgcaagtcacaaaatcgtaattttaattcaaaacaagaaaatcaattagtataacacaagcctgaaggcagagataacacttgcattttcgaatatggatgcaagaatctataaaaccattgtgttgtctagtggcttataagttgcatatagtcattttatttctaaaactagaaagaagaatctctaaaattagcggccattcattataccagttatgtttggatcacatcaaaccgaagcggaagatccattagtgtagcatcgcctctacaatgaataaccatacatcatctatatgccattttgaagactagttgttgtttgattcatagccttagtttgccataacattagcacgcaggtttaatcaacttagcccaacgtttggtttgtttacacttttcatgtgtcataacattcaacttagggtcctcgcttgtgtactattcatagccaaagtttgcatagctaatagttccttagccacaaaagttgtggcgtgccgtatcttagctcaaaatatttggcaaaataatacatgcaaccaaagagctcaacacaccgatcagttctgcaggaccatcatttgccttttgacttatcaattgcatacaaaaattgaattgtgaaactaaattttagagttgatttgtaagtttttttaatcgtagttttattctggctttcaagtcgttaagaacatggatatatataagtatattcattatttttttctattaataatccattttatggcttactagctgtagacaaggtttgctaaaccgtccttatttgtgagggtatgttaagagttattggaagtagggtttggtaaattttgttcggatccaaattatgaaaaaaggataaattctcctaaaatttataggatcaatacatgatttgcaatgatatctggtgacaaaactttataaaaataaagctaattctatattttggcatgactaaaaggcaacattggtccaaaatcgatgtttgatgctcgtgaatgttatatgtgaatgctataatcatcatagttgtagacattatatatttctattgtcaaacgtggttttttcccgtgattttctttttatttaagtcaaaagagcatgtttaccacgccttatcgtgctgcgattgccacgacataaccacagtaatcgcgatattgtcataagatttaaattttgatatttaaattttagaagataaaattcacatggtctttagcggtaaccaaacggttaccgtgataaccgtcttattgtggggtaacggtaatctcccatagatcatatgagaaacttggttgtaggttaaacgattaaacttgcgttgaaaattgacgatgatcgaactctcgttaacaaccttctaaacttgattttaagtttgaaaggcttgaacacaagtgcaacattctcaatttcttatattcgaaatcctggcaatcccttttaaaatcttgggagcacttgtttctttgccactacttgcggttgaccggtactttcacgttcgaaacctcaaccaaatcatggtggtgcacggttttcgggtttggtagcatgttgttatcgggtaccacagggtgccccatcgcaaatcgagaatgaaacagagccacagacaaacacagaggtgcgaagcttcgtgaaaaaggcaacgcgtcggtgcgatgctgcagtgcagtttgcctttgtgcttgtccagatccgacaaaatttttcgctctgtcagatcaaatattaaatataaaaaaataactaattacatccgtggataaattgtgagacgaatcttttaaacctaattgctctattattatttgacaatatggtgctactgtaaacatttcctaataacgaattaatcaggcttaataaattcgtttcgcagtttacaaacataatttgtaattttatttgttattaatttatatttaatactttaaatatgtgtctgtatatatgatgtgacgtaccaaaactttacacccataaatctaaacgccccctctggtgacagatcgaaacgttggggctatatctgtcacagacaaattcggtgttactacagcggtgcatgtatcgtacatttgtacgtgtaattcaagcactttggacggatggaccaatcactgatcaatcgatcatgtgacttctccggctcaagaggtgacagcaaaacaacatgggcttaacagatttaaatatcaacctaacatgcccttacacccgcagtgagcagtgaagatcttcaactagatttaaccatttataaataagaaagcataagtatagcttaagaaatgctcaaaataaaaaatagttttcaaacaattgtaatagctattttattcaatgttagattaagggttgggaaaagaatatttatagtttaaggttacctaagagatgatttttaaggaggtaaaaaatatcaagctaacaatttttaaagaaaaagtattaactacagcaaaataaaccaattcggagagaaagtactctctccgttttactcagtgtcatattatttcttagtcaaaattctttacattcattcaatcaaatttatagaaaaactagcttacattcattcaatcaaatttatagaaaaaatagctaacatctactctattcttacacacaagattggctttatgggcatcgagaaatgcaaatatgtagattggctttatgggcatcgagaaatgcaaatatgtagaattaattattcttgatctgtagatgaaatatgactataagaaatagatgaagagagtacgtcattctagcattttctctaatattaatgaatataaacatataaatctctttaaattcattaacatcaatactctttaaattcattaacatcaatacaaatgtaatacgaatataaaaaatgctaaaataactcacattaaatcgaagtactacaatttaattttattttatattaaacatattttaatacaatatttgtttttattataaatattactataatttattacaaatcaaatttgaatttttttaaaaagagttctatttaattaactatagctaaatttagatttggtattttgtgggtagggaggcccacacaggcaagtcctgcaaaagtaagcagtgtcaatacccgcgcgagcctcttcccctcgcaaaaattgccgtgcagggtttgagtcccgcaccgcgagcggctctcaccgcaacgctttgttttccttactcattagtttaaggcaagttttttcgttgcacctcacccaccttatatagcaccagccgcaccccgcatctcctccggccagcgaggtgggattattcaccacattccccctctcgttcgttgcgctgtgtcgaccatatatgggccgtggtggcccattgacctgagagggttggagcccagccgtaaaatgtgggccgcactgcgtcggcccataactagatgcgaacatgggctaggcccacttaattcaggtctctgaccttaaaccctccgctcgcctcctccgcgaagcatatacacccccattctcttcctcgcgccgccgccgccgaagcagctgcgaccgccgccgccgcgattcgagccccagccatggcgaagaagcggaagcgctcctccgatgcggcggccgcggtggagaagcccgacgagttcgcgccgcagcgcccggagcgcaccctcttcggcttcaaggagaagcccgcggacgacgaggaagccgaggccgaggccgcctctgagggagaagaggatgccgccgccgccgccgccgcggcgccgttccgcaacaaggagaaggtgctcgtgacctgctcccgccgaatcaactaccggtgagtggcgccgcaccgcgcgctcgtttttttttcgttcggtgtgatgtggcggcggatagatcgattgatgtgtggatgtgttgtttttgtggggggattggggtggtgggttttgctcgtaggtatcggcatctgatgcagaacgtggtgtcgctgctgccgcacgccaagaaggacagcaaggtcgagtcgaagcagagcaagggcaatgcgctcaacgagctgctcgagctcaggaactgctccagctgcctcttcttcgaggtatatatttacacatatactgctacgatctcaagttgcttcaggcctcatctttgatgcgctgatggttgcgtgcttgataggagaagcatgcaataggattatcactagctgttgaatcgttctatacttctgttcttaacatgcattaagctagtgatttgtagttctagcgctaaaacaatttcactctttagtaattctatatttcttttctgctgcggagattactgagctactacttcactatgataataaagcttggagcttcaaattctctgttcagtttagaccttagtattgcaattctgatggtggaacttcttctatatgtatactacagtgcagaaaacagaaggatctttacctttggatggttaagtcccctggaggaccatcagtgaaatttctagttaatgctggtaagtatgtcaagtatttgtgagctgtaatctgtacaagattatggacattattccatcagtgcctaaatgtccagtaatgtttacatgcagttcacaccatggaggagttgaagcttacagggaaccatctgaaagggtcacggcctcttataacattttctacaaattttgatgaacaacctcactggcagcttgtgaaagaaatgctaacccaggtgcatgactgatttgatatgttattttgctctacatgcattcttatcaatgaacaagttgatcatgcactagactaaataactaatctttatcaacttattgtgactttagtcttggttttttgcctggtaacagcgttcaaacttgagtagttgaattaaatacatgttttttgataatgtcttattgtacttgtagaacccagtttgtgaattcaattcacaagtattgagagtgttctgttgtttatggactagcctgtaggtatctgctgtactgtctacatgaaacactttacatccatttttgacatgttgataactttgattaagaaagtgtaatccttttaaaaatctggttctagacttcacaattttttagtactttccatcatacacctttttcttaatgctgtcagttttcagaattaatatttggtcatgatgccaatatgaatgttgttttagctttcacatgttatgaactttatggagaactgggggaatgcaatccgtgatgaagttatacatgcttcttttctagtaaagcagttgagaaacaaacttgccctaaaaaacataagaaactaactattatttgctctgcagatatttgctactccaaaagatcatcgaaaggcaaagccttttcatgaccatgtgtttgtcttctctatcgttgatgaccatgtttggtttagaaattatcaggtaatatattagtctgtttgttttcttaattttcattaactcctgccagttacaagcaatagaagttcctagcattgtctgaatattaccgtatgatcaactttgtcagatttctgttccccacaatgagattgacaaggttgataaaggaggtctggacaagatgacacttgttgaggtaaaggcgcatagcttctatttgtataatatttttttatgtttccaagtttagtttcagttttgagatcgaacttgctgtgtaggttggcccaaggttctgtttgaacccaatcaaaatatttggcggtagtttcggtggccctacattgtacgagaatccattctatgtgtctcccaatcaggtatcccttttttaccaccaattgattgctgtgtatgtacaatacatatttctgagcatcttaggtgagcacctgaaaatgttaaagcaatctaggtttgtttgttctggtcatgcttacgctttcttttgtgtatcattaaatggaccaacaaaagtttttgctgttgtgtttgctctgttcattgattcgtctaagcattgtgattttgattcaactataacaaatcatttaccctcatgttgcacgactgcacgtgtagttcatatgtttattttgttatcttcgtcagatccgtgcactagagaagcggaagaaggccggcaagtatgccaagaaggtcaaggctaaggtgaggaggaagatgcacgagatggagaacactctggagcctgatgaatttgctgaactttggaaaggggaggactagttcagctatagtgattgaaccatcaacccccgttaaactagttgctctcgctgtcacccgacacgagttttgtttactatatctcgtggaatttcttgtatgacaccatgagtctattatttacatgaataagattttagtgtcctatcctaactccatctcgtctcgtgcttaaaagtataattcgcattagtagacttatatgtgcttattgcttgttacgtttttttgttaccactgttttaccatgtttttggcacaatacaatttgaagggcctgtttgggggagcttaaaattctgagaagcagctgtcagcttctggcttcttagttcatttttcagaatttgtaactatagattctcagaagctatggattgtttggggcagcttttggaaaaagctacagctgggacaagctccactaaacagggccaaaaacgaggacccgatgtgagcaagcttataggaaggggaaaaaagagtcactttccatcgtttggcgctctgctcataagtcagttctaaagtttaaattttaaaacttaattttgaagttgattataggtttattttttatgttggtttttaaactgcaataacacaaacataaagtttaccaacaaatcttttttcttctgttgcttatatgtcgttttatgccctatcagacaagatcatgcaaccgaaagtaagtaccaaggatagccgtgaggtaatcaaaaaagatttgaaattactttttgtcaaaataacgagggggaaaacatctacccgtaaaaatctgtctagagcaaacgcttcgctcttattatgggctgtgaacttagcaaaacaaaacggacggattagtttcatgtgcgtccctgatatatgtctgagtttcatttgcatccctcaatcatataataaaaacgtttattttacattagttttacgagttggagtatactctatatctggttttgcatccctcaaccgtaaaccaaatatagattacgtccattttgtacttagttttacaagttggaggcatacccagttttgcggttaagggtcaagcaatcaatactttttgagggatgttaagtggactttttttccacggccgaaacataccgcgtgcatacgtgctgcgttaaacgagcccaagaccaaaatccaggagagcccaagaagctagggtttccgcctccacgccgccgcacgtatataaacctgcgaccaaaccctcccctccattctccttcccaccccaccgccgcctccaccctctctctcgcgccgcagcgaagcgcctcccgcagcaatggcgccgacgtcgaagctgtcgcagggcatcaagcgcgcgtcgcggtcgcacacctaccaccgccgcgggctctgggccatcaaggccaagaacggcggcaccttccccaaggccggcaagcccgccgccgccgccgagcccaagttctaccccgccgacgacgtcaagccccgcgcccccagcacccgcaaggccaaccctaccaagctcaggtctcagccatgcgaccaactatcggctgctcgtgatctatggatcggtgttcctgagtgatttttatctgtttgtttgtttgtttgcgtgatgcaggtcgaccatcacgccggggacggtgctgatcctgctcgccgggaggtacatggggaagcgcgtcgtgttcctcaagcagctcaagtccggcctgctcctcatcaccggtaaaccccttcccgcctctccccgtgcctgtgatactgcgatgattgattttggcttgtggctgtgccatctgggaagcttgtagtgtgcggatctatgaattgattttgtatagttgcacttcgtttgttatttagttcgggaattgtgaaatcagtacctgtagcttatgtcgatttatatctgatgcaaatgtgagatttattacccaatttataatcgagtgttcatttccctaatagatactgtattattcatatccatgcgattgagtcatgttaattgttagtagtaacaactgtattattaagaaataaaaccaaataactcaaaaaaaatgtagggctaaaactactaaacttttgatgttactatgttctctaaaccgcaattttagtgcctactctgaattgctcataagagctggtctttcaaacaagcagggacaatcaatccatcatagttattttggcaaatattgttttgttaggaatcttttgcctcattgatatagattgagctgaaatttgcatctgtaatacaaagatgtaaaatggattgtgctgttttttgtaatggaaattccatataacatgcacactgaatgcaaaaagggaattgtatatttttgccactcaccctctggcatattttgatgtttttagtagaatgtaatagtctcactttgttttaatcaagttaatttcattttgatgggatctgacctaagccaggaaattggttaagctctgattacaatcaatgaattggttgggttcagatttttacaatcaaagcactggattttggcctaaattcttattgttctccttcaggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggtatgtcttgattctgtatggcattcctccatggccagttaccggtttagctccaatgctaactcacctgcctattctctgttgaatcttataggcaaccaagaatctgcccgacttcaagaaggatgaccagaaggctgtggatgctgagttgatcaaggctatcgaggttgtcccagacctgaaatcctatcttggtgcccggttctctctcagggacggcgacaagccccatgagatgacattctaagttagtcggtacaagtttcaagttctgaggaagtctttttgcctagtgtgtttctgtacttctgaattttgtacccgggtagtgaactctccatttctgttgaagtctgcctgtcaaatattatgagaagattaagagaaggattatctactttggtggttcatggttaccgtacctactcaaatgtgcaatgcataacatttgagccataattaagctattgcgttgcaagttgtgtactggtgtctatttgattttttttttgcttgtttccgcgaggttaacttatttaactttcagtgcttgatgcatgccacttaggccggtgcaatgctgacgagttgcccttaacgtttcggttgtttacaatttgtttcaacttgtttacggatatattgatttaaacaaaaaagcatgtatgagtttgatttgcagcattagtgtatagacaagatgatctgataaaagaagggcgattgctgtggttgcaaacagtaatagcagatggccgatttcgcaacaaaacaaggtaatagcggattagtaacatatcagcgtgctcggccagattttggacatccctatggagtgtgggtgtcggtaggagtacgaggtttatagattcaagtatgcaaacgatagtgaaggtatgatctaataagagtgattgctccgtctcctcccgtaaaaaaaaaacaacttataactgaatatgattgtaacataatacaacaaatcgtaacatttataatcgtatatttgtctttttcgggatagagagtaatgaagatataagtggtattgaggtggtatataaaacggagacagggaatggtggaagtagtgatggttggttgtatgttttacatgaggaaagggaaatgagtatcattcaattctatatttgtcttttttgggatagagtgagtaatgacgatatcagtggcattgaggtggtatataagacgaactaagaaagggtcgccaccgcgggaacgtgaacggttagatcgaccctactgcgagatcgaacggacaatattggtgagaaccaatatgttattaataaaaacttagggttttttttaaaaaatgctgacgtggcacggtaaattctcagtgatcccatggcatgtagagaggttaatatgtggaagggcatggggaaggggcgaagtagtgatggatagctgtatgttttatatgagggaagtgagattagggagaacggattgatgagtgcatacaacgatagatacatattgttgaatctcaatagaatggacaaaaatgatttaaaaaatatgctaatagcaataatacatagtcatattttggcgcgaaaactcaaaactatggtacaatcatatttaatatatattagtgacgatgtgagtggcagtgaggtgcatatatgtgataaatgagttaaaggtgataaggcacatggataaaaggggttcttattgtatcttgtaactgtttatgattaggtgaggtgatacttgttgtgtatgggaaggatggagaatcggaggcggtggttgttcatttccagtatgttttactcaagaaataggagcgtgggagaacggatcaataagtcgatgtaatcataaataaaataccattgaatctcaatagagtgacaagtcaattttaaaatatgctaataacaataataccttgtctctttttatttgttatgtgttattttggcgcaaaaacacctaacaacggtaacatcatgtttacaatacattttttccaattaaaacgggagaatatttattctttgtttctcttttctatcccgctatttggaacaacgatcactgtgactaaactacattctctattttaagattacctctacattagttttccttttcgtttttgttcaggtatatttaattgatggcaaatactattagtgcaccatagttgatgcagaaactaggactttgcattttgcttatctaaattaataattaaaaataaaaacctgaaattgatataatattgtaaataccgctctacagtccatccatacattatatatttttcaaatccttttcttttgtttcccaatttttgtgttgctgggttttttgctttcctcccttccaaaattcaaacgaagccctaggctccaaacagccctaggctttccgcattgcggcgcggcctcagcggcggccggcggcgtgggctccggcggctcgagctccggcagcgccggcggcggacggcttccttttggtcttgcgcgcgtaggttggattggatgtttttttgctgcctccgtttcgatgatttttgttttttttttggtttgctccatttccatttacagccatttcttcgccgcaggaaatcgaagccttcgtttgacgattccttcccaaagctaagcccctaccaaatggagaagttcctcgtggcggcgcctccaccttccggcgatgctccggcggcaccggttcctccgaggtgctccccccttccccgatctcagtacacccgttactgaactggattgcgttttttttttcgcttctctgaccttatctcgatccgcagacggcaccggtggagccgcgtcgccgccgagctggacggccgcatcgacgctaggtttcggcaccgggagtccgttcgcctgcgcgattcgttctccgaggtgacagaaatctcggaaaagagcatttgctttgtttccgtgttggttattacgaagttgttttcactactgggattactgcatatgagttagacactggaactggaattctctagagcggctaacgacatatttacttttttgtttctttttagtaatgctaatcataggttgtagattccaatagcaaagctgctcccttatgtttcttctgttgcaataagctggtagaagtgctagaacttgcgaagtagcacttataggatgtcattggtcgccctgatctctttccggttgctcaatgttctttcctgagctggtggtcaggcatcaggaaaggggtccctaacagcttaggcgcgggttcgataccgtcgtcgtgctcgctgcctagtccatctggaaggaaaggaacaacagggtgttctatcagcagcagcactcgtggccggacgtagctagggcagcggcagaggaggctgccttgtggagatcggcaggtctgctcccggagttgacaatcagcattagggtcgcaaaatttatgccgggacatatcacctttgtaaccttctctttgtttcttttttctgtccgggttggtttgtaagttgttgactttattccctaatcgtaatacaaagatgcgcaaatattttgcgcattctcgaaaaaacaaagctatggccctttttgatttagtagatcaagagtttgtgtcaatgtcctccaaggttcaaattggtgcttatggctctatgctcgctgctggagatgtggaaaatattgtttaagagaccatctcaactcgtgtacaattctatagatgtaatatgaatcagccagtagcataaaggtataacttgaaatagagcttatgacatgtactttattaactatcctagcacagtatctttctttgagaatggcagaaccgtgtatgccatcatagcagggttttagttttgaattctgcaggacaacaaggagggtggttttagttgttactatgccagttttccagttctttttttttaaggaaaaccattttcatgttttattgcaacatattttattggattttgattaatttatttatttttatgttgggaagataaggaccttcagtcacaattactacatggaaggccaggagcgatgtacaacatatgtaatgctcatcctgtgcttttttaaaaatcttttttagtgtgcctctcccctaccttatttctaccgacaaggctcattatgtaccttgtaatgttgaatccctgttcgttatttgactgatgagttctaccattgctcctatcagatgaatcgagttgttaacgattcagtcctgggatttcaagcagtaaggtcagcatttttattttatgttatttgctgtatttcattataaaagcacaattttaaactttaaagtagttggctagttgctataatctccttcctagagtttcactctgctgtttgtagccatccttttaatacactaataaccttgccttttttttttcttttggcagagaggggatttcagcaatggaatttgataaaaaggtagcgttgaaatgtcagttcaattttccttgtttagcatgactgcctactgcaattgcttgtaggctggaacatatatttttttttgaagactattgttacatattgttctgtaaaaggaaaaacaatatttatgcaataatacgttgtaatttagaataatgccattaaaagtttcctttttcatacatgccaatgccatcgcatagtttctagtaagagacatgccattatgagctactggtgtgcacattttacctaattaccccatcttcgtcgctttcctcccaacctttctctactnnnnnnnnnnnnnnnnnnnnngcactacgatagtgcagctgcctctgccatctggttctactagatctgtcatctgagtctagcaggaggtggctgagatagagtggcagcattggaggaggatcgacagcaccattggggtagggtggatgacggtcctttgcatgcaacgcacctattgcaaagtgctggcaccttccttgcagcactggcagccatggactttgctagcagatctgtccatgtggctcccttgttggcagcacgtccatgttaactccaatttgtcttgtagcgttaggccgtccacatcttgaacggcagcctccacctttgagggatccaattcatgtctccagcacacctcccatgctcaagaggtgtgctggagatgggagtggaggaaatgtggaaactgtgggaacatgggagatggtggagagactgaaagggaggagagagcaagaaaaatggggcaaataggtcaatttggatatccaatggcatatggtgaacacatcacctttgtaatggcatgtttctaagcataaatttgtgatgtaatatctaactataatgtttgcaatgacatttatgtatttttcctatataaaatgtttacacacatttcttgtgtttctgattggcagggaatataccctgcatcagttccagcctcgggatgtttaaccgtgcatgattttgagaccttatactgctccacatatggtccatcacggggtaagttaaaacagagcccaacttgaccatctaagagattaaattggattatatcaagtccacagacatgtcggaatccccttatacataagcaagtactcaaaccgttatacataagcagaccaagagtgtgagtgtagttttaaaatgtggatatttcctttctagcacaaaccattatgtgtttataaaattgcttttcttgtcactgagatagacctgccttttcttgtcaatgtgatattgaagttaaggacttaattctttttccaagaatatgggtacacttctgtagtttttgttactgcattattgttggtacaaaatgatgcaattcagcattcaaacttctacacatctagttggaatatatgcatctgagagcacaccaaaagaattgcaatggtgaccaatgcatcatttccatttttttggaatgaaactacagttaggcgcacccagcagttaattttataaattgggtaaacaatttgtacaaaaaaggaaaagagacaaacagtttcaattacaaagtttataacagcaagaacaatgcattgtttcattttccaacaacatactctaaaagaagggataaagtgagaggtggcactccaaatgttctttctcaaaagttgttataatttcttgataagttgcttttttttgtaaggttctccataactttctgcctttgtatttatcataatccttatgcaatttactgtatgttggtaggtttgccagatgaatcatcaaactatttgctacatatatcaaactcaatgcccctatgtgctgtccgatggaatccagcaaatcaagatgaggtctgtaattgtgcactagctgaatctttatgtgtgtggtattttagatttctagcttatttcagatcagaaagtactttgtcgatttaacattgatgggttcattttgtaaggatgaaccgtgtcttgtattatctgtcattctatttcttattgttgtatgcctgctgaggatagtttgtacatgtata

SEQ ID NO: 11263 - DNA, 12457 bp, Oryza sativa
atatcctgtgctctctgaattccgcaaaggtttgactgatgtagctttttcttcagatgataagtcatggtatgtgacaaaatttgtattgttcacccttggcatgccaattatgtttgcttcttttaaataatgcaaccgtaaatgcataaactattgctagctagtatttgatgtaaagcttggctgtgattgacagcatattgtgttctttcttaatttagaagttgaggttaattttaacccctattgtacatacaatactatgtaaacccaggaattctacaaattttgcacattgcaatgatatttcttttgttgtttgggtgggcatggggtatgttaatatagaaaataggattatagccagggtatgtggattgactggattctgcttatggtggttgttggtttgtaaaagcaagctactacagagattgccaacagcgtccctcttcttgttttttaaatgaaacaatgttgttactaatatgctatgcttatttgtgctccttccttaggttatttgcatctggccttgatggagcggtcttcatgtgggacatgcggctaagtaaaaaacactgtcttgagctcataggacatccagaatctcaatttagcagtgtcaagctaaatatagataaccgggtacgctaatttagcagtgtcaagctctttgcctctttagctttctgaattatgttctcatatcgacctatctctgtttaagattctgagtttccaacttggcttgtaaattgaacttagtgttacagaattttagagatgtaaaaagaagtttggttatttgtgttaaagtttgggccattcatagatggaggctgacagtttattttctagaccgtgtttgctgcaactaaagagggcaccgttcatgcctgggatctccgtggagggagggcatcagctgcttttcaaagccataatgaggtactctgctagctcttcctcatttttatgcggtatcgcaccatcctacttgatcttcattttgataatttttatgatcatatattcagaatagcaaacttctgttcatgattttttcttttgggtctaggttcaacaattatcatcagtgaagatatcaactttgttgggcaaaattccatcgctaaaggtatgaaaaacaaaaacaaacttatgattgcgcataaggaaattaatttctccttttgcaagtttccattcttgtgagcatttagatgtttcatgtagtcacagtatcggtgagatgtgaattatcaaattcatatagagtacttattaaatacccaaatttagaattaatgctagctattgttttgcatgcaactattaagtttgatgatattgacttgcggtaactcagtagaatatagaacgccaaacggcaatgatatatccctcttgagcttgtttactcttctgaaaactgtttaccagaaaaaaaaaactatatgtatgttaacttgtaattctcttgggtcaagttttttcttttgaaaattttgaaatcttgatatttggaacaaacctaacagtcattatgcacatctagctgaaaagggaggtcactggggatttatttagtgctttaaaccagtcagattatgtattcttgctgcgaactggcagtttgcttagtttttgccatatcaggaagtacctaaaccctgacatacttctgttgtcctaaataagttcatttcttgccattgggattaaaattagtatggagggaaaacaacaaaatgacacatctcaagtaatgaaatggagggcatggtttctacggcttgtttgaagctattataactcatcctccaattggcaccttcattaaatgtgagatagatggtatatcatctaatgggggtttccttgctactatatatattattttcttttaacatatttgatcactgtcttcaggaccaaacgaacattgtgtcgagtgaaattctttcaatagacttcaaccctagttgctcatatcagttagccttccatcttgacaatggctggtaagtagtgtgttgcactgttattaattatctgactgtaaagcaaggttactttgttgacttattggaattttccatccaccatcctttcgggtgacatatttaattactcttctacttgtttaagtgttctgtgctatggtctagatctcagtgacaatcttttccatatgcatgttaggtctggagccttgaacattaacaccctcagtgtgagtcacctgcactgccctcctcctgattggttgtaagtagattacttctgccttcacaaatcttcttagtcaaagtaacctttgctaattggacctattgttttgttgttctcttctgtttgttttactagggagcacatgaacttcatgtggcaaaagctacatagaaaaccgacctggttgccgacatcttcagtaagaatattatagatcacatgcaattctttttattaaatttgaaacctgcatatcttgttgcaaggtgaaaaggatttcaataatgctgaataaggcactttcatttatcactgtagtcataataataaatatctcatctggcattgaaatacattggagctagatgcataacatacactttacattatccagatttatgcagttggatctgcctccaatactgttggcatgcatctactggattttcatccagatacaagttcagcatgccatgtcgactacaagtgagctgatatttgctttccttttcttcttaatttacacaatcatacattttgtcaacaatcttctttggtctttattctcacttggcattccatgtttcagtgaggaaataagaggctccgatgaaaagaaacctgcagcaaacaagtttattccttcatctcagagagttgtttcctgtgcagcacatcccttctgtcatactatacttgccggtactcaggttagttcccttccatcttcagttactagaatgacctccatctcggcgtataattgggaaagctatatgcattacgcatcagttgcagatctgagtctgttggcaaaagttaacttcttgttatcctcttcagttttcatctttgctcgtgttatcgcaaaagcaagagtctatcaaaaactcggagtagcggtgtcatggaacaatcttgatttgcctccaagacaatatctccaaatgcagtcacagtgctctacattagctcgtgggccgtcctgcatcggagaatgatcagccgcatgggagcacaatctattggtcccaccacagaggctcccaacctgatcgaccggtcaaaaagaactaaatctcttggcgttacatgattcgatcttctgccagtgcattgcctccaagatgggcgacagatttctgtgttgcaaccgaccatgtatgtactttcatggcatgctcctaggggctctgaaggttcgcttacctgtacatgatttcccccgttccctgaactccctatctctgtagatcgtacataagttgtgtttcccagtttctcgcaatgtcggtgtatctcctggatgtaatactgtataatgaactgcttcatccgttccaaaatataacatactggtactagattatacataacctagtgccaacatgtatcctgtgcggttgatgccgctgctgatccagaccgtggttgtcctgggctcctggccggcggcgccgttggggtggcggtcagcaaagaaggcggtgtgggggatgcatgctcaccgagccaggaggccctggacagctctcaccggaggcggcagagatggcacagagatttcgacaggttgagccgagcaggcatcagtcagtatagtgcgcaggcttccgtttccgtgctctgatcagaagcgagcggctccttccctgcatcagtttctgccgcagcgtgcgcccttctccgtggaggcctgacatggagcgccagtgtaatcgtgtggagagcacacgctgcatgcggtcgtctctggcgccggcaccggcacggcggcaaccgtctcttgcgcggccgggcgcatggtatcaccggctcaccgctggtgaaaagggaaaaacgagatttggagggagagacacccctctaaatacttttttaaagaaaaattatgagtgtgtcaattgaacatgagactttagggttgaaattatagaccacttgtcactacactatcaggtgcatcttgtagcaccgccagtgtccaggtggcctccgccttcaaaaagtattcgccttgtttttgttcgcccatgcgaataattcctcttttattagagagcatgagaaagttgcttgaaatcatcgtagtgttagctaacagcaactgccagtcactattttctgcttcggttgctcttcccttctcttgtctagcaaaaaggatgatgtgatctgctgctaaatctggacaaaatttcccttttttttttgcccagatttaaatattgtttgaaaatttcgttcaacaatcgtgataaaaatcctgaaacctcccaaaattcagaatatgggtgccccaaattttcttttccccttccgaaagtgcaaatcagcaatgggtcaaagcatgtttgtttcagatgttttcaacagaggagttataaaagctgatgcacataaatatgaagatcggatccttcagggcacttcttcgagaatctagaattctacaaagaaatggtgtttgcatgtggctgtgttctttagtctgctttctctcattttttcgcgcgcacgcttcctaaattgctaaacgatgtgtttttttgcaaaaaaaaatctatagaaaatacttaattaatcatgccaaatcgttggaaatgttcccaactccaactagggaacacagaggattgagaagcaaaggacattggggtccttgatagaggaggcaagctaggaaggtgtatgaagctgaacaggtggaaatgctgagaaacgagaagcctgccatccaggaggctgagaaggaagaagtgattcccatgtgcacattagaccacttcttttgtgtttgttcattttcagtatcttttgtgtttgcttatttaacatatggaaaaaactgatacgatcagtgtatgcttgtttcaacttagataaatcagactggtgttcctcctacctgaattaaaatcatatattgaggtgttcgagtcattttgatcatcttttccattggaattgttgattcctggaattggagctgtgctaaatatacccatgcttgccatgccatgacgcaataaataacagacctagcacacatctcagcgtgtatcatacggtaaaaaaaaatcgagtgatagctaagaaaaatcgtttcgagtgagatatatttcaatgaaaaatcattggttgaaacagaaaattggggttacggaaaaaaatatttcaatgccgccttttctcccaaataaaatccccatctttatttagatcgtcgtaccttttcaaccaaaaaaagggaaaaatgacagttgatcaccaagacaatcttaaagactgaatcttgctaccagcttggaagcatgcaaaactgagataggcctctatgattttctagtaaagcagtataatttccattgggaaatcaccaacaacgtgcaaagttctgatgatttctactgctcaatactgtataatcaagtaaatcaggacgttatgcgacgagtcacaatgttcacaccaaagagaagttatgttctacgacagaagtgccatactgtagttaatacaataacagagtcacagaaaatcttgtcttgttagctactaacagttgtcgatgtctcaatggagcgtgcagtaaaaatatacagaagctatacacagttgaaggtctgctgcagtaagcatgtaccagtacgacgaatggtattatcaacagctaatcctatctatgccctcaagaagagagctaggctacccccccatatcccagggtcctcaagcagagatccccctcaatggtacacaaaactgagcaccatgcctcaacaagcccaggatcacagcagggatggaagaagagcagctgatgcaaagggtttggctaggactagcggctaagaaagcagcagacaagtgggaaaacctcgcagttgcaggcctgagcaggcctcactctctcctctggacagtgtgatcagctcatctcatctcatctcatctcatggacaacagggtgcgcttctggatggtcaccttggaaggctgagcagccttcggagctctcttgaggttcttccttaccatcttctctatctgctctatggagctggacagttccttctccatgagatcagcaagagctggatcatttggtctggatggtgtctgaaaggagcagtcagatggagaagaagatgatgccttcggcttgccctcggccaagtaagctgttgatgtgcttgcaacagcttgggttgagccaggacaaggggcagcagcatccagggccttttgagttggtggtgttggtgtgctttgagggacaccttcttctttttgtactggagttgctggatccacagatcgtgaagaatcttcactcaactggatctgctgccgaaccgcagcatttccgaggcgacttttcctctcaactgcctgcaaatggtaggtaaaattataagcatattgtcatggatgcgtgattatatccattaacttgaaggatgtatcagcattgttatcctgctacgactcagtactgcacaagcatatgttcaacatatgagcataaatacaactacagggaaaaaaaggcatgaataactataaaaatgacagagaactatgtacaacaaaatgaacaacaaaaccccttttctctttcccccaacgacagcattgaagcaaaatgtgaaatctggattaactggtattataataaaatgagatatataactctggttgtttgacactgcggaaaatacacttatttttgctatgaagataaggactaatatatcagctagcaagaatttcatcaaggccaaaaaggagctgttttgtatttaagcagctatatacacaacaagccgaagtactgaatatgtaccaatcaaagtacttcaaaaagttatccttaaagtttaacaggaaagtatctgttaaactatcgaacactgagtaaaatttaacaggagaagaacagaagaaagcactgtagcaaagccaaactgaaatcgcacccggtaaactacagcttgatgaatacatttagttcaattttttcaggttaagtgaatctcaaaagatatgactactggcaaggcaagcaagttaggctgttgccaaggttctatatagcacaaattccaacattgaggtatttcctcatcctctattaccttcggtgcacaccattgaaaaaaatgtatataactaaaaaatgcacctacctctataatgcaaagcagccatgaattatgattcatgataaaacagacccaatcccccaaattggtggctctttagttttagtccataaagtgtacaaccaacaagtccaacgaatcacacatatcatagttgattcctcacatgatcagaagatcattaagaaatgcaacagacatgaaatggatgaatggcacatttacatgttttaagcctgttatttcactgaacttctcagaaaattaatcagtattttatctgattactggtcacttaaaatgacggataggcatatcaaaacagataaagaaaaaaacaaaaaaaacaccatttgttcagaagaaagtccctcgttgcttcttactaacaaaattcagcgattttgttgcagtgacagaaaagatgcccaattataaccagcagtagccagaagacacttaatttgctagactgcaactattgctagtaatattcacaataggtaaccaagacatcctcaactcaagcctaatcacaatttcagaatcatgtgcacaacatttagcattaccatatcaccgtgaacatatcatgcatcaaatataacctaacctgaacacaacaatatattgacacaaatcctcaagaacataccatgcataaaaacctaaagtattaaaacatgatattagcacaaaatgaccacacaattttacaggattcagagaacatccaccacaaagcccatgggaactgttcatcaccttgacgactgatgtgatatcatggagtgggctacacgacatataatgcaaatttgtcatgaattatgatgattcatgttataacagaccgaattccccaagtgtgtacaaccaaacaagtacaacaaattagacatgtcatagttgattactcacatcagaagagcattcaaagtttaagcctgttatttcactgaacttccctgaaattttgcatagtatgtcatctaattactgatcacctaaaataagatagacagatcgaagaagatacaaaaaagagcgaagaagcatcggttggtgaagtccctcattgctaattcatttatagtctgatatgattttgcaagtataaaaaggtactaattgattatagtatcaagcaattgtgttcctcattttagtgattgaaatgcttactaacaaaattcagggactttgttgcgataagcagaaagaaatgcatatttatcatcagtagtagtcgaaggacaccttaatttcctagactgctactcttgctagtgatattcactatctgtaaagaattcaacctcgaacacaagaccaccacaattccagaatcacgagcacaccaatcttagcactatcatatcttcaagaacataccattcaccaattataccctacctaaacatgataactgacacaaatcctcaagaacacaccatgcatcaaaataataaaaacctgaagtcctacacatgatatcagcacacaaaaaacgaccacaccaatttcacaggattcagagcacatccaacccaccacacagcctacgggaatggttcatcaccttgacgactgacgtgatgtcgcggagtgggctcctcgggtaccactcgggcagggggctcctcctcttgggtgtagccctcacggtcacagcccaggacggcggcacgttctccttgttgctcgtcggcggcagggcccgccgagccagcggcttgaccgccacggctcccggcggcgacgtcgtcctcctgataaagaacccaccacccgaggggtcggcgagcgccgccctaccgccggaatttctcacttcaggcatcctggagatctgcgagaagaactcatgagcaactaatggaatgaagatttttcgcacaaattctgcgcggctcagatttggctcctgcctcttccaagtaaaaagaaaaaaaaaccaccaagacaagaaattgcccccaagaaacaccagaaaacatctaagctccggttttttcaactcagattcgtcctgaaatcctctaatccccatcgatttgcaactaaatgacccagaaaaaaaacacagaagggtttgggggaaacgaacacgaaccaacgaatccccacaaaaaaaccaaccaaatctcccaaaattcagccatctcaccttcagattcctgccgctgcaaccccccgcacgcgaatcctatcccctcccgcagatctgcaaaagatcagaatcacaccacaacgcatcaggaaaagaaaataatcgcccaaagaaacccaagaaaacaaacaccaccccacccaaccaaaaaaaaaaaaaacgcgaaaacaacctacgatttgctcggctcttctccgattccttccgatccgggccccgcggcgactactaactcccctacgatagaatcacctaactatggtggaatagatccctagggtttggagcttggaggtggctatggctatggctatgggctctaactaacgggagggggggagaccaggagaggcggcgcgtgggcggggggattcttatcgcgttttgaaatggccggtgcacggcgtgatccgtggaccgagagcagcatctcgccgtccgtaggagggatggacggcggggattgttccggtgtatggaccacgtgtatgcggtttggggatttggagttcttgaccgttggttgctttgctctgctctctcggctgagaagtgagaactctgcatcaaggtgttctttattattattattaatttattttttggaatttggacggtaaaaattgctccgaaaattggcacatgatgattattttttgagcctcaaatgggagcatcgatttttattcatctctattaaaatatggagtatatatttacaacaaagtgttccctagaaaactgatttcaagttgttgagagaacatgacaaacatacttcgacatgtgggactttgtctatagtttgtgtattactgctcttgtttttaattcatataatatcatgtatgccattgtgattaggcacctttggcgtatcgtagggacatgtgcctccgacatgtgggaccgtaagggtggccccaccagttagggactcgcgccactacccgtaactctgtaagaggagttgattccaagccattgatgatcgaattacgtttgtgccagagcttgctagtgctcttgctgttgtggatggtggtggcggagcttactgcttatgaaaaaaaaatcaatgttacagaatatggaccgatatgtgattttgtggactatagagttcctagagagttgtgactatgcatttccagcttcatatactcagaagaacaaatatgtcttttttacttaggagttaacggtcaatacacagtcaacatataggagtgatataagagggtgtagaaatttagaccaatggcatataagaaattaggacaattttcagtggcatatgagattctctcatatctagttacacggcaactcgatcttgtttttacgagttcaactgcaacaacattacttgagcatagacgtactcgttataaacctctagacattatccatatcttgagaacgaaggcggaggttaaggatccctgttctttgctctatcttccaaactcaagctcgctcgttttctttctgtacgcttcccaaatgtactaatctatatgtttgagtactaaactatacgttttctaaaaaaaattctatacgaaagttgttttagaaaatcatatttaaaattaactactccgttttacgtgagtatgaaattagttcccaacaccacatgccgaaagctacgaggcaaggcatagaaatcattccatcgttgtcaaacaccctagcaaagagcaacaacgcgtacagtacccccagcttgtctcgcttcgaacacaacaacatccatcgccagaaactgcaacggtcgatccaagcaggaagatgctactggtttagtagcatggcatgtccccatctcaaggaacactagttgatgcgaaggaaggacttatgcctggtgtgtttggattggcatggcctatggggacagattagaagtaagcgctcccatgatgtgcttagctgataggtgcattctcggtgcctcccaacctcaatccagctcgtgtggtctgtgagaactgaagattatttcggctcaagattgtaccaaggatgcagaaatggtttccgtttagaaaagatgcagaactaggtgtatgtgtaggaagaagaggcagatggatagctgctgatgactttgaagttgaagtaggtgagaaagaggactagtgaggcaaatatcttgccttttttgtttcgcaaaatcaagtggagtaggtttcaatttaagagaggttaaagacaagcaaaggagtaatgtggagcagatagaaaaagaaaaaaaagacgaattacccctcgaactattatggtcgtccgaattacccctctaaaccataaaaccgaacatcctttacccccaactatgcaaaccggatgaattaccctcctcgacccaatctacggtggttttggtctacgtagcgtacgcgtggcagtccagtcaccactctattataaaaaaaaaatgtgggacccacctgtcatctcctcattctctcttctctctctcactcttcctctctctctcaaacgggtcggcggcggtgggggaggacgtggtggcggcggtgtgcgggcggtggcggagcgcggggaggacgcaacggtggctcgtatatcccgcgtgcaagagctcgagcttgctcggcggctcgtcgatcccgcgaaggaacttgacgaggggcggtcgccatcgccatcactcgcgccgcgcgccgtcgccatctcccctcgagccccgcctgcgccgcgcgccgtcgtccgtcgtcgccgtcgcctcgagccccgctcgcgcgccgtctgtcgccgtcaccccgcgccagtgtgcccgcgtgatgccgccgtcgcgtctcgaaggaggcgagcgcggcgacggaggaggcaagggggcggc

SEQ ID NO: 11264 - DNA, 7987 bp, Oryza sativa
  unsure (1)..(7987): unsure at all n locations
gcctctcctcgcctcacctcgccgccgcagcctcctctgccgccgcagcctcccctcgcctcacctcaccgccgcagcctcctccgccagtgctcgcctcctccgctgccacagcctcgtgcgccgccgtcacctcgcctcgcctcacctcgccgctgcagcctcctctgcctctgctgcggcggccgcctcgcctcgccgccgcagcctcgcctcggcgcccttccctcgcccagctgaagagagagagagagagtgagagattgggagagaaaaagagtaagaaacttacaggtgggatcacctattttttttataaataaattgctgactggactgccacgtaggatcaaaaccaccgcggattgagtcgaggggggtaattcgtccggtttgtatagttggtggtgaaggatgtccggttttgtatttcaggggataattcgaacgaccgcgatagttcgggaggtaattcgtactttttccatagaaaaacttgcgcggtaggaacaacaatcacacatctcacaaaattgttcacatgagatcgaagattccaaattaattctactatcagtagagctatgagaagtgggtgcacgacttcaaatcacagatgcaaaactagcatactgcaggacaacgctatcggctgattgaaaatccaataatatgaataataacatagcattgattgactggctactgcagagcagtgctcatacgaacaaaaatatcaagattttgatttaatgaaaaattaagacacagccacgatgtggctccatgtcagtgttcgtaacaagtttgcaagagaatttatgtatgccagtattggtaaaaaagagaagcttttttttttactaaaaaaatagaagcttttggacaaaggaaaaaacacatcacaagccgtcgatcaatagtttgacgaaaaaataactaattacacagattgcatgtaaattacgagacgaatcttttaaacctaattgcgtcataatttgacaatatggtgctacaataaatatttactaatgacggattaattagacttaataaattcgtctcgtggtttacatgcggattctgtaatttattttgttattagactacatttaataccttaaatgtgtgtccgtatatccgatatgacacgccaaaactttacacctctgtatctaaacacaacctgaacttgctgcaggtttgcacatgttagaactcactaatcaataattttgctgaaaagctagacacatacgggactacgggagtctcgagttacaatttttggtttatggcgtactacgagcaagtttaatagtacaattagttacaagctataattttatacatgtcatctatagatagttttagagataatttctacaatagatatctctaatctcttcactatacacttgactatacagtgggtcctaccctcctctctccctcctaccttttctctttgccctcctgtcttgtgcgcaggctaacatggtttcaccaatcacaaattaagaactgaacatgaaatggggctcaccaggtgtggaggaatgtgctgcagctagcgcttattttgtcgcccgcattccttctctctcttagagcaggtttaattaaacaggcgactgccggcggtaaaaaacaccacatcagcgatagagataactagaagatgggtgtatgtacagctgttggttatacgcacaagcaccaataaattgattattatttttttacgcctaatccgtacccacgcattgcctcacatagacccacatggaactatgggataagctttttctatagtttctttcttcttggagtttgtgtgtagtcggcgatatagtcgtccgctaccacccactctcctggttttttccatccagctcatcactttggccaggttggatgcgctatcgcctgcttaaaccgtttattatacctgctcttaccctctctttctttcaacacaccaaagaatcagacgtggtatttttgtgcctgctctactagacaaacgtatgcgccggttatgatcatcttgagcggagagcccccaaggccccaaatgaaatcaaggcgttggaggacggtccactattgtcaccttgtcctcgatgcaggaggatcagcaattcgatcgattatagtcacaccctgcgaccgctgctactccagtccctcgtaacactctgcttagggccctcgctgagcgagacataaaaccattacgggtgccatacgaagaggggttctccactgttttctagctgggctaacagctggatttctgatgcttaccattcctatatcgaacgatattgggatgaaacaattactatacgtcgagtagtgtatctgaactcaagcttgagacaaggtatgtgcatggagtgatagagtagctagctctttctccttatatcacttgtatatctcctaattgctattttggatatttttcactgggtgttgggtatagtgaaaggcggccggacaaggaggagaggagatacataagtggtgcctcttaatatttggtggttcggctagcttcagaacctcttaaagtgatagaaaaagcactgacaagaaggattgcaccaactatatctttatgctaattaacttatggataaccataagagcatgcccatcacaaagtactaagcctaatttccacatcatcaagagccaaccatctaaacaactcatacaacagttaggtctctaccaataatgcctaatatggagtatttattttaatgaccctaaatcttatgctctgttgattggcgtgttttctccttaaaattaactgagcctgaaatctgaagaacaagctagtgatgattgatatggatttaattagggaaaaaatttaatcttgaaattttcaatggccataactgaccacaaagaaatactccctatgtttcatatcataattaagtctttcttattcttttttctttatcaaatttcttgcggtttaatcaaatttatagaaaaacccagtaacacctataacatcaaattaatttcataaaatgtaacatcgaatatattttgataatgtgtttattttatataaaaatattgctatatttttctataaacttgatcaaacttttaaaaaatttaactacgaaaaaaatcaaaacagcttataatataaaacggagagagcagtaacttcgccgagacaaagatagcaacttcatgttctttatttcttgagcctgtcaccgaaatgcaagcaaccatcagtcgtgtcacaacgtccacatatacaagcggcggagggcgctagcagatcttcccacggatcggtgcaagaacagaagccgcggaggccggacgtcatgccagccggtggcatagttctcgtgaagcccggacgagtactagcgtatccgctgagtacagattatcgagacgtcgcctcgcagctgatcagttctttatgggtgatactttggttcctggtgcctcctagtcccagtgaaggatcaggggtgtctgtagaactgtagtacaagattacttggcctttttattttctttctggacagctactagattttttttattgatcccatgaagcacatgtttggtgtctgtatatactatgagagaagaggattggagatcaggcatatatgtatgctgaggttttagtggcaaatataggatggaaaagatggtaaatattaagaggactcttccgtctagataaaaatcaatcatgggcagcaaagttgttttcatttgtatttgccctttagtttaaattttcaatttcattaagaaaaactaaatacaaaatgaaaaataactttctctttttttatacataggtcatcggcattggataaaaaagggcagagcactttctagttatggacccaaatcctttagcatggaatattttcttttttaattaaaaacccttagtatatgaaagaatgaaaatgtgtttttgttattttctcgtggaataagaagccctcgtaccttaatgaaatgaaacaacagtaaccagcacatgtttatatatagtcattaatttggtgcatgctgtggttattgcatctcacgagagttattgtcccttgtcgagactttctctatgggctctatatataggctgtgtttagatccaaactttggatccaaacttcagtccttttccatcacatcagcctgtcatacacacaacttttcagtcacatcatccccaatttcaaccaaaatccaaactttgccatcaactaaacacagccatattctagacacacaacgactaggatgtaattctctgccatagaaaaaaggtgatgggcgcatggaacaagcgataagaaggacggagcaacacatcctgtagggattagtggattattgcctggatgagtgaaatatacttgtctgttgtctcctaatttactgacatcactcaactcgaaatggagaacatgttcaaactacaaggcatgtctagtatggatgtactgacaagcaaacaaacaatggctttgatcgtttgtacttgcagccagcaagctgcgtcctgttgctgctacatcaaatcagcttgcatagagctggctggctgcagctgcggtgttgtagccagcacaaacgatcagccccaatgtgtgttgttcttggtgcaggcgcgcgattcgtgcactattcggccggccctctccttgctctatccacgacacatctaggctcgatccatactacaaccttcatcccaagctattgccatggcatctctggtcccagcactaggatcttgctaagtgctcgacattatattgtcatgtgtaccatatctaggagattctaccaaaacacggaggcatttctaatggctatgtttccaacgccttccattcctatacggaacgatgaagctagctagcattatgtttggcttctatctgaactctagcttgcacaacaggcatagcatggcagcaagatagagctcctctttatcacttgtatctctcactattcttttgaatctttttcatcatattagtgaagggtgtgtgtaactagaggagacgaggtaggctttggttcttgatatagttcgtgtgtgtggggttgggggggattgcaccaagccaccaactacagattaattcactagagctagcctactgatgtaaagatgggaaaaatattcagagcacatgagtaagcaggtggtactaatagtaatagagcctgaaatctgaattaggagccagtgttggtcgatatgcatttaattaagtgaagactttgatcttgagatcttttaggtaccattactgattacagattaatagctgtgtcatgccaaaaggattaaacaaaagctctacgaaaaaaaaaagataataaggattgagaagctagtgctgtactactgtccagtacttaattctcagactttcagaaccaacgtgactagtaagccccccgttctggtcaaggcagcttcgtgtatagatagccatatggcccgagtcccacggcccagcccaagtcacgtcaatttggtccggcccaagcacagcacggcccgattggggtcatgctcgtgccggcccagcccgacagccaggccgcgcttgggctgctctctcggcacggtgggccggcacggcacggcacgatcaagaaaaatagtagaggcacgtaaaatacacttaattaaccatatgaggcaaggcccaaaaacatgagaaatacaaaatagacttatttttcagtcatatggacacaacctatagagtttagggaaaaagtagacttattctgtggagaagaatgatagctgttgtgccttcaggccagcccggcacgtcccgagtcttactgggccgtgtatgcagcccgtgggctggcacgacatggtctagcatgtaggtcgggccgtgccggtccgactgacctcagcccaagcccgtatcaggcggcccatttggccatctttagaacgcatcctcttcagagcaatcgatcgagctccaatgtaactcgaaatggcttgctgatcatgatgctgggcaaagcttcgtcttccacctgtgcaatatcctcatattaactctacttcttagcctagctcttagcacttgcatatcgtccgccgaagagcagtatgtatatttacccaaacatatagactgatcagccctgatcaacgtgctcaacacatccaaaactcagatacacacattcatatgttatgtgtttcagatttactactactctctaattcttccatacgaagagagcatacaataccatatgcatcagcgacaaatatttcttaagataacgagaagatacgaggaagaaggccaacgtacaggagacacaaaaggcctatacattgtgtccacaaccacaagtgaagaagcaagcgcctgtcgatcgatcgcgagctccctcgctccatggacacaagccacacaactccaacggcgagtacctctctccggagccatccgccgatccatccacaccaaacgatcatcatgatcactgcgccactggaccggctcctggacagcacgcaaagtgtctgagcagttcttcaccaacacagaagttcttgtaggcggtcaggttggtttgtgtgattctttgattcccagtgcctcctagtcccagtgaatggaaaatgagcatgtacgtacacaactgtgatacacttttgatcgatattttacttcacttcacccttttggccatctactgtatatagtttttgttggatatatagagtatatatcccatgtaactgcgtggttggtttttgtattcggaagagaggatcgatcagagagcgtgtgtaataaataatgctaaggttatggtagctagaaaggtaaaggcgaggcgagctaaatgtacaggttatataagagcaaggttaataatagtgccgactgctgactccaaccgattgccacgtccttcaatcaccagccatctgcaacaacatacaacagcagcgaatacttcatcttttaatgaagctaatctctaaccagccattactttaagtctattcatttttccgttggttgttgtgagggcaggtgggcccatggcaggcaaagtgcctagctagactcacgtgtagagctggacataaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtagactttttgctatctcttgtatgaggtggacaagcatgagctagtgcactagctcaaccattgaaggaggcctaatagtcgctcgcttctctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11265 - DNA, 627 bp, Oryza sativa
ttagcgccattatctaaaactaatttagtcggttagatttaactgctcctgaaaggcgagttgccagcgcgcacgcgcgcagtagcttttcgggagaaagaaccgatgaggcaaatcgttgaagcgattagaaaattcaaacaacgatttcaaaatgcaacggttctgccgtcggtggcatcgtggtagcggcaggacgaatttgaaggctgcgccccacgggcctcatcgtcatcggtaagcaaggtgggactaaaaatgtgcagtacagtggctgcacaattataacaaatagacaggttcataaatctgctcgccacagccacgagatttcaccgggaaagcgtgctcggagctggaaagggggaagtaaaggaagttggaactgagcaggagtaacacaacatgtgtaatctaagatacagaaacagcccttgcaggcacaagagatgatcaattgtgtttgtaacagaacggcaaaaaaaaaaaaatcaaaaactagcatccagctagctttttcaaaccggacacgagtgttgctggcaaatctcgacgaccaaaagctatgcttccttgggtttggtgagtggctgcgttccgttctccaacaaaaaatgaaattttgga

SEQ ID NO: 11266 - DNA, 5261 bp, Oryza sativa
  unsure (1)..(5261): unsure at all n locations
ttgatttccatccaggtgacgcacgatgatgctggagacggtggcggctgtgcccgccaccggggatggtgggcggcatatgctgctccacctctgctcgctccgcgacatcaagcacagcgacggctggatccgtgtgttgttggaggaggctgagaacgagaggatgcacctcatggccttcatggcggtgcccaagcggaggtggtacgagcggctcaccggccgctgctcctcgccttgacatgtgggtccacatgagtcgcacgctgagttagctaggttaatcatagttaacttgccgtgccaaccaaaatcggacactatattgtccaccggacggtattacaagttgaggagcgcgttatatatatatagtattgtgatttaagaatgaaattcaaactttagtttaagatgagcgactctaagtctaagtgcacttaaggcttgtttggtttacaaccataccaaactattggcgatgccaaatcatgggccaatttttttgctagtgccaatattttgacaacatttgtatgatattagtaagtattggtagcaaaccaaacattggcaaaattactgttaaaaatgccaatattttggtatggcaagttttggtttcaaaccaaatcagcccttatttcttgaaattttttatatttatatttattttttaaaaatattttaaaaaataaattaccatttcaaacatttgcaaaaatcgctctactagaggatgagaagggcctacatgtaaaatttcctgcaacacataagacgtagtatttgtacaatttgtaaaattctcatgtgatgtcagttgaagttaaagtttatatgaaaattgtagagcttgatgatatttacaactttgcagttgacaacttttccattaaaataatttatgagtcttaatacatatatttatatttatatttagccccctcccatgaggttttcactaatctgaaaattaatattgattatttgatactctaaatagttttaaatgaatgagtggccaagtacaaaattatagatctcatcgagctccacaacttcgatatagaacttgtctccatcggaggtcgtttaaaatgtaggtctgagaatttataaaaataaatctaagacattctaaggaatatttagacccataaattattctaatggaaaagttataaacaacaaagttgtagatctcgtcaagctctacaatttttgtgtaaattttaacttcatccaacatcatatgataattttacaaatcatacaaataatgtgtgttatgtgctgcagaaaattaaaattttacatttagaggacgagaaggaactaaatgcaaataatttggaaccccgtgttgccacgtcacataaatcgccctctattagggcgatttttagggagggaggagtatatttttacaaaactttgaaacggtaatttattttttaaatcttttaacaaataaatataaaaataaaaaattccttatttcctctgttctttccttcccttttcaaggcccaccaggcatcagcccatcttaattttccttttctttgcagccaaggagtcgaattattgcacgaataaaattcaacccaaaagaaagaatcagaacattcagctggaaattgtttgataacatgattttcctttgaggaatgatgcaggagtataagttaagaccacaacttgatttttggtttgagatgcatttagatttgattagagttgatttttttttatttttttcatctttatttgcaagtcattaatagcatgtagataaaaagttttacacattatttttttctaataaatcatatggataagcacaaacatgtgcaaaacgaggttttagatggtatcagctacaatacttttcgaggtctctcggtaaccaaacactataagtttcagtacctacactgtattgttttcctagtacacgctatagaacaaaattaggataaaaagaattgtagaagagaaggtagaaggcataaaacataattaagtgaaaaattatgtctagatattgtttacaaattcaaaagtatagcttgctagctttaaaaattaacacatcttctaccatcaacctaatagcccacctagttatagatatatactactccctccatctcatatttccaaatctgaaaaatctatttttgataggcaaatttcaatccaacaatctatcatcttaataactttctcggatttaatgtatgactctccattcttccacacaagattggttgcatggacatcgagaaatgtaaatattaatgaatcgcttgtttacgaggaatgactagtagcatgtttaaatagatgataagtagaatcacttattattggtctatgtgtcaagatgaaatatgactatcaaaagtagatggagggagtacatcattaactctcagacacaacttatagaggcttatgccttatggtgcagttagctataaattagtaatctgctactcttctctttcttatttcttatactctcttctccatcttagcacaaatctgatgtgacaattcttacatcccacccatatatcatctcattcttagtcgggcacctccagttgtcaccagggctcaaattttcggaatgaaatttctaaagtttcggtcttttcggaaccctcctcccccgatatgatattatttcggcctaaattttaattttttttatatatatttttgtgaattttgcaatattttgtttaaatttgactaaaatttattcaaaactttcgttatatcggtaccctccgatagaaacatccaaaccgaaatattaaatcctagttatcacttgccaccacactggtgcctcgatcgctgccccgagatcccgccgagggaagaccatgctattgggcacctcgtcatcttgccgcttgcgatgctggtcaacgctgcaatgcctcatcatggccatgcaagcgcaccatagcatcagccgcgccgctgcaccgtcgctcctacccttaccagcatgtctcatccgttttttttacaaattggtccttttcaaaaacttattttaaaactagtcccagcaaaaaaacttcaaccaaaaataagccgtggactcagcgccatggacattggcgctaagttataacgtatcagcgccaacgtcgttggcgctaaattcagcatgaattcgctgaggtccatacgatttaaatagccacgcaagcaacatatagaaccaagactgtgatggtgtggtggttgtgacttgggctgtgatccatagagtgttaggttcaaatcctggtatccctcatctcctattttcttttgtatttttgggtttttccttttctcttcctcctagcattttttagaattaatgtattttacaaaataagttttgctctcttgactactcactcttgttctttacaaaatgactgttccgtttgtaaatttgttttattttgaatttgatttgaaatttcagtttaagttctcatttgccatataatatagcactttaattttttttcaaataaaaaaagttgcatattttcttttgtatttttgggttttttccttttctcttcctcctagcattttttagaattaatgtattttacaaaataagttttgctctcttgactactcactcttattctttacaaaatgactgttccgtttgtaaatttgttttattttgaatttgatttgaaatttcagtttaagttctcatttgccatataatatagcactttaatattttttcaaataaaaaatttgcatattaaacatatattttgaagatagtattacaagacaaaaaaagaaaataaataaataaagatataaaaagaaaacgagataaaaaaagaaaaaacatattaataaagagtgagggagagaagaaaaagggaaaagtaaaaggaaaaaaaagaaaaagaaaacgagataaaaaagaaaatatatattaataaagagtgagggagagaagaaaaagggaaactagaaggaaagaaaaaaggagatgggagtcgaactctgttcctgaagtttaaagtagaacgctactaccattatgctatcaatctggcgttgctagagatgcctccgaatttatttaaatcgtctggacctcagcgccaaatagatctcataactcaacgaatccatgccacctcggataagagtttagcgccaacgacgttggcgctgatacgttatagcttagcgccaatgtctatggcgctgagtccacggcctatttttggttcaagttttttgcagggactagtttcgaaataagtttttaaaaaggatcaatttgttaaaaaacggatgttactagagctgatttttgcggcttggaccgtcgaaacaagaattcggcaataataaaaggagtagcgtacgagacctaaaagtggatggatgcagagataaggatttagacagattcaggccctctcactcaatgagaggtaataccctactcctgtttggggatttgaatccgccgggtgtagtattgatctgatgatcatatgtgctcataccccctagagggcctcctgcccattttatataggatgggggacagaattacaagataaaaaccttaaccaatacggtatcggcttcctaaatctactttataatatcatcaaaccagggactttgcgtggaggagaggggcggcgggggcagcaagaagtggccgggcttcgtccagttcttcttcgtcctctccgtggtcctctgcgtgctcctctacgccccgcggttcatcgtgcttacgcccacctacggcctcgacttcttccccagccgccgcccaacgacaccacctcgaccgcccgcgtcgtgggagatcataatgctggcgacgtggtggttcttgacaaccagctgcgctcgccgtgctcgtcgctcgccggcgacaccatctgctgcgaccgctcgaatttcaacaccgacgtctgcttcatggccagcgacgtgcggacggacccgtcgtccctgtcgctcctgctgttccccaagcagccgccgacggcgaacgccaccgtggaggagaggatacgtccgtacacgcgcaagtgggaggcgctcatcatgagcagggtcgaggaggtgcggctccggatggctcctcccggcacgacgcgccgctcctcgtcatgnnnnnnnnnnnnnnnnnnnnnnnnnnnnnnnnnnnnnnnnnnnnnnnnnnnnnnnnn

SEQ ID NO: 11267 - DNA, 14940 bp, Oryza sativa
gggtcgaggaggtgcggctccggatggctcctcccggcacgacgcgccgctcctcgtcatgacggcggggggctacaccggcaacctcttccacgcgttcagcgacgggttcgtgccggcgtggctgacggtgcaacacctccgccgccgcgtcgtgctcggcgtcctcttgtacaacccgtggtgggcgggcacgtacggcgagatcatctccggcctcttggactaccacgtcgtcgacctcctccacgacaagcggaagcactgcttccccggagccatcatcggcacacgcttccacggcatcctctccgtcaacccggcgaggctccgtgacaacaagaccatcgtcgacttccacgatcttctcgccgacgtgtacgagaccgcaggagacaccgtcgtcgtcgacgttccccagccggcgccgcggcggccacggctcgggatcgtgtcgtgcagggggaagcgggtgatcgagaaccaggcggcggtggcgcggctcgcgaggacggtggggttcgacgtggacatcctggagacggcggacgggttgcagctcccggcgtcgtacgcgtcggtgagcgcgtgcgacgtgctggtgggggtgcacagcgccgacctgaccaagctcctgttcctccgccccggcgcggcgctggtgtagatcgcgccgctgggcgtggcgccgatcgcgcgcgggtgctacgcggaggcgtccgcgcggatggggctgcactacgagcagtacgacgcagaggggcacgagagctcgctgagccgcaagtacggcctccgcgacgtggtggtgtccgaaattgaactataagccaggttttccggtttctccaaattctcaccaactagcttctcgtagttgtagaatctagaaattgaactaaaagacaaaagctaggttttccggtttctccaaattctcaccgactagcttctcatcagctgtttctcagaattttaagctcccaaaactggaatgtaactaatatgtgacttgtctaatcttccaaaaattgcaacagatcaagtagctagtacgcacggcttgctggagcgaggtcctcagttcgatcccctaccagcgcacaagctaatcctcaccctagtttacattttcataggcaaacatttggctccgagagacattttgaaactggggatgagttgcggccttttccgatctgtctataatccgtgctaccttggccctgtttggttccatgggctaatgtttaaccctcaccttttagcctcaaattagccctcaagaatccaaacatgtgggctaattttgagctaatgtgaattagcccccctcaaaacattagcccctccaaggggtgctaatggggctaattttgtatggggacattaaaaagcagctctctctctctctctctctcctctctttctactctctctctaacttttagccttgaattagcccatggatccaaatataccaccctaggctaatgtttagcctaccaattcatgactaaacattagctcttaaaattagccttgggctaatcttccaaacatggcccttgtactttcgcttcttaattactatggcgtaactttccctgttctcaatatatgcggcgacaaagctcctataccggtttaagaaaaacaaacatcctgaatatcatgaatggcacatggatcgagcaaccatattttgatccatgacttgcagcttggagcaccggagatatattactggaggacagtaatgaacgtgaactgatggtcaactacagatttgagttgggtactcatccacaagtggatttgtcagtcaaaactcaaaagtcagtcgctttaatccgaagattttgggttgttcacatgtgatggggctgcttaattgtactccatgtagatattttgagtccagaaccacaagctgcaatgcagcaatgtgctaggcattttatttgtcgtactggatatatagtttatatagctagtgtccgaaccttcagcgtgtcgttaaattcagtgacttcataggccaacttggcagttggcactagaaactcacgtgtatatatacctactgtgtgcttaacaccacgcttctggaaatctggataaacatttaaatttctctgactttatattagcaacagttgttaaaatgcagcggaaatctattcaactctgatcttgtttttcttcccggaattttggcccgccaatttattttagttttcacattatggaattgtgaaccctggaagaagtggttgtgcatggccgccttcaattcatctttgttcgttttaaaccctttgggccagctataagctagtaggtattaaggtgttgatcgatgatggataaaattgagtttgtaaaaaaagagatggatataactgagtttatgataattattcgagagcaccaaatgaatgaattaaataatagagcatcaaaatgatgatttaaaaagaagtacatactataagaaatgctagtgattttttttaaaaaaatcatattaattaagtttaagcccacaataattcgtcgtccattagctcagcaattctccttctcgttcgttcttcctttcttcttaagacatctcatgcatgaccttctgttgattggtccatcatattttatggaatgtgccaatgtagtcgacgcatatgcgtctataaatagctggctcgtctattgatttgtgcagtcacccggcccacaggccacagctactagcagcagcagcaagactgcaagagggggggaagaagctaggtagctagtagtacgatgcagcagccgcaggcgagcagcatgacggcggcggcgaggaggcggcagctgcagggatcggtgctcgccgggaagatggtgctcgtgcgcaaggctctcgacaccaacttgaactccggcgacgtcgtgtgccagctggtcagctccacggtcggcgaccccggtgcgtatctggaatcctctttcctctttctcttaactagcatggtggcccgcgtagattgcccggcgagcatcattatattttctctcatataatagtatatatgttttctcaatgtattattcaaatatattaaaataccaacataattttaaaattttgtattacctttacgaaactactaatgtataatatccatattgtattttataaacgtgttagttattagttatttttaatatcaaattttagttatttgtaaattatattccaatatggactctagactcatctttcaatatttatttttttaatttcgaattttcgttatctataaattgtatttctttatagactctaggcacttcttccaatattatttatttttaattctgactttttcttatttctaattgtatttctatgtggactctaaactcatcttacaatattctttaatttttaatttcgaatttcagttacttctaaattgtattcttatattgactttagattcttcttcccatatttttttaattttgaattttagttatttgtaaattgtatttttatacgaactctaaactctacttttaattctattatgtttatttcgaattttagttagttttaaattcttatatggactctatactctacatcgaatattccttatttttaattctgaatttctattatttcttaattgtatttctatacgaactatatactctacttataatattccttatttttaattccgaatttctattatttcttaattgtatttctatatggactctatactctacttctaatattccttatatttaattccaaatttctattgtttcttaattgtatttctatatggactctagtgtcctcttcaaatattccttattttttaattccgaattttctatttttttctcaattgtgtttctatatggactctagtgtcatcttccaatattccttattttttaattccaaatttcaactatttctaaattgtatttctatatggactcagtttttctttttctctaattaatatgagaatttctaggctatgggagcgaacgtggaggctcctttttctattccttaaataagttaatagatttctaaattgtatttctatatgctcagtttttctttttctccaattaatataagaatttctaggctgtgagagcgaacgtggatgctcatttttctattcctttaataagttaatagatttaatttacaagtcgaatcctgcacatttcgcgcaccaaattcacatccatacattgatacatatctgcacacagctagagaaattgaagagctagatcatacatagcgcgaatatatacattttaccaccgtacgcatccatatcgtctatgtcacgcctagaaattcactagtaatttccgaacttatttgtgcattaaatcctcatccagtaatcagccgaggtacacaaactgacaatttaatatacagattcatcaagttaactaaaacgataaatacttacataagaggcacttagtcctcacaacgaagaaaactgcagcgaaaaataaaatctagcgaagctccggctccactcccacaggcagctcaattggggtataagccaaacgtcttctccttcgcaacttttcttcaactgaggtttgattgattattgcaaggtgagcatatgacatactcagcaagccaaacagcaagtatgcaagtgtacaaggataccaaagaatggcataatatagggctcatttgcaaaagcagcatttagcagacatttgagaattgtaaaacagtagagtaattaatcatcaatattaatcaacactgaacagcacacccatgctgcacaggccgaaccatcctgaacaaccatacccggctgtacagatctatctccaaaccaggaatgtaccattccaaaccaggagctaatcaaattattaccagttataatatcatttattatggtgagaagtgtgagactaatcacgaaaggcattgttagacccgcccatgaccgcgggcacggctattcgaatagttttactctggccagaggtgtaccactgtacccacaagacacgattccacacatgttactatgccctaaagtaccaccacggcactgcaaagggggaaatcgtgacagtacccttcgcacaacacaactcaaagtagtgcactgttcctggattataatcacccccttataaaacaaggcatggactccccagcgacccccgtgggcttatctccgccacttctcagtctggtgccccgcaatgaaccatgctatacaaaagataaagccgttgcccatgctggcttatggttggcacgggttaatatttcacagccgaaactcgtgaaccggtccttaattgtcatgagcacgaccatcaaaaccatgtactcacaacccaccattatcaagttttagttggcaattaattaattcacaatcacgattgaccatcgtgagctacaattaaatatccatcattaagtaatagtgaaacattagttatctcaatagtgtgctaatgtttctaagcatgactaagcaattatatctaatacatctagctgaaccaatatataaaactcaactagtcaaattataacccgaggtaatcaagaaatagggtaatcaatgcaaattggccataacaaaggaacaggttcacgccacccggtgacattcgaaaataaatgcacagttgaaataaatagagaatttaaatataggatcaacatgctcaaaggaattgtgtttgggatctatgtgacttgtcttgcaataaagggtcttcaattaatcttcttgaatactcccgacgcactcacggaccttcgaaacgacagaaacgacaagctaacacgcaaaacgagaaaaaagactaagaaactccaaataaacagtacataaaagtaaacaaatatgtagatcatgattttagatgaattatgaaacttgaacggcctcattctgacttcatatgaattagttatgaattttacatgatttaattccaactaaacctattaaagaaaagactatttcaaattaattaaataatttacaaatgatttataactgagataaaagattaaagcaacctccggaaaatattagattatatttggtacatgacatatattagaaagaaataatatgccactgaaaagagagaacggatttatatcaattttggacggctgagattaatcttgaccgagagttgaccaagatcggatggcttagattaatctggcaagcgagcctcacgagatatcaactcaacgagtcaattctacatgacacatgatcacctaaatgatcaaccgaaaccggcgaacggaattggcggctctgaactaaaggacaactcgacacggacgaatgaacgaagcacggggaacacctcgtttgaacgaacgagcgaacgactcaacaacgtctgcggctaaaccggtgagctagacacgattcacggtaaagccccggtacggcaaacgataggttggtaggaatttagggatgcacctacggctagacaacttgactactgagcaacagctaaagcggcggttaggttaaagtggcacacagctgcgacacggcggcactagggcgacttggctcagctaggcggcggcggcgacacacagctacggcagagacacgcggctagggttaaggcgatggcacagcgacgacagatggtggctacggtagcgggacagcagcaacttggcacgcacgagcagcagcagcacggctgtagcagggagcggcacagcgacggctaggcggctagcgcagcgacgatgtacagcggctaaagagcgacgcggcggcaacaaggtgctggcggcagcggcggtgcacagggcagctgccaagtgacgcggcagcggctgcgctagggttagagcaacagcggcggcgacatgaccgagggattgaaacctaacccgaggggacacggatagaagtctcgccgaaccaaatcgatcggagagggagggtcgatgatgacgacgctagacaaacaacggattagattagattggattaaggccctagggaaaaaaatctataccggtgaacgtcataggagcggcggttgccggcgaaccacggcacaataatgcaaacgaatgcaaacgaagggcaccgggagaaagaggaggcaacagcgattcttaccaacacttacgcgacgacggacagctacggaagatggccggcgacgagatcgggacggcggtgagatactgtccacggtggcgacggtgtttcggcgaccttcggcgacaacggaggggtggacggccttcggcttggtgctgcgatgccgacgacggcctcggggtgaaccggcgacgactgcaacagcaaggaggctcggccggagatcaaaccgaggaggcaaactcggccttcacggtgacagcgacttccagcgagacttggcggaggggaaccggtagacggggtagatctcgaccttgcggagccgatggaggtggcggcgcaggagggcgacggcctaggcgacggcgcacggctgctggagtggcggccggaggcggcgaagcttggattcgagtcggcgaggtacttccagaggtcttcggcgtcggggaagtggaggccggtcttcctctccttcctgcgaacccaacggcggcagcggcaaccgaaagcgacgacagacgacgacgaacggcgcggctggagcggcgccggcgcttggagagagaaggagagcgcggggagagcgattccggcggcggcggaagacgggacttgagaggataggtagaggacgactagggggtcctttatatgggcacgggagctcgggtccgggcccaagtcgacgggaaaactcgggaaagtctagggttctcgccggaaaaaggaaagattgaaccgcgaaattggaaaggatttccatagaaacttttggggatttcttggggaaaaggaagaggagattgagaggattccattcccgcaactaatttggaaagaggagcaacggggaggtcggatttggaaggggatcggcgcggcggcacaggctcggctcgggctctgtctggaggttgaagatagagtactgtagcgccagggaagtcaaacagacttctctgcgggctgactaggaaggaagattttattgcttttccaaataaattaaccaatgagatgatctttcaattgttaaaaatacttccaatgcttaaataattctaagaaaaatctttaacatacttggacactcaaagtatttattaaaatttaaaccagctcatttcatgattaatttaatatgtgaataattactgaaatattctttgtattattaaaattaggaattgagctctgaaaaacccgagaaaatttcagagagtataattaatcatggagaacttaatacaaattaaattcatccatactttatatttaggaaattttattttctacatttaacttcacttgtaaattaataaacatttaatataaattctattaataatctattaaataatttataaatcctaaagcggaaattcaggctgtgacagtctatgtcccagggaaacatgagcactcatgtcaaatttaatactttaactcgatccgatcggtggttatgtttgatcagttaatatatatatatatatatatatatatatatatatatatatatatatatatatatatatatatatatatatatatgctcagctcatcactacaatataatcatttcttttataaaaaaacaacattctttcaactcatttttcaactctattttaaacctacaatcccttgtatatatggacgaagagagtataacgcgctagcaatggtacatacattttagacaatggcaacagggggatgttgggccaggaggcatgcgtccatatcaactcggagctacacccaactccctacgaggcctccacattcagcttcgagttcatctgggacatgaagaaacagggtgtccccggagcggtcatcgtcaagaactattgcgacgaggagttcttcgtcaacaccatcaccctcgacattgtaccgggctatggaaccatcgtcttcaccgctgagtcgtgggtttaccccgacgagatatacgaccatctcccccgtgtcttcttcagtaaccaagtaagctcgtcttgaaatattctaccggtcatgttttatgtactttgtgaattttgatcgagaattgtccgtacatcgtcactggtatacccatttttgtgattttgaaatgacaacgtcggatttggcactttaattgtttatatgatcgtgggttaagttgtttacaaacgttatatatgatgaaataatataatataaattaatgatcaaaactctatgtaacagtatacttttacaattcaatactccctccgtcctataatataagggattttgagttttcgtttgaactgtttgatcactcgtcttatttaaaaaaatttagaattattatttatttttttgtgacatactttattatctaaagtactttaagcacaacttttcgttttttatatttgcacaagttttttgaataagacgagtggttaaacagttcaaccaataactcaaaatctcttatattatgggatggagggagtatatttctataccagcagtatatagacgggcaaaattataaattttatagaaaattgaaaagggctttctagtaattttgtggttgagagagttaatcggttcaattgggacttatatataagcgtttaaaaaatatatgcaactttatactcaagttatgtagaggtaacaatatagttagatatagatgtggtgtaattacactatagtttttttctcgaacgcacaaaaggattgcacgtcaatatattaggtaattatactatagttacaatgtaatgtacattatagtgttattacatttgaaagttttttacctaaaaaattcgcgagaactttaagcaatttccaactgacatatacatgtacttgcacagccatacctgccaaaccaaatgccggcgccgctggtgccgtatagggaggaagagctccggaacctgagaggcgacgacaatccgggcccgtacaaggaccatgaccgtgtctaccgctacgacgtctacaacgacctcggcgagccagacagtggcaacccgcgccccgtgctgggtggctccgacgagcacccttaccctcgccgctgccgcaccggccggaggcggaccaacaccgaccccgactccgagagccgcaacgtcggcttccccctaaccaaccatttctacgtgccccgcgacgaggtgttcaacgaccgcaagaaggcctacttcgacaccaacaacctcaagctctatatcatgcaaaagtacgccacctttctcttgcacgccgaccagcagacccccttcgagttcgacagcttcgccgacgtgctaagcctctacgacgagggctccatcaacctgcccggatggctcaacactttcctccaaccattgctcggcataatccccttcaagttgctccagcaagtcctcacccccgatagcgagttcatcctcaagttccccatgccggcggtcatcagggaggacaagacggcatggcaaacagacgaagagtttgcgcgcgagatgctcgccggcaccaacccggtcgtcatccgccggctcggggaaaccgagttcccgcccaagagcaagctagacacaagcaagtatcacaaccagaacagcaggatcacagcggcacacgtcgagaagtgcctcgaggtcgagggcctcaccgtcgagcaggtgctagccgacggccgcctcttcatcctcgaccaccacgaccacttcatgccgtacctgctcgatgccaaccatcaacccgacactttcgtctacgcgacgaggacactgctcttccaccgcaacgatggcactctccagcctgcagcaatcgagctcagcctacctcgctttgaggccggcagcacactcatctcgtccgtcggcgaggtctacacgccggcgtcagacggcgtggagggccacatctggcagcttgccaaggcctacgtcaccgtcaatgactactcgtggcaccagctcgtcagccactggctcaacacgcacgcggtgatggagccgttcgccattgccacgcaccggcagctcagcgtggcgcaccctatccacaagctcctccacccgcactatcgtgacaacttgtttatcaacgccctcggccgccagagtctgatcaacgccggtggtagctccgagaacaccgtcttcctcggcaagtatgggctctccatgacatcggaggtgtacaggaactggaacttcaccgagcaggcgctcccggaggacttcatcaagaggggcgtcgccaagcgccgctccaatggcgagctggagctgctgatcaaggactacccgtacgccgtcgatgggctcgccatctggtcggcaatcgagacttgggtccgcgactattgtgccatctactacgcggacgatgcggcggtccagggcgacgccgagctgcagtcgtggtggaaagatgtgcgcgaggaaggacacggagacctcaaggaccacaaatggtggccggagatgaagacggtggccgagcttgtccagtcatgcgccaccatcatctggatcgcctcggcgctgcacgcggccgtcaacttcggccagtacatgtacgccggctacgtcccgaaccggccgtcggtgagtcggcggccgatgccgaagccgggcaccgacttgtacagggagctggagctccacccggagaaggaattccttctcaccatcactaagcaggacctgtccatagctggcattgccctcgtcgagctcctatctagccattccgatgacgaggtctacctcgggcagcgcgactcgccgaactggacgtccgacctggatgccatgaacgcgttcgaccgcttccgtgaacggctcttggaggtggagaagaacatcgtggccaagaacgacaagggcagtggattcaagaacaggacagggccggtcaacatcccctacaatttgctcttcccttatgcctccggcgacgcggaggccaacaccggggtcaccggcaagggcatccccaacagcgcttccatctgatcaagcactatactatacaacaagggcaagcaaggggacacatactccttaattagcaacatttctcttctcgtgtaatgtgataattcagtatgggtcataagtttgtttatgcaataaattaaaataaaatcggactacctataaaactgtcaaaagaaaatttctctaaaatatttcaaatgtaattatagtgtaactatattataattcaggtgtaaccgaaatgtaacttgtctaatcttatagaaagatcaagtggctagcatgcatggtttgcgggagcgaggtctagcaaatctgaaataaaataattcagtaaatttcggtgaacaccatgcccaccatgaaaggccggaacattaattatttgccacccaccagacccatatgttattgacacgtgaagatccacatgtcattggcacatggatgacaaaataattaaacactaaatctaagagggcaaatagttaaaaaccgtccctaaaacactatcatggaagcttacttctttcacatgaaggtgaacctaggcctgaggcaacctacgggacgaaatgcccattatatatacatttcaagttttcactatactagtataaatttaacctagactagaatatgatggtttgggccttggtttatactcgtatttagataagaaaattgcatcgataccccgctataatattaatgaaaatttcaagaatttctctgtgcagagactcacatgactataaaaagtggaggatcttgaccccacctaatgttatccctctatcttctcccttctcaccctcttcccatgttctcgtggctggtgaggacgtggcaccaacaagctgcgccatcgctggtaacctcgcgagaaaggcatctggtgagcgctggacggggttgaaaaatgcgcagcaaaatgtcacaaggagaattggaccgaaaaaaaaaatcagatgcattgaaattgtacaacagaaatgcgatatctatccacataaggatagccaaatgcataaatcaatcacacaattagaaggaaaacggatcaaacacaaataaaaaacaaaggctcatctactgtaacacgggggcagctagccgttgactctaagtgtttcttttaataatgggaaaattgactctatgcgctgaccgcaagagcgggctaagaaattcaagtgtgtgtattcaaaatgtgaaaggataaaaaagatcctttcgacgaaatttaagagtgtgtattcaaaatgttaaggggtaaaaataattctttcgacagcttaaaaacctaatattgatatgtataatagcacatagtactcatggtataatatatttaatactaactcttggcaatggccggtatggtctcttttttaattttttatacacatatgcattatttcctgtgtattatctaaattatttttatcaaaattcctggtattcatcgaaataccaatgaattaattaagctgggcccgcccataattacgtatctatgaatggctgcatgttgtctcgatagagtttagaatttttcaaaaaatatcagcaaacaactggtctgttttacttacgtcatccacgaaccatcaaatttgaccaagcagtggtgctacttttgttcaggtcgttttgctttcaatactattaagaaagaaaccatcaatattgaccaaacgatcggaccaaagcgaaagatatactccctccgtctcaaaaaaaaaaaagacaaaccctgggtttccgtgtccaactttaactgttcgccttatatgaattttttttataattcgtatttttattgttgttagatgataaacatgattaatattttatgcgtgacttgtctttttaatttttttcataattttttcaaataagacggacggtcaaacattgggcacggaatctagggtttgtctttttttggacggagggagtatgcccttaggctgcatttaagagttgaacaaagagaaggtcacgcgcaagtttctcgaactgctaaacggtttgttttttgaaaaaaaaagtttctatagaaaagttgctttaaaaatcatattaatcccttttcaagtttaaaagtaattaatacttaattaattaccatagcttacatcgttttgtaagctcttcaccatgcattgccatgtcatcgtacctcttacctcattctcatgtggtgtatcataagtgaaaactgaaaaagatagtataaaacagatgtgacgaacaagatgatatacgggataagaattaagaaaaacattctgtcaataaaatattaagtttaagggcaataaaaaggatgacaaaagaaaaaaaaagaacagtttgtgttattacctcgtcctttcccggacatctaccgtggttgatccttctactagcagtctaacacagcctacaatccttcaaggatgataaaccgtagacatcctcttcactgatcaaatcagacaaagacaaccaatccaatcagcttaataaccccaaaattcccctcgcgcgttcggcgttccccctctccaaaaaactcaaaattcaaactcacacctcaatcaccctcttccaaaaatttgaaccgtacatatgtacccaaacaacgacgtctcaataaaaaaaaaaacacatcacatcgcgccccacgcccccccttcgttacccccgtccgtccaatttccaaccaacggttggccccacccaaccccacc

SEQ ID NO: 11268 - DNA, 17415 bp, Oryza sativa
ctcaccagtacaacgacgacgacgacgacgaacaccaccccttcgacgaggactaccctcccataaactgcgacgagcaacctgcctcctccgatgtgggcaccccgcgcacccaccacctgctcaacagaatgcctggccgagcctcggccgccgataagggagtcatctcttcatccagcacaaacttgtttccagatgacagtggcattgccatggatgatgaattccctctcgtcgtggaccgggaggcgtcagaccagaaagatgactgtcaccgggtgtacactgtggatgccgtgcacgttgtgcctgtggctgagcctaaaaatccttgctactttggaacaccaattggtggcgaaatgagccacaggggtacgattggtactcgggctgaggaggaggaaatacagaagctcagtgcaagactgcaggctctggaggcagaccgggagtcgatgcggcatgccatcatgtcgatgggatctgagaagcagcaggttgtactgctcaaggaaatcgcgcagaagctctgcaaggaggcagcaccattgcaagtaattccatttaaggtgcggtcgccaccacaaccagtggttatggcacagaggaaggtggtgaagaggcagagtttctttgcgaaattctttgtcgtcgcggtgattaaggtaactttgtgcaatcttgttcttctagggctgatactgagtttgatttcttgaggaagaatcacagaatcattttttgtttgttttaataattaatactagctttacatagtgagataataatttagacatgcaggagtcagtagtgtatcttattatgcttgaatttggtcacaaatggagtgttcttgcttgataattgctcattgaatgcactactttattgaattatataatatataggtttgtatcattagctcgattgcattttacctgaagcatccttaacaattttgctagcttaacctttttgtcatattatgttaaaacactatctgttaaaactgcgataaactgaattttgcagatcattgcatattttattttcattctgataataattgtgataggtgcccaaatatcatatcggaactctatggtattgttgaatgacattattataatactcattgactgtgactataatgttagttaactatccttctttttgtttttaccttttgttgtctcatctcaggcaataattatcatgcactgaaaggaaaacccttttagctgcgtatgtccgtgtaactttagttaggtgtcaaatggtcatttggtgcatggtatgcttttcagaatccaattgctactaaactaaagggggctacaaaaaaattaatgaacttaatgtcttaagtcattatacgtacttatgtagtcataaggtttctgtctgttctttgaagtagtgcactaaagctgctaaattgtgagttagggcatcatgcaatggtcaacagtggtttttcacgctccttatttcacctgagttttgtgcaagatttatgaaatattgcttcctacttgtttctttcaccaaaggatatttgatgaaatactagtgatataacccaccataaatggctgtctgtcaaaaatgaataactattccttgcaagcaaatttccagtttgatgagatagccggttgttgctgttttgtgacaatgtttctttattctaccttagtaccgaacacctggaagaaagtacagtctgaattgctttgagaacgaggaatcaagttccatcacctgactagacgatgattctttattctttcaatttattctgttgttctgtgtttactatagtttgaggccaagtgtgctaccaaatgtgaaggaaagcatgtgaccttacttaatcaacatgggtctgtcagaactggatcatggctgaaaattaactaataaggataaggtttgaccgacaatatgcgctagagcctgccacgtctatgacagtgcctgacagttgtgcaaatttcagtatgattgtacttcgtaaaaaaataatttagtcaatttatgcccatttttttatacaaagtatcccacctgcctgagattgggaggggtggatgaataagaaaaaggaagggcatatcagttaagttagaacaatcttaaaatttacattttgtttccatctttggaaccatgcattgcttctagaagacattaatattaagatgttactctcacactgtattttctttgctgatttgcttatttgatgtttcatccagtggattgcctctgtgtttagctggcggaggaaatcatatcgcgtcaagtgagttgccctatcttgctcggttggttaatctctcggtagtgttttttttaatacctaaccaccattggcactgggcatcaattgcaggtacccaatcggtttgtgtgggagcaatgttggcctgatgctgctactgaacaggttccccaagcagaggcacagaaggtacctcaaaagaagctagctgctgccttcactggtcgtagacacacaaacaagggaaagattctgcggcgctcctacgattctctcctccaaatgagctattttctggacataaaaggctcatttgcatgtgaatccattctggttgttgcatatgttttgacccctttgtctatgcattctttggttggtttggtatgataatctagctcagaattgaagcctcgttttttcgcccatttttgctgcctgattttctccgtagtagttgattctttttgtacctaccactcacgtgttcaaggacgcactgtacatggtcaataaccagtaaacatgtgtagctctattagaatattatgtgtgatctgatgagatccaacgaattacacaggtgaggctctgttcggtggaagaattcagatttcagagtcaagacatgtgcttgaaatgcagtggtcagaacagacttatttaggcttgtttagattttctgttttgatcataggcttgtttagatttagatatccagtacgccggatccaactaatgctctcgagtatttctgggtcatgtcttgaattttctgtgaactcttgcatctgcagtttgaaaatagaactgtctgcgatagtctattctctgtaatttacttagttgtgggtttttaagaaaatttaattttaagatatgcaataagttttcttcttggatttggagttcatttggtaatctcaatcgatcctaatcaaatgcgattcaaattcgtcatatattcattctaatcctccaatcaaatctaaatgcatctcaaaccaaaaatcaagttgtggtctaaacttatatgctcccggatcaattttgaaatgaaaatcgtgctatcaaatttttgggactaattatttcttttgggctgaattccattcggcccaaaataaaaaagaggtccggctaggctgcaaacaagcctccgatggccttgaaaaggggaagaaagaatagctgggctaagaaaaagataaggccgaacaaaaggacaagaatcggactctgaataaaaaaacaatctgaaattcgaaggcaactccggctgggacgtccgatgtttcggggaaaatcgggcgcacccgatttacgtgcaaaaactactttaaactgatttttctcttaaattacttatccaaatcatgattcgattgcaccattaaattcgttgcaattaaatcttcaaaacaaaaccacacatggatatattccgatgaaatttttttagcttattattgaattatttttaaatgttgcacgatgttccaccaggtatatcggaattgtttcactaaataaaccgaaaatgtttcactcgttaaatctggtgttgtttcaccttatataaaaataatgtttcagcaaatagcgaaagaatgtttcatttcactgcaacaacattataaatacactaggtgaaatattttttggtgaaacgaaaaatgaaacgaattcccttaatagggggtttctaaaatatgtgggttttttttgttgtaatggaatattttagttcaccgcaacattagatttatatatagggaaatattatgagtacactaggtgaaacatttttggtggaacaaaaaataaaccaaattcacttaatagggggtttccaaaatatgtgggtgatttgttgcaaccgtgcattccataatatcaaaatccactgcaacatttgatccgtacatagtgaaacatcgcaagcacactagcagaaatatcgtaaaactactggttgaaacatcaaaagagatcatatgcaatattaaaaaaaatatcaatagaaaagctaaaatatttttttatcgaaatataatcatgtgtggtcttgttgtaaaaatttaattgcaacgaatacaacggtgtgatcggatataaccatgtaagatcttttatataaagatttaattataacgaatctaatggtataattaaatcgtaggtcggataaataattgtagagaaacatgtatttaaattttgaatatttgaatatgcatggacgcatgcacttgacgtgtgctgacgtgtactagctccctgcatgcatgtgaggacttctgttgtctcgggtgaagaggcaccattactaccgtccgatttttgcgtcggcccagatgcccgatgagaagcattctcgctgaaattccatctaaaactcgagaatgctagttctcggtcgatcggcgcgggtgcgttaaatcggacgctcgcccgtgtctcccccatggggcacacccacatgtctcccctgcccccacctgccacttccacacacacaactccattgtaacaaatcacccacatattttagaaaccctatattaggggcatttggtttatttttttccaccaaaaatgttacacctagttactcacaatatttcactatgtgtacatctaacgttgcagtgaacgaaacattccattgcaaccaaaaaaacccgcatattttggaaaccccctattaagggaatttggtttatttttttttccaccgaaaaatgtttcacctaccgtacttataatgtttcactatatataaatcaaatgttacagtgaactgaaacattcttttactatttactgaaacattatttttatataagctaaaacaacacccgatttaaacgagtgaaacattttcggtttatttagtgaaacaattccaatatacctggtggaacatcatgcaacatttaaaaataattcaataataagctaaatttttttttcatcggaatatacccatgtttggtcttgtttagaagatttaattgcaacgaatttaatggtgcaatcggatcatgatttagatacgtaatttaagagaaaaatcattttaagtagttttgcacgtaaatcgggcgctgacgtcatgctgacatcagcgcccaatttttccccagcatcgggcgtcggagtccgacgcgtaggcctcccctctaaaactccgcagaaatgctgaaaatcgggcgcccgatgggagaaaaaaaatcggtcactccccccaccccccacgacgcgtgtcgccctgcacacctgccacgtgtccccaccacatattccgttgcaacaaatcactaatatattttggaaaccctgtactaagggaatccgtttcatttgtttttgttcctctaaaaatatttcacctagtgtacgcacaatgtttcactatgtatgacctaatgttgcagtgaattaaaatattcttttgcaataaatcgcccgtatattatagaaaccctctattaagggaattcgttttattctttgttccaccaaaaaagtttctctaatgcactgaattgaaacattctttgcagcaaatcatgcacatattatggaaaccctctattaagggaattcgttttatttttttccaccaaaaatatttgatctagtgtacttataatatttcactttgtatggatcaaatgttgcagtgacttgaaaatcctttcactatttgctaaaacattgttttcatataaggtgaaacagcgcccgattaaaacgattaaaacattttcgatctacctagtgaaacaattctgatatatttagtgcaacagcgtgcaccatttaaaaataattcaaaaataaactaaatatttttttcatcggaatatatcaatgtgtggtcttgttttgaagatttaattgcaacgaatttaatggtgcaatcgggtcatgatttagataaataatttaagagaaaaaaatagtttaaagtagttttacatgcatgcatgcatgatgacatcatgctgacgtgggcgtccgatcttttgcaatagatcggacgtccaatttatagcagcctccaaaactccgggatagggaaaaacctcttgggttcatcgaaatttctgactttttgaaataaaatgacagattctgcataaatcgaaaaggaggaggatgcttgcgcacgaacccccaccttgttgatgatcgccaccgctggagggacgacggcgagggtcaccggcgagtcacctcgtcacctcagttcgacgtacgtcacgatgatcgccgctcccgagctcttgccgcagtggagacacacgggaggtcaccggagagtagctgcccattcgtgcccatcgcgccgccggggaggtcgcctcggccggccactacagttgcctcaccggcgatgatggcctcgacgagaggagataaattttgctccggatgatgaaaggggatttgaacgaattgaccaaacatttgacccgagttattatcactgacgcattttccgaccaaacgtaaaataataggcctacaaatcaattatttggacttaaaaataacctcagacttaaacttttttctcagacttaaacttttttctttgagcgaaaggcaaagcttgcctattcattgaatatagaagggcaaatttacaagtcaggaaaagaaagtaatatttacaaaaaaaacggtcggggactaaagtaacatctctgctaggcgtttggctcctgccgtagctcaagattttacctcttcctttatcttcgggattaggaccaccgtcgttagctcctgtttcagaagatgcattggttttactccttccaaatgccaacaacagtatcctaaacatcaccaacggtatccttaaattctatcatttaaatattgtttagggggcatgtacaatgatgtgtaataacgatctctcttcgttgtcatgcaagtaaaattagtgatgtaggaaagagagggggagaaaagggaaacatggagttgactcttaacatttattaaaaaaaaattgttgcatggggtggagaaaagaaaagaagggtagtaaaaaagtatattttagtgcattaatggttaagaatttttattgcctcaacttgtaggagtatagtttctaagtgatatatactattaagtaagaggtaatacctggcctaatggaaatcctaagcaacagaatttgagatgtgaaataataatctcttgaagagattggttaaattctacatctaaaaataaaagtggggtcccatacaacaaaactacaactgaaatctgtttccttctccctcttgcgatcgagcttgcccacgcgacctgtgatgatcgcagtgtcgcgcctctccggtctccattcaacgtgatcaaagctcggcaacagcaatcagctctagccattagcaaaataactatcaacaccaaccagcaagcagaacattagtagctctagaaacttgttagcaactcagcagtcagcagcataagcactaccagcagcagatcaggtacacagatttgactggcacctacaaatagagaaccaatacaatgtcaaaaaataaagggtaaactaacatacaaaatttgcatgccaagaaccatctatttattcctggcattcttgttagacaacaatggtgcgattttagcagcagcatcatcagcagcagcaccattaatcattaatttccgctgtaggtttcgtccgaaatgcgctcggcatctgtcaggacgccgccattttttacacagaatggagaactaggaacagcagcaacaacataacggagcactattattttccctcagcacatagcagcggcaacaacaagccaacaacaaaattaaaccaggaagcaatagcaacatatactagccgtgcgttgtcgcatcggcgtaggtcgccacggaagactctctgccgactacgtgagagatgtgtccgacggttgggtagctagagggcttctttacttgtggagagagagaaacctggagatgggaattctgattttgggtcaccattggatcgatttttttttattttacaaaacttcaaattattggatagggatttgttttgggtgctgcaagcaagaaaacatgagaacaatcttaattggacttgactgtgtctgggttggaccgatcatcagatcctatcactagaagggataccatcatctcaatcgagcggtataccccatctcaatcgggcacggcgtctgtcacagactagaagtcacagatgtgaagagttatctcaatcgggcaaacggccgtcacggatgaatctatctaaatcgggccctaattaaagcccgtcaccgatagctttgacccagacgactagtcaaactatagcccgtcacggatgacctatctcaatcgggccacaactagcgcccgtcacagatgacccttatctgtgacgggcattaactatagcctgtcacagatgacagcattaactatggcccgtcacagatgaccctcatctcaatcgggcctaagttaatgcccgtcacagatgagtataatccaaaaataaataaattttattttttggctagttttaggcctctaggccagtctttttttgtcctaacttgaattcaaacttcccgatcagtcacccatcctgaaattgttccaagccgagcacgctagattggcttccggaaaagtagttgtaacttgttggtatgagtattctattaatcttattaagccctaagccaggatgtcaaattgggggttattaaatgatttcaaatggaaaagtcaccaaaaccaaagttgtagaactcatcgaggtgtaaaatttttattttggtcatttctccatatgactctatttaaacaatttgaaattcgaaattcaaagttttaaaagttcaaatagaattttagatcagtgaacggcttcaactgaaaaagtcataaacaagaaagttgtataactcatcaagatctataacttttattttggtcatttttctatataacattttttgaaccatttgaatttgaatttgaaaatatgacaacttcaaacaatattgtcaaatactaaatgatatcaactgaaaaagtcatcaacaacaaagttgaataactcatcaagatctaaaacttttattttggtcatttcttcatacgacaaagtgatagtaacattattcataaaattgacatatctcttatctggttttataaactataacacatatatgtaaaatttatgaataatattactaacatttcgttggatgaagaaataacaaaaataaaagttttagatcttgatgaattattcaactttgttgttgatgactttttcaattgaaatcatttagtatttgaaaatgttgcttgaatttgttatattttcaaattcaaattcaaactgttaaaaaaatgttatatagaaaaatgaccaaactaaaagttgtaaatctggataagttatacaactttgctgatgacattttttccatttgaaatcatttactacccccaaaattattttgactcataaaatgaattattatacttcacttaattattttgctatagttcaacttacaaatataaacatttcatatgaaaaatgaaaaaatagtcatcggtgacaggctttagttaatgcccgatagagattaagtatatagcccgtcactgatgagtcatctgtgacgggcctagttgctatctcaaacgggcctcaagttggtgcacgtcacggatgatggtcatctgtgatgggccacaacttgaggcccgtttaagatatggaatgttatctcaatcgggcctaaagttggcgcccgtcacagatgatggtcatctgtgacgggccacatctttaggcccgtttgagatatggaatgttatctcaatcgggcctaaactacggcccgtcactgataggtgtcatctgtgacgggcttaagttttatgcccatttaatatgtctgtgcgaccataactcaatcgggcactttttggcccgattgagatgacttccttgtgacggcatgctatttctaggcatattagagcccgtcacagatagaaggatctgtactagtgtatatcggttcggtcccatgccgccagtcggtctagccctgtgcaaaaggcttgggtcttttccaaatctgacctggacttgcgataaatatatcccagtgctaaatttggttgccaacatatataattcacgtaccgcggttaacagtgaaaacgggaaaaatacatataaattttctagaagtttcttaaaaaatactacttaaccgctttatcaatcaatgcacaccagcttagtaaaataaaacagagcggttatcgccacaattttaacagtccttaccatggtatatgtgtccgttgataaaacataccttctatacatggtttaatgtaatacgacaataccatatatctaatagtatacgagaaggtatcctataattaaaggaaataaggcaaataaagatagaaattatcttcccggactggaatgtgtaagagtctagtcgggggagataaggtttgtctctccaagttctacttggataagaagatgaccaacgtattaaatagaagcccccctctcatccagcaagaagcatcgaattataagccatagccaaagccacatccagaagtaatccggaggaagccagcgccttattcgccgaatagatcttgttaggtcgttctcgtcagcttctagtcgacggattcatcaagtcgtcctgttccccattatactttgtgtggtattcccatccataatacatataaactgaagtatggttattactcatcttgaggacatgaaccaatataaatcattatcctttgtctgtttgatctgatcttgagtataccttggttcaaacgatccccataccctgcaaatattgtctttgggtatagttcgtcgacaatatgttaaacacatttttctcacacctctaaataaacgaccatttctatggtactttcacactataagcatatatataggtcttgtttggcatagtccaaatattacatccatgttggatttgaaatttgtttgttaaattatagtaatttaaattttatatttcacttaaaataggagaaaaaatgattcatcgaaatgctttcaatgtaatcgcggatccagatttataaatatgtgcagttagaaatacctagctctaaaaaatcttggatagagatgtgccaaacaagaccatatgcaacaagcatctcctagaacatatggtcttgttgcatatggtcttgtttgaatattgcaactagagatcacaaaaattctcaacactatatacttctaacttgtaagtccaatgagcatctaaactcatcccatcactatttgcatgtcaggctggctacatagaagggtggcagaatctccataggggccacggacctcccgaatacccaccctatgggcccatgggcaagtgcaatttccaacttgctagtccattgaggtggggcccaatcaaatgcgtaacagttttcacccataggttaactacagtccctaggatataaggcccatcaacaattgcttatgaaagcccatttctacaggccaaaccctaggtgttctagttataaatagaagggtgtgaaccctagatcaaatccttcccaacctcctagccgccagcgccgtcaggccattagcacttgcgcaacccactggcctcgcagtcaccccctctctgaccggccgccaccgcccctctccatcttcctttctcatcgacgctccaagtccctctcctctactgctaccatgccggcgccccaatcttgtccaacttggatccgacccgccccgttgtcaacccaagatatatactgtcctaagagcaaaaaagaaaaggggtagctcgaagttgcggcggctgcaaaagaaaaggatgaagacttttttacctctagggttttgttcccctttatctccttgcatgtttggagcagatgctggagtgagctcggccatggcgacatcaataagtaatacttgttcatctctaaatcttgttgcccccgtttttcgcttatggaatttgttgagttcatttggatctgatgcttttcttttcaatccagtcttgtttgatatgattattggtacggctaggggtttcacattaggaatcaacttggtctaaagatcatccactggagaagttatgaaaaaaaaaggtgagtacttcggatccttttgtttatcttcttcttccactactttttttatgtgccttttcaagtttcttcgtgttatctagattagtgggtggtacataaaggtctaatctttttagatctactcttatttatactgatcaggaggtcatttttttgttaaaaacaacagatctagccatatgtgtttgctacatatggttagtgaggaaaataattcagaactttgtgtttaccttccttgtgtgttttatacattttattatatgttgaaattgatagttatagagattactatttatgtaccttaccttttctaggattaatctactagtgttgcatgggctattgtttagattacaaacatttaaaatttaataatatactgaatagattggttattttataaattatagttgcttagatttaaaaatgtctatataaattacaacttactaataatttcaaaatcaaaatgatacaatatatttatctaatgcccaaattttggaattattttttttcagaaagatatccatatttgttttattggtgttattttagctaattctggtcaacgcctctaaaaatatgttttctcaaaaaacattattccactacattgcttgaccatttttataagatatttctaaagttcctttctcaaatatttaatttatccctataataaaatagataattcgtaacaataatctggacaatagtctatgtcaaatgcaaaaattaatataataaactgaagagcccatagaatttacaacaatatgttttattcaagatgatttctcaatatgatataaaattttgataataccatcacaatcacctaatcaagaaatagtttgttttctagataaaggttaaggatttacctcaaataaatgatctatgactatggatataatctaccagctcgcacatcaatcaggttgtacatctattctgttagggcatgtactttaataataaactcactgtgttatcatacaaataaatttggtaacatagaatagaagagagaaatgagaggaaagagaaacattattactacacttgacaacaaagtgactcttagcattttttaacgaaaatttgttgcatgtgggtggagaagataaaaaatggtaaataaaaaaaatgttttggtgcattaatgatgagacctcttattatctcaactattataagatggtagtctctacctctacctttgtatgtttccaatttcagtataccgtataggattctactaccgattagcgattaatatacgtgactggataagaaaaacaagcacagttagagaaaatttccagtccggtcagtaaaccgtataagattctattgattgcttaaaccgtacatctattcaacagagataatttcccattcactaaaaccgtaccagatttaaccatttcttcatgtacgtaactggataggaaaaatagaaactaaataattttgaatgcatcgatacaatctacggttgtgatattacgatcattctaatcaactgctagatttttctagttgatatatgagctcctaaaaaatatctaattagtataattagtatagatagatagatagatagatagatagatagatagatagatagatagatagatagatatttgcttaacctttgtccatcagtgaagaggaaacggccatatatgaccatatggagtactatacattaattagtgcccattaggcattctcgcgaaaattgcactcacggcttggcctagctggtactacatgaattttacttttcacgaatatatgggtatatccggccagagaggcatatggttggcccagcttaattaaaatgattccccgcgccttactacagaaattactaagtaacttttaatattttttaataatcgagctaaaaaaattaaattagttattaacaacaaataaaactagtttgtcaaactatgttcaaagagaaataaatttagtagacatactctatatgagattgtagatgaaatatgatatcccacactttgattatatggatgaatatatgttgaatattataaaaatgatggatatatatatatatatgtttaaaatattatgaagaataatgtgaagaaagatgattgggtgttgatttgtagaattcaatgaattatagataatgttgcatgcatgcataagttttttatatagttattgctagtggatgatgatgtgacatgtttgtatgttgagttttaaaattcgtgggttataactttacagtaagataggattagcatggtttcttgtttttttttaaaaaaaaacccaattagggaactcatgaaatttagaactaattagtaactgaaaataatcttttccgaaattaaaacaacaacaattttatttcgaacatggtaaaataaacaaatgtcagccgagtttaggcctaactaattaattaagctaggttggtcaaataaatttggctcagcattgaacgggagtctaactttttctagacgatcaaagctcagaaaggcagaaacatgtataaatcttgtatttcataatgtgttaatctcggaacctaatgttggcccaattactttgtggttaaacagatgaggcagtactgcatgcacttagttcctgatgcagtaaagacattaactaatggttcaattgttggcgccacactaattcgatggattaattgtttatggttacatggcctctgctggtaaattggaatatgatctcacgttgcctgcatgactgcatatcaggtaggtgcttctaactagttgattttcctcttgggcaaaccccagctagacttccgcatgtatgtgttccatttaatgtttcgattatcatgttaaaaagtaaaccaaatatgtgatgtggctgtgcactgagatgaagacgctgggtgagtgtgctaggggtggcaaaatctctatccagaacccgcccttacagattaattaagaatagatccaatttttgacccgcggaacctttgagaaaatgtgagggtaacagtggggaagtggggcgggaccctgtacaggaataaggcccatcaagagtagctttccaattatcagaagttgattactactcgaccgacccaactattggattagatatagctgaaaataaaaggatgtagctataaaaacgagaaaactcaaatcatccttaagaggatatcctctcatttttacatatcacttaaaaagtcataaaaaaattgaaaaaacttaacaggatagatcaatatgtgatatgtcacttcacaaatatgcaaattcaaattcagcttatacaagtagaaacaaaaataataaatttgactatgaagtgaatgtgtaattcacggtcaaatttgttattttttgtttcgaattgtatatgtcaaattttaactcacatgtttgtgaaaagatatatcatagattgatctatcttgacaattttttaaaaaaattttgataactttttgaacgacatgtataaaacgagagtatgtccccttgatagacaaaaatccactttcataaaaacgctacatcaggttttcccgacctaggccatggatggttaacttggtttcccctttttttttttgggacagctcaccaagatagatacaaatatgatttcagtaatttatttcaatagtatattaaaaaattacgttactattttcccactacttaaatgatgagttgtttacatattgagtgtgtcagtactgactttatgcatttttgttttttgttgagaattggacaaaagtgtattgaatcacttaattaaacagtaagcatataaaataaatacagctaatatgatgtctatatgcaccttcttataattttgcatgcaaaattgaatcaaattatagggagtatgggtccatttgtcaatccttaccattgttctcatgcattacgcctgataagtatatataccgattgaaaaaatatatattaaaacaattatcttgagaatataaaactaaaatagaaagcatatcaaactaactatatcatccatggatgtatatccatgtctagatgatgtaaccattttttcttccaaaaaaaggtcatacatagaacacacatacttatcttcatggaccaatctgtaatcagctcatcatttaagtagtagagaaatactaacgtaaaattaaatatgctagtgaaatgaatttgcttaaatcaagtttgtatcttccttggtgagttgtcaaaaaaaaaaacggtaaatcaaagttgaccctccatgtccctggccccaccacgcagcgtctcacaaacctgtacgtgctgcaccatccctcgtgtggatttgttgtgtccgttgttgctgaaacggacggctcagatcgagtagaaacggacacaaaaaaaaaagaattcctagtcagtgattgcaatgccggttcgaaattttagaccccaccggcaagccattatctcgtccgaaattttcgaattttctcaattttttgtgaatacggtcaaaatttatccaaattcagtcgaaatttgttaaaaaatttatataatttcggcccaaaagtaccgaaaatttccaaattgcggtatagcactgaaattttgaccgaaagcgaaattgtaaaccctgttcctagtacatttaaaacctcccgcttcagcgtcgcctctcgttttgggaaagccttgatggcggcgtgagataatctcaagtgctcgtccagttccatcgattattcctttccttggattggtggagagatcgtctcgatcccctcccaagatttggtcgagcgatttcgg

SEQ ID NO: 11269 - DNA, 932 bp, Oryza sativa
gtgttcgtcgggctcgggaagggcgactgccgcgcggaggacgtcgtggagaagcgcggcgatctgtgggggaggttcggcggccacctgtggaaggtctacgacggcggcgagcgggactggagggaggcggttggcgcgctgtcccgtgctgatccggccgtggaggtggacgccgcgagccagaggcaccgcctgatcgatctcctcgagatcgtcgggtcgaggcttgggcggcgcgcggtgacggacgccgtccggtcatggcgcgcggcggcggcggtgcacccggagcttcccttcgcccgcaacgagcgcttcgtcgggagggagagcgagctgctcgatctcgaggccgtcctgttcgggaagaggccgatgcatctggtcgaggtcgaggtgttctgcggcgagccggcgttcatggacggcgtcgtgtgcatctccggcgcgtcgggcgccgggaagacggagcttgtgctggagtacgcgcaccgccacgccatggagtacaagaaggtgctgtgggtgcgcggcgaggcgaggtacctacgcatgggctacctcaagctcgccgaccagctcggcctcgccgtcggcgacgacctgtccctcatcgccgccggagaccggcgtagcagcggcagcaagaaggccgagaaggagtggatctttcgtggcttggagagcgacgccattgccaagatccgaaaggagctcacgcgcgagatcccctacctcctcgtcatcgacaatctcgagagcgagacggactggtgggacagccgcgacgtgcaggacctcctgcccggcgccgtcgccggcgccggcgtgcgcagccatgtcatcatcacgacgacgcggctgcgccggctgcagagggtcaggacgttctcgctggcgccgagcatggagtcgccggaggccatgct

SEQ ID NO: 11270 - DNA, 6154 bp, Oryza sativa
gagcccaagaggccgctgtggaagcagatgaagctcgcgctgcgcctctcctgctcatcatcccggcgagcgctggacaaagactcctcctcccgccgccgcgccgccgccgccgccgccgagccggaggcgctggtggcgctgctgcggctcgggatcgcgcggcggtgcacgacgcagccggcgccgtgcgtctccgtgcaccgggtgttcaggctcttcggccgaaaggccgtcggctccggcgaggcggcggcgcgttccaccgtccgcgccatcaccgccgcggaggtgcacgacgaacacgcgtgggcggcgtgcatgtcggtgttcaagatcgcgccggccatcgccgccaacctgccgacgaaggagctgccccagttcgtcacgcacgtcgccgtgccgctcgccgcgcgaggcgtggttgcgcactcggcgtacgccgccgtcaccgacctgctcgtggagtccagcaacgtcgtccgcggcgaggagagcaggtacgtcgcgagcggcggcctcgatgagaacccagctctgtaccatgagcttgcacattctagggcacagctgctgaagctccgcgccaagctgatgctccgaggaggcgagttcacgctcgccgaggaccacagcttggcggtgatccacatcctggaggtggtcgccggcgacgatgacccggagacggaggaggcgagggcggccttggaccgcgttctgcaggttcagccagagtgattttttgcgggtttagggtctaggactttaggcgcggaatcttgcatggctctcatagaaactcgtacaaaactagactataacccacacattgttgcgggtttgattgcgctgttattttcatgtatcttgtctttaataaaatgtatcttttgatactttggtatttattttggaactagcacttacgttattacttattacttattttggattctacggattaaatatttatcggtcttaccgcaccacctatttttaagtacatggtagacacgcccgttagttttgaccattgacttgctacaaaagccataaataaattatttcccattttaccatgtccctccctccccattttctggcctcctctcactgctcctgcttgagctctgagccccaaccgctcatgctcgtgctcaaggagcgttggagtagccaagagatggagtgtgagacatcttatgaagtgggaaaatagttttctgtgctcatataatgtggtatgtcaacgggtaaagctaatgtgccattgctaccgtggagtaaaactatgtggaatggacaaaagtgggtcaaacgagtgatacgaaaaattcaaggtgaaaaaaaattagggctttaggcacgggattttgcatggctctcgtagaaactcatacaaaactaaactacatcccgcacgttacgggtttgattgtgctgttattttcatgtttcttgtcgttaataaaatgcatcttttggtactttggtatttattttggaactagcacttacattattacttattacttattttggattctacggattaaatatttgtcgatcttaccacaccacctattttttaagtacatggtagacatgcccgttagttttgaccgttgacttgctacaaaagccacaaataaatcatttcccattttaccatgtccctccctccccatttcttggcctcctctcgctgctcctgcttgtgctctgagccccaactgctcatgctcgtgctcaaggaggagcactggagtagccaagagatggagtgcgagacatcttatgaagtgggaaaatagtttcttgtgctcacataatgtggtatgtcaacgggtaaagctaaagtgccattgctaccatggagtaaagctatgtggaatgggcaaaagtgggttaaacgagtgatacgaaaaactcagggttataaagaatttaaaatttaaggctttaggcgcaggattttgcatggctctcgtagaaactcctttaaaagtagagtacatcccgcacgcacgctgttgcgggtttgattatcctgttcttgtcatgtaatcttatcgtttaaaaaatttatagtatcttttagtactttggtatttattttggaactaatagttacattattgcttattttctattctagagattaaatatttgttggtcttaccagaccacctattttaggtacacggtgacaatgcttgttagttttaaccgtcgagttgctaaaaaaacaaataattttttcccattttaccatatcgctcccaacccatttcatggctcctcttgttgctcctccttgtgctctgagccccttctgctcgtgctcaataaggaccgctcaagtagctaagagatggagtacgaggcatcttgtggactaggaaaatattttttttgtcacgtcatgtgatacgtcaacgggtaaagctaaatgtgccattgccaccgtggagtaaagctacgtcgaatgggtgaaagtaggttaaactagtgatatgaaaaactcggggtggaaaataataggatttagggctttaggcgcgggattacgcatggctttcatagaaactcctattgcgcacacacgttggtgcagttttgattgtgttgatattgtcctgtaatcttatcatttaaagaattgtatatttttgtactttggtatttattttggaactaatgtaacatttttacttattttaggttctagagattaaatattagttggtcttaccataccacctagtcttagtacacggtggcaatgtgtgttagttttgaccgttgacttgctgcagaaaacacaaatgaattcttccccattttatcatattcctccctccccatttcttggcacctctcgctgctcctgcttgtgctatgagccccttctgctcctactcatgctcaagaaggagcgctagagtagccaagagatggagtgtgaggcatcttatggactaggaaaatatttatttgtgctcacgttatgtggtacgttcacgggtaaagctaaatgtaccatcgccactgtggagtaaacctatgtggaatgagcagaagtgggttaaatgagtgatataaaaaacacagggtaaaaaataatcaaatttagggctttgggcatgggattttgcaccgctctcgtagaaactcctataaaactagagtgcatcgcgcacgcacgttggtgcggttttgattgtgttgctattgtcatgtaatataatcgtttaaaaaatgtatcttttagtgctttgatatttattttaaaatttatgttacattattacttattttgggttctagatattaaatatttgttggtcttaccataccacctatttttagtacacagtggcaatgcatgttagttttgaccgttatttgctacagacaacacaaattaattcttcccccattttaccatatccctccctcctcatttattggctcctctcgctgctcctgcttgcactctgagccccgttttctcatgctcatgctcaagaaggagcgctcgagtagccaagagatggaatgcgaggcatcttatagactaggaaaatatttttttgtgctcatgtcatgtggtacgccaatgcataaaactaatgtgccattgctaccgtggagtaaagctatgtggaatatacagaagcaggttaaatgagtgatatggaaaactcagggtgaaaaataattagatttagggctttgggcgtgagattttgcacggctctcgtagaaactcctataaaactagaaaacatcgcgcacgcacgttggtgtgggtttgattgtcctgtcattgtcatttaatattatcgtttaaaaatatgtaccttttttactttggtatttattttggaactaatgtaacattattacttattttgggttctagagaataaatattggtcggtcttaccgtaccacctatatttagtgcaaagttgtcaatgcgtgttagtttagaaaacacaaatgaattcttccccattttaccatattcctccctccccatttcttggcacctctcgctgctcctgcttgtgctatgagccccttctgctcctacttatgctcaagaaggggcgatcgagttgccaagagatggagtgtgaggaatcttatggcctgggaaaatatattcttgtgctcacatcatgtggtaagtcgacgggcaaagctaaatgtgccatcgccaccgtggaatttttgtccaatttatctgatctggaatttttgttcatggtgtataaattaaaggacttggtacgtaagtttgcaagattcaatggtgaagtacctgattcccaaaaaaacaaaccaaagttgtgacacagatgaacatggtatggtggttttaaatgtcaatcattttgttctatactcaaacagtgacagtagacactgaagcaaaaggcgtttaccttcatgttcctagagagattggtgttctgggttaacagaaatatcttcagcacaacattgtctacaggacggaaataacaggtagagattatcacttctgtgtctttaagaagattgcaagaactgaaaaaaaatgcagatgaaataagtcctatagcatcgatacaatcacagtggttatagagaagaactatagaagtggtatttgaagtggcaaatagttaaatttccctgataaattactcgcttcattagtgcagtgtgtttctgtgcatggtattagggaggaacgaaaataaagaaattgggggtgcactgatccaagtcctgtcataaacaatatgtgataaaagaaaaattgcatcagacaagctgcctttgttagatcgagttccaacatatatctgcatcttacaggtaattgcaaacagtcgttatgatctaattcgggactagtgcaaatatcttaaattaccagtaaagcggtgaaccacactgtaaatctcgtatcgatcaggccgaggatatatagcatttccattaccttaaaagaacgtatcatatctcgaaaaaactacaacgaaatctatatctatatctatatatacctaataaaaaaatacgtaaggttttcgaaagttttttttcgtccgtcatccacttgcgtacgcaaaatcgattttaatctgcttagatgtatcaaacacttttcaatctactccaaaaccacggttcagatagaatatgtattttccatgtaacaaccaagcaaaaacagcagtttgcctacttggctaaggaaggagctcttcattcccacattcatctcctttttacacatattattacttgcactagtgtgatttaaagcgtcaatgggccactcctaagccaaatctggcctactttatcaaaaccattttacacctattattacttagaataactctactttgaatccctcattccaaatcatattttttggtaaaaagaaaatgatcgcaggggctcctaaattaaaactctgaccccttttgacctcggcaaatctctaccattacaaaaattaaagatatttttatcgatattttagtaagtcatctgtgtatgagtcagtttttaagttcgttcgctattggaaatatagatctgtattttagtcgagttttaagttcattcgcttttacaaatacagaaggagttgtataagaaatctctttaaaataaactcgcatgttaacttgacatgattttctagaaaaatatatatatccaagcgaattcttacaatgaatttcacaatgatcaataataagattaatatagtctttacccgttgcaacgcacgggtattttttctagttagctaaaatttcctgtccatccgtcttgatttggatgagtttgtaccaattttatcgaaatgttttaaagttaattgagatcagcatatacctataccagttgcccttccaccgccaccacctccaatcctcccatcaacctatccaatggagctcctcacaaccagaagaaattggtcatgcatatgctttgttcttatactagatatatgcatgtagagtttttaattagctctgagtatggttgatttgcacttgtgcaccagcactaaaggaggcctgggggtgtggcgcgatccgtaggaaagcagctctcttactgacag

SEQ ID NO: 11271 - DNA, 1180 bp, Oryza sativa
  unsure (1)..(1180): unsure at all n locations
catattttgacccccagcccgatgcagtagtcgtagaaatcggcgcagatgaactgggagccgttgtcggttatgatgcggtgcggtagtccgtatctgcaaaatatccctttgatgaatttgatggcgttgtcggccttgatttcccccgtgggtactgcttcgatccatttggtgaacttgtcaattgccacgaataggaacctgtagccgccctgtcctcgtgggaacagcccaagtatatctagcccccaacacgagaacggccaagtcagagggatagtctagagcgcttgcgcgggtagctttgtgtgtttactgtggaattgatagacttcacatcgctggaccatgtcgcatgcatctttaagggcggttggccagaaaaaaccttgtcgaaaaactttcccgaccaatgtccgaccggcggcgtgtgacccacatatgccttcatgtatatcgaggacgaggtgtctgccgtcgtgggacgagacgcatttgagaagtaccccgtttggcgctttcttgtatagatcgttgccgaccatacagtagatctttgctttacgggttattttctcggcttctgtatcgtcctcgggcaactcctcgctgttgatgaatttgattagtgggatgcgccagtcgtctgtggtctcgatatcggcaacggcgcgttctgccttggtgacctccgagctaatgtcgggggtgtccgggctaacttcgccgctgacctctttcactgatggcttcgtcaggatgtcgagaaaagtgccgggctcgagcggttctcgtctggacgcacgtcgtgctaggtcgtctggctcaatgctgtccttgcggtagacgtgtcggacctcgatcccatcaaaccttttctccagcttcctgacttctgcgagatacttggataactcggggttagagcatttataatctttgtgcacctggttcgcgactagctcggagtcccctttgacgattagtcgcttgaccccaaatgcagctgcagctcttatcccaacgagtagtccttcgtattctgctgtgttattggttgccctgaagttgaggtggattgcgtgcttgaattgatctccggagggagacgtcaagataaannnnnnnnnnnnnnnnnnnnnnnnnnnnnnnnnnnnnnnnnnnnnnnnnnnnnnnn

SEQ ID NO: 11272 - DNA, 921 bp, Oryza sativa
ggttgcatgatactcccccagcatgagaaaaagaagatgacgaagaaaagataagcatgagaaaaaaaaagataaagtaaaagagaaaaaagaggaagaactaaggtgtcgataaaaatgcaaccgcgtctgcgaggaagagaaaagatgaagcatgagaaaaagaagatgaagcaaaagagaagaaagcggaagaagcatcgtcattacgaatcagacgaaccggggacttgctcccaaagttctccaggaagcattgcctgcaggtcgactctgattcttccccatttggcgtttgcttccttgaaagacatttgcttgatcttgaggctgtctttacacatgacttctcttcgggacacccaagaagatcgaaaagaaggatgcgacagcacaaggtcgtggtcgtcgaggcggcgctgctaccgcatatccacggggaagtcgccattgctgtgcttggtccgcagcggcttcttgatcccctccttcccggagggctacttgatggcctcctcgtcatgggccttggtggaggttgacgcagaggcgccacctccccaccacgagctgagccgccgccgccgccggtgaagcagatcgcgtctgtgggtggcgtggggttccccatcaacggatcgaggtgcagacgcagctgctcatggcgaacggcgcggcggcgccgggttcgcggccgacgccttttcgtccggggacgagatcgacgaggatgccgtggtggagctcggcgaggcggatcccgtcagcaggaagcggcgcaaggagaaggagaagaagaagcggcgcaaggagaagaggaagcaacggaagtgggcgccgcccgacaaggacgaggtacgcgtgggcctttctacttatcactcgggctctacttatctctttatttagttcaccttccca

SEQ ID NO: 11273 - DNA, 1060 bp, Oryza sativa
gcaatataaacttgaatagaaatttttctttgtgcataatcttcaattggaaagtatatttctttttggaaaaagtacgaattaccccctgaactatcacggtcgtccaaattccccccctaaacccgaaaaccatacattattcaccctaaactttcaataccggacgaattacccccctcgactcaatccagagcagttttgtcctatgtggcgtatgcgtggcaacccagtcagcattttctttttttaaatatggtgggcccacctgtcattctctcccatctcctccttttcctcttcccctcttcctctctctctctctcgacgttaggcgcggtcggcacgcgagggccgcgatgggcggcagcggtttgtcaggcgtggccgcacgggcggtcggcacgcgagggcaacggtgggcggcagcgcgtcgtcaggcgtggccgtgcgggcgatcagcgcgcacggcggcacgcgagggcgggcggtgggccgagaagatcgatcccgatcccctccagcggccccatctttttcgttcttggtcatcaggagagatcgatctccttggttttgtcgctgtcaagcagcagcaacagcaccttgcttgctaggtcatcgtcgacggaatctgctccgccccctgtgcatcgcccatcttcgccgcgaccgcggtcgaccttggggcctccagccccgacctcctcttctcctgtcgtcgcgttctcctggaccacgccgtcaaccggctctccctcgctggcgttcgttggtccgccaccgccgtcgaccggcctgagccacagtgtcctttgcgatgagccggcaccggcgcctggctagggtgctcatcgctgccgtcaggacttggccgcttcctccatcggctctgcctcttggattttcaaccagagccgcccgccgcgctcgcgtcgtgtacctagtcgcgctcgctgtctggagcccattgccgcgcatgcctgttgattttgcaaattggccgggggagacaatgagattccgaatgtctcgccatctcgatcacgcccatgttaca

SEQ ID NO: 11274 - DNA, 2844 bp, Oryza sativa
ctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacacagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggagaccggaggacgactctgcgcagcgaccacgtcgaaatgctacaatgcgttaaagactgggagcttgctcaacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttccttatacatttactttgctttttttttaaaaaaaaacactgtgcactgc

SEQ ID NO: 11275 - DNA, 2757 bp, Oryza sativa
gtgcttgggcctgcggctcggcacgtgggccggcacggcacggcccgtttcatcaaccatacctaacggaccgtaccaaaatgggccatagccaaaccatacccatgccagtccggccggaccacccatttaaacacctatatccaccatcccccttctcctcctcatgagtccaccatcttcaccaaacaacaccaccgtcctgctgcttccgccgcatcctcgccggtgagtacccagcacgaacatcttctcttgtagatccaaaagctcccctcttttcccttcaatcgtagtactaacagcagcgtgcgtttgtttgtttcaacgaattttggggggtgggtttcagctgccctacgctgtgtcctgcgaggatggatatggctctctttaggcatgggacaacggattccggtgatgcttatcttgttcttggattggggtttccaattcctgcatctaatcgaactcggagttttatggcgcgtcctcgtttggttctctgtataagtcgttccaggaggagcctgcccgatcccgacctccaagattgtgcagctttcgcggtgttcctgcacgagcagttcatcttccaaagaggttgcacctctgccagtgttcctgcacaagcgattgatctgttaagagacgctctgctccagatggagatgtgcagcagagaggagattatggatttgtgcccccaaaacatgtgctgtgtaattccccaagttttgcctaagcagctatgccttcctccctgttcaacaaaggaggaacttcggacgatactgaccgaaactacggctcgcgaattttcagacctgccacatgatatcctgatggatatcattgccatgttggagatccctgatgccctgcgtgcggcttcagtctgctcctcgtggcgctccgtgcatatcaaactgcacaaccttggaaagtacaaacgacctcagacgccgtgtttcctctacacttctcaatctattggtgaaaacatcgcttgcctctacagccttgcagagaagaggacctacaagttaactctgcccgagccacccatcagtaggaggtatctgcttgggtcttcagatggctggctggttaccgctgatgagaggtctgagatgcacattcttaatacgatcaccggtgaacagatcgctcttccgtcagtgataaccatcaaccaggtgacgcccattttcaaccgcaaaggcgagctctgcaaatatcgttactcacggcacacagcggagggtgttactgagtcacccatgacgcttcctcttgacaaactacggtacttcttccattgcaaggcctttgtattctacgataaattcgtacgaagctatattgtggtgctcattcatgatccacataaacagatctcatttgctagattagaacatgacaagtggacatggctgccaccacacttgggaattcatgactgcgcctacaaggatggcctactgtatgcagtgacgtcatttggggaaatcttctcgtttgatctcgacgccactgtgatcacagcaaaggtaattatgggcaggacaaaggagtatgcgtgtgagagaatttatattgttcatgctccatgtggtgatctgctgcaagtttggaaaccacaggaggggaatggtaattgggttgatgaaatcactggctttccagctcttgtgagcaacactcagaacacaagaatatttagagttgacactgtggctaaaaagctggtgcaaatatttagcttggatgaccatgtgttgtttattgggaataaccagtcatcttgtcttggtgtttgtgagtacccacagctgaaggcaaatcatgtgtattttacagatgatttcgagtgcttgtcctccaagagcatgtggggtctccgccttgatattggagtccttaacctggaagataagagcatcgatgaaattgtagcacctcggcttttcctcaagtgtcgagctcctgtgtttctcgtaccgaatcctagcatgatgaattcaactctccacggttagacaaaaggtcccaatatgtttgtgtgtgtttagtagagtgcccgtgcgttgcaacgggaaatgtaaagacaagaaaattaaggaaaagttaaaaaaaattacattatgtaattaattaattaaaatacaaattttcttaaaaatttggatatttttttaagttggtaggtgtataattaaattataattacactctttggaattttattgaagttttcagagcttaattgcaaattttaataatacaaagatagtttcagcatttattcttcagcccgcgaattaaaatttctcgttcattctcttctgggtaaccgaaggtgaagtgctatttgatgcggactctgtatgatttgttgtgtgttggacccgggatgttgcggacaaaaataggtgagaacggatgaaaatttcaccggaagattaggtataggtatatagaatgttagattagattagattagattagaggtagataacatataaacgatgaaatcggatagaaatcagacttttttctttttacatacaatcggacctttttcgctctttttttattttagacggacgatggaaacattttcaaatttttgaagtataagtagagatagagattagccattttcgttttcttagagagtattatcacggaaaacatggtagtttattaatctataattaattaagtattagtaaaaaatagattaatatgttt

SEQ ID NO: 11276 - DNA, 1081 bp, Oryza sativa
aaacatggtagtttattaatctataattaattaagtattagtaaaaaatagattaatatgttttctaaaacaactttcgtatagatgattcttgcgaaaaatgcaccgtttagtagtcttagagcaagtataatagtaggctataagccggctaaatgctgatgtggaggagagaagagaggagagaggagaagcgggctgtaaacttacagccggctcggacacaagaaccaagaaactctgtgaaagagacaagtggaccctatattaattgtaaagagctaactattatatgggtaggctgagagaaggctataaagaaccttatagccaacaagtcggctgtattattaaccttgctcttaaaaagaaataacagccttaagggacctaaacttaacttattccgttcggagcatacatgcggcccatgagacgacccaattgtgtggcggcctgggaatcgcggcccgacgcgggagcagccacagccgtccgatctgatcaatgctccagattgttccaaacctatataaaagttcagtagctaaaccctaaccctaaaatcattttttctcccctctctctcaaaaagacgccgtcgcctctctccctccgccgtggcggcgccgctccccctccccctcccacggtgacgccgtcgcctctcccttccgccacggtggcgccgttccccctcccccacccacggtggctggctgcggccagcggcaggaggggaggcggcgggcaggggcggcgccctcccctccgcaggatctagcgggagggcaggcagcggcggcgcggcgtctctgctgtggcggcgccgctccccttcccccaccggcggcagcgccggtcccactccccctcccacgatggcaggcggatgcagcgtcctcccctccgccggatccagcgggaagggaggctccccctcccccactggggggggcgtcgttacccctccccctcccacgggggcaggcagggacggtgccctcccctccgccggatccagcaggagaagaggtagcggtggcccggcatccctgcggcggacggtgggcaccctccc

SEQ ID NO: 11277 - DNA, 703 bp, Oryza sativa
tcctatctattagggtctaatgcaactaaaatcactcaccgagcaaagagagacagaatcaagagatatggcaatgccgcctctttcgccaccaggttgccaaaaaccgagttcatacaagttcatcacgagttcttatatgtggctcatcgcctcgcctctacacgccacacacgccagctgtcaaccagctgttaccacggacagacttacacggcccactgtggcccatgatacatagggttgggtttgacaggccttgatgagcaatgcttcttgagcttgaagtcctcctctcctctttgctctgcttcttgctcagcttcagcactcagctctgttggcgcctcctcctcagcagcttcagtcttctcaccaacatcttcctggttgacgtcagataagggtctaacactatctcctctgctcattcccttcctagcatctgacctccggcaatcgagtggcgacgtgaaggcaaacaacaagggccgctcggaggggtgttacatccggcgccggagtgcaagtgcggcgaacggcggcaggcgttgtggctgcatgtgggcagccagacaagctgcaaggaagagcaggtgtttagtgattagccaattagctataggtcttgtagatgatttattctttttaattttcagtattgactcctctcatctcagagttctgtcacggtataagcttg

SEQ ID NO: 11278 - DNA, 2521 bp, Oryza sativa
  unsure (1)..(2521): unsure at all n locations
nnnnnnnnnnnnnnnnnnnnnnnnnnnnnnnnnnnnnnnnnnnnnnnnnnnnnnntgctctatgatttaacaatgtggtgctacagtaaatatttgctaatgacgaattaattaggcttaataaattcgtctcgcagtttactaacggattctcgcggtttgattagccctaagtgctatagtaacccatatgtgctaatgacggattaattagacttaataaatctgtttcacggtttccagacaagtttgaaattagttttttcattcgtatctgaaaaccccttccgacatctggtcactactggagaaaccatctttgcttggttgaccaaaaactacactagtctcggtagagaaggcggagacgttggcgagcggcgggagctcaacggcggcggcgacatcctgtcggcgacggagcacttcaacgatgcgtactccatcggcaaggggagcttcgggaccgtgtacagcgccgacctcggcggcgggcgcaccgacctcggcatgaagcggctagacgcatcagagaccggcgacgcgtgctgcggtannnnnnnnnnnnnnnnnnnnnnnnnnngaacgtcggcaccgaggggatgcgacgcatcggtgtgaacgagaagccaaacgctgtgttgctgctgttgggcgtgccgagggcgataaaaagcatcgtgttgctgtcgaagaagatcatagaaagagaggaagaagaacagagaaagagagatagacaagtggacccatgggcaaacttgtctttaaccaaagtttctctccccgttttcattgaaaaataataaaataatagaagaagtgtctagcagctaattaccactttttacagtatccatgagcaaatacacgatcttcgggtgtctcacagcaaagaccacaatctttgagtgtcctgtaccaaattttgcctaaataaataagttctgaatgactatatacctattaatgaataaaaatatattttattatacaattgattgctcggttcacaccatcatattcaccgattattaatactaactgtccattaaacttcctataaactctcttaagttgtcacgtggcatcctcacaaacgctcttaggctgccatgtgacgctctaataaattatagaaaattctaaaaaaacaaaatatctaacccttaatattcacttaaattagtgtgtccaatattacataactactattaggagtgtattcgagcgctaaacatacatcagcccaggcccaccccaccccacgtaccgtcatcccacttctaccgttgtcggagtaaacaatttactcctatcgggcgcctctacctcccatctttactcgagtaaacgatttacttcaataataaaaacaactttctgcttccgatcccacaccacgtccatatcgtgctcccaccattatcggagtaaatgatttacttcgataaaaacaacttctctgcttccggtatatattctatttttcccgtacccaaccaaccactctcgaccccacttcattttttttctttttttcggatctgaatcgatccaccatctcagtccacagatcagtgacacaccatggaggaggacgatgacaccgtggcggttgatggcggtggccggtggtggttgaggcgacggcactacttcgggcctcgctgtcggacgctgggcagcaccttaaccaagaaggaggtattcacctggaccaatagcaacaaccaacagctgctccacgtcagcgatattgatagaacaagcaagtaaggaaatgatactctgatttgcatctacatactctccttcaacttcgtgcatgaagccccaatatttttttttgcaaatcaaattaacgtgcaatctccaatattacctgatctcaattgatgggctgcacaattcatacatttgcacatcgtgctccatgtggctggctgcagaggatagggtagagtccgccggtgatggaaattgtttgctatttttcttttgctcgtcatctccattgacatgaaggagaatgttttttgcatttttttcatgcttactagatgatggatggctactagtgcgcaacgtcgagctcatctctagaccataccgctacatccttccatgatttcataatcgactactgctcgctacctggttgccatctccactaccagtcacaagacacagacaatcctcttcatccttatggcaagatccagcaaagccactagatggatttttgactaaatcttcttttttttttctaatttgattcacctgtgagtatttttatctcttgcgtgtgattgagcctgtaattttttcattcatacgactattttgtgatatagatcaacaatattcttagtactaatttttactcttatattgtatattgaacacattagtaaacatattactacacggtggctacgagatcatggctatatcgagaggaaagtggtaactgttttactcgcagaccacggaatgtcttttgtttactcttatactg

SEQ ID NO: 11279 - DNA, 5209 bp, Oryza sativa
  unsure (1)..(5209): unsure at all n locations
tgttgtcaacgaggctgaatgtcatagtagtaaaaccttaagtaccaagtccccctactggcgcgccactgtcgacgggtgatacccgtagaccggatatagagggtattggggtacgttggtacaaggatctacgtagtacgacatcaagcaaacaaaagacgagaattatactggttcaggcccctagataggtaatagtcctaatccagttgatgtgggattatatggtggaaaacacaggttacaaagggaacaatggaacttgtcggatccggcgagatcgtagtcgagttggttcaactagatctcgatggcttggctccttgcaggctccggcttcgtagcctgtgtgggttgtgttggctctgagattcgatgccttaggtcctccccggggggtcccttttatattgcagacctggaggtctccaagtagaactcggagatatcaggccctgtacgatacattaacgacccaatcttgtccgagtaggattcttcccatccatagattctgtgaaggatttccttagagtacgcaggaagtatccgtatgcgcgtggatataccataccgatatgtaacgtatattaaagggtaaagggtatgcctaacccgtagccctgatgcatgtagcccccgacttctgcttaaaatgaactcgtgtaaccattcgcgacttcgggtgtcgagactgttgtcgttcctagtgcgaggaccgcggagacaggccgtagtcgagcacgccatttgaagcccaacggtcacgagcgaattttaaactaagtccaaaaaaccgccgcgcgtaacggacccagaaatttccggcaggcatctctctctgttccttggaattcgcaccgttggtagtgcgcctatttaaaggaatgttggggatccattttgaagtccgcccaccgtgcagaaaatattccacctgtaagcgctcttcgccttcttcaccgccacaagaaaccctagttcatcaacctaggccctttctccggcgatcttcgattagcgatggacctcaggaaatcatcttccaccagtgcgtcgctgaagaagcttcaggaagacggcgcccttcccggtcgtggaaccatggagagggaagcaggaggtactaatccccagcccgtcttaggtcgcatggttgcgatcgaagactatattctctgcggttttctccctccgccttccgaattccttctcctagttttgaacttctatggtctttctcttcttcatttgaaccccaattctatcgcttttcttagcatctttgctcatctttgcgaggcctacattggtgtagagccttttcttgatctctttcgcttctactacgagctgcgttggatggagtccaacagggtatctggttgcgtcgggttctgacttcgggatggcctgaagtcgcgttatatccccttccagtgcccttcttctcacagcaaatggcggaataggtggctctatcttgagatcaaagattcagaccctgtcttcgttgttcccaaagaacaacctgacaagatttcgtcttggaccgcaaagccccccttgaccccctctcttcagtcgtttatcgacatcatcgacgacttccgagtacggggcttgtcggggtatgaagtcattgcagacttcgttggtaggcggatccagccgttccaagctcgggcccatccagcctttaactattccggaccggaggacgcgacccgggtttctcctcggggtatctttctcgcatttttcttgacatgtgtacgttcgcgttcctcttgatttatcgaagtttggttctcgattcacaggtttgaacagcgaaaccatggagcgccgcgtcgaccaggtgatgatcagtggtctgacaacggcgagtgacatccccgtgcccctttgtgagaagggggcagccgaacgcaatgacgctatcaacgtaagtgtactcgataggcatcccgcattttcctttcgagatcaccttaagacttgattaagcgtaggctcttcctctgactgacatcatcgggccgctcgcggaccatcaggtggcggcgtctctgaaagagaaggcgccaaggaggcgtctgatgctgctgctgccacaactagcggtcgcaatgttccgacaaaggggaggaagttctcctctgtaagcggacatcgtcgcaaggcgtcgaccccctgggtaatttatcctgtcgtcagatcgtgcagccagaaggattttgccttactttgcattgattgtctttcaggcctcggacgcgtctcccccgcctccacgacgacaacgtattgtgacgattggcgagaagtaagtagatgaacttttagatttccgtgattctattcaagcgttgtctgacccgtggtcgtcccgtagggaggcgcgggcaaaggctgtgcaagccaagttcggagggacttccagcgcgtcgcctgccgtggcctcgacggatgtcgcgctcacagccgggagccgggaggcgacgcctagcggcccagtcagcgatcccgcggcaggtcgtggtccgccaattgccggcctcaccttggaggagctccaagtcgaaatgaggcgcctcctcgaagctggtgctcgcggcatcgaccgcgagattgcagaggcaaggtcggaagcagcgctggcgaatgcgcgtgctgaccggttggtgcgtgagttggctgaagcccgtgaagacctcacgaagatgagggaattggtgtccggcaacgagcgacaacggaaggggctcgaggaccgcctgtcggaactcgggaacaacctgtcggaaatccggggttcgttgtgggtcacctacactggcctgcaccagctctccggggagtgcggcatcaagtctaccatcccggtgaatcccgacgagttctcgctgacctcctcccttgcggaactggcaacgacgatgggggagatcccccccaagcatgcagccaggattgcggaggagacgtcgagcgggatctacaccggggagtgtcatgtcctcgcgtgtgtaaagcagtcgcgtcctgaactcgatctgcgcgagatcttggatcagggggcggccagcgacacgcgtgaggaggtgatggaagaagtcggtgatctgggagagtctattctccccctatttgaagagtaggacttcttgtacttccaagacacgctgtgtaaaacttgaattctgaccgccttcgtgcgtgcaattatcattctagtttacttttgtatgttgacctcggaaacttttgtcctttgtagagatgctgatgatgaggatatccagcagtgcggccagcccgagtcactggcgataatttcggtactcgagtttgagccacacgtgtcgcccgacaatgtggaccagacccttgatacggagacagggatgacgacgacttcctcaggttagtagtccattcatcccttgatgccctcccgactaggtcaaccgtgttctcgaaagaggtgtgcagcttgacttagtggttatcacattaagaagatctcgagggtgcccttgctggccaagatcatcgtatccaatactggaagatgaagtttgaagtggcggaactcgagagaaccatgctggcagtgaagaaagagcaggctgtggaaacgctccaaggtcgcgaggtgtggtttaactcgtacttgaagagttgctgcacatctatggccagggtctgtagagaacttcgagtggtccgcggagatcccgaggagtcggcggccggatacatctcatggctgaacggggcctgtgcccaactcaatggcatcggcaagcgtatcgacgaggccttgaagcaggagtgtcgtcgatcgagccggtatgccggagggcacgtgttggcttgcccgcgagatcatcgtccgcgcttggacctcgactttctccatgagggttttgctcgttctcagaggactccggcggagatagaccatctggcgaggtcgatgtcgccgttggccgagaagatcttccagtctatggactggcgttggccttcttggtagtattcgtaccctgtgacagatatcttggaaaaaaagtgtaatttagcaaaagatttgtgtaaaaactgtaagaagtattttgtgaaatagaaaagaaatctatctttaacaaatgtttcttactctggatgtcgtgtgtaagagtgtgttctcagtacacgactttagtcagccgtttaagtcgtacactctccctggctcccagccttgtcgtcggaggaattttctcggaggataaggctcttggacttttgacctgccttggttgaataagctctgatcctagcccccagccgtgaagttggaaagttaatttccgatttcatggcttggttaatacgcacggcgagaactcttacacgaccagatcttacatggtcttttgtctctacaggatctgacaaggccttatcggctttgggtgtccccagccgacgatcccttaggttcctcggaggccttgtcaagacagcgtaaagggacataaggacaggtttcaacgctaggtgtcatcagggtaagggatcatcgggtgaaaaacactttgattgtaatatgggcctaaaaataggctttattgatactgtaaggtgtcttacaggtatggatggtattgactcatacatagaatttacgtagttggtcaatgttccaagaatttgctaactcgcgaccgtcgccgtctgcgattttgaatgcgcctggccgcaagacttgtgtgatcgtgtaaggtccttcccattttggtgagagtttgtttcgccctgcttggctttgaacccgtcggaggacatagtcgccgatcgaaagtatgcgtgctcggatgcgcttctcgtggtaacgtcggagggcctgttgatagctggctgctcgaacggcaactcgttcacgatgctcctcgagaagatttacatcgatgtctcactgttcctcctggtcctcgtcggagcgcttctgtactcgtgtattctgatgtcatagctcaccggggagcatagcctcagagccgtacacgaggaagaagggtgtttccttgttagacgttgtcggtgtggtgcgtacgacccatagtactgatgggagttcttcaacccatttttnnnnnnnnnnnnnnnnnnnnnnnnnnnnnnnnnnnnnnnnnnnnnnnnnnnnnnnnnnnnn

SEQ ID NO: 11280 - DNA, 12666 bp, Oryza sativa
tgtcatgatgaccgcgtaaagcagcttttggatctgtgggtatcttgtctttgcgtcgtggagagcttcgctaacgtagtagactggtcgttgtactttctctctctcgacaacaatgacggtgctaacggaatatagtgtggcggcaatatagaggaataattcttcattaggttggggagcaacgagtacaggggggtttgataggtagcgcttgagtgcaacgaatgcctcttcggcttcctgtgtccatacaaatttgtcttgtttcttcagcagagcgaagaaaggttatcctcgttctcccatcctagcgacgaacctactcagtgctgccatgcatccggttagcttttgtacctccttaagtcttatgggcgacttcatgttctcgattgccttgatcttctcgggatttgcttctattcctctgccaaagacaaggaatccgagcagcttgcccgacggtactccgaacgtgcacttctctggattgagcatgaggcgatatcgtcggaggctgtcgagcgtttcccacagatcgtcaatcaatgagtcgcatgtcttggttttgacaacgatatcgtcgacgtatgcctcgacattgttgccgagctggtcactaagtgcgccctggaccgtgcgctggaaggtattccctgcggttatcagtccgaacgggtatcttaacatagcaaaataccctgaacggcgtgatgaatgctatcttctcttcgtcctcttttgccatgctgatttggtggtagccagagtaagcgtcgaggaagctcaacagcttgcaaccggctgttgaatccaccagttgatctattcgagggagagggaagtgatccttagggcacgccttattgaggtcggtgaagtcgacgcacattctccattttccgttggccttccgcaccatgactggattggctagccactctggatgaagtacttctctgatgaagccggctttgagaagtttgtcgagctcttctcgtatagcttgttttcggtctggtgcaaatctccgcagtctttgctttactggcttggcatcgggtcgcaccatgagtttatgctcaatcacctccctagggacccccggcatgtcggacggctgccaagcgaacacgtcagcattatcacggaggaaggtgatgagcgcgagttcctatttctcgtttagtgtcgccccaatcttgacggtcttgtcggggttggcactggagagtggaacgatcttgatggtgccgtccggtttcggcgtcttgtttgtcttgctcactttcttgggtggctcagtcgtggcgggtgggctgggcgtttgctcgaccatgtcgaggctccgcttgtcgcactgcaccgccagctttgcgttcccttgaatagtgattgttcccttcagtcccgacatcttgagcacttgatacgcgtagtgagatgcggccatgaacttcgcaagtgcagttctcccgataatggcgttgtaagctgtatcgaattcagcgacatcaaaggtgatctgctctgttcggaagttgttggcttggccgaaagtcacgggcaacgtaatcttgcccaatggtctggacgatgattggggaataattccgtggaagggttgattggttggtgtcaactcgctttgcggaattcccatcgcgtccaaagtgctggcgaaaagaagattgattgagctgccaccgtcgatgaggactcgcgctaccttgatgttccgaatagtgggttcgaccacgatcggatatcgtcctgggatgacggcggtcttggggtggtcttcttccgagaactctatcttctgctcagaccacttcatcttgggtgcagccccctgccatgtcgaacagacttcacattccactttcttgtattctcgctttgaggagtatggtgtggaaccgccgaagatgtgtgaaacgtggaggtcgaagtctggatacgctgaatccgattcgtgaggaaccgcctcctcgttcttctcgaccacgcgtactcgcttgcctttttcaaatgcgatgtgcttctcgagcgattttttgaaaacaaggcaatcttccagagaatgtctgtccgtcttgtgtatggggcaccatactttctttgtgtcgctactttgtgggtatgggcgcttgggagggttcgcgtattctgctgcgaggacttctgcttgagctttccttttcccatttttgcgatttttcttcttgcttgactcagatgcgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctaggtagtgtagcgatctctgacaccggatttgaaggcgcgaattacagaagcgtcgatgatttcggggattgtatttctgcactcgttgaagcgccgaacatattccctcaatgattcaccagagttctgtgtcaacgcatgtaggtcgtcttcgatcgcgtggtgcttgtatgtttcttggaaattggcgacgaactgttgccacaggtctgcccacgaagagattgagtagggaggaagatgcatcagccatgaacgtgcagaacctttcaacgcagttggtaaataatttgccaacgcgttgtcgtctgctccggcagtgtagagtactgtggagtagacttgaaggaactcctctgggtcggtgctcccatcatacttttctattactccaggtcggaatctcttaggccatcggacatcacgcagggaacgaccgaaagccctacacccagcgttgggggcggtgggttgtcggcggtcgtgtgtccttcgtggatgtctgtctgacgatgaggaggacgatgatgatgacgatgacgatgggttgcttggttccggcatacgattacgaggatgtcggcctggatctcgggaatcctgtcgtcgtctcccgctgttgtctcggcgccgatctccgtcatcgtcgttgttatggtgacggcctctaccagtattgtctggcacccatcgttcgcgatcgttgtgatcgtggtggttgtcctggtctcggtcctcgtttgagcggtttcctcgatttccgttatcatggcgccgtgaagagacatgatgccgagaacgattcacattgtctcgtgtgcgtcgtgcctctcggtggccgttgatgtgatctcggagatcgccagtgccgcgaggtggaggggtagctcgttgaggtgattccctcctttccgggtcttcaccattggcatcgccagttggtggctgctccgggtgcgctgcggtagcgacttcttcgaacgcgttgctgaggttggtcactgattcccgtagtcgttctgtccaacgctcgaggtcatcgttcagaacgggatcgtagggagtttccctcagtatagcttgaacggccctaatgtgctgggctggagaagtcaattgactccccggttctgcgttggcgtgcgcttatcgatgacccatagtcttcgagaaggtgtaagaccgatggttcgtgaggattgatatcgaataccccaacgaatcgatctgaagttggagtcgctccatgttccttgtcgttatccctgatggggacgtatgacttaggagacagagctttcatggcgctgagaaagaccttgcagcttgagaggtcgtgattctttgtcttctgaataggacaatagacatcacgagttggagaaatacgctgaattccacgctctttgcaggcgcgaattttggcgcagacgttgaggaaaacccaacaggcttgcaaagtgtgtttcctggttttgtggataggacaccagaaccttgtggcttcggaagtcatctttgtcggctcgcggttcatgtcggaaggacaaggtttggccgcatcagaatccttcttgagctcggatgtcgtcgatgctccgttctccgtctcagcgggaggatttttcgacatggagtcgccttggtttgtagccactgcgttctcgtttccggtcattggaggaccagttgagatcggcgtagtggtgtaaaccgggaagacgatttcgccgacttgagtccacaccagcatcgttgaagcagggagtacttggctgaggttggtgttgacgctgttgtcgacgaggctggatgtcatagtagtaaaaccttgagtaccaagtccccctacctggcgcgccactgtcgacgggtgatacccgtagaccggatatagagggtattggggtacgttggtacaaggatctacgtagtacgacatcaagcaaacaaaagacgagaattatactggttcaggccccttgataggtaatagccctaatccagttgatgtggggttatatggtggaaaacacaggttacaaagagaacaatggaacttgtcgaatccggcgagatcgtagtcgagttggttcgactagatctcgatggcttggctccttgcaggctccggcttcgtaggctgtgtgggttgtgttggctctgagattcgatgccttaggtcctccccggggggtcccttttatattgcagacctggaggtctccaagtagaactcggagatatcaggccctgtacgatacactaacgacccaatcttgtccgagtaggattcttcccatccatagattctgtgaaggatttccttagagtacgcaggaagtatccgtatacgcgtgggtataccataccgatatgtaacgtatatcgaagggtaaaggatatgcctaacccgtaaccctgacaactttgcagatgtagattgcatcatcgtatacatttataatgtttgaagaaagtttactgcattgtatagttatattctttacacatctatatgtacatttgttgatggttgttattgatcagtttcgaccgtcaatattaccaaaataaaggagaactagtgatgcttacaatgcatatacttgttagaataataatattcctctagtatttggttcactaaccttttgcagagaataaccataaagtggaggagaatcggcatcaactcaaacgataaatcaatcggcatcaactcaaacgataaatcaatcggacgatgtcgagaatcagacttatgcgtgaatgggccaagaactcagaattgacacgatgaattgggccaaaattcacaagtctgcgtaaatgagcaatagaggaggccgccagccaaagatgggccgggatggcccagcctatggttcggccgaacccatcctggcgccgttggatgcagggttcggcgtggacgtccaagattgcatcccaatgacggttggagggcacttcagacaattccccttccacaactataacagccctccctccagaaccgcgtagcccagcacaactgacgagcgggcccacttatacacaccaccccacttacacttttgtcctcgcttcgtgtaaaagggttaaccctggagtgatgtggttggagggaagaggccttataagtcggttccactcgtgctaaactagcaaggtggtactaaacatatgcacacagctcacatgggccacacaggcctaatccttattgggccgggatgtcacatccacccccctcaaaggacccgatgtccccgtcgatccaactttcccagccacacaggcatacaagcaaatgtccaggaacacaccccctcttagcgcacgtccgtacgtccagtgtcgatgccatatgccatgccttgtgcctcacacagagcccacatgcgccatgcgccatatgcccgaccccgtacgtctagtgtcgatgccatatgccatgccttgtgcctcacacagagcccacatgcgccatgcgccatatgcccgaccccgtacgtccagtgtcgatgccatatgccatgccttgtgcattgtgcctcacacaaagcccacatgcgccatgcgccatatgcccgacccgacgtccccgtcggtccaacttacccaggcacacaggcatacaggcaaatgtccaggaacacaccccctcttagcgcacgtccgtacgtccagtgtcgatgccatatgccatgccttgtgcctcacacagagcccacatgcgccatgcgccatatgaccgcacactgacccgtacgtgcaaccgcgagggtcggctctgataccatttgtaacagccctccctccagaaccgcgtagcccagcccaaccgacgagcgggcccacttacacacaccaccccacttacactttcgtcctcgcttcgtttaaaagggttaacctaggagtgatgtggttggagggaagaggccttataagtcggttccactcgtgctaaactagcaaggtggtattaaacatgcgcacacagctcacatgggccacacaggcctaatccttattgggccaggatgtcacaacaaccgtcataactacctctatataaggacttcaccttctcacttcactcacacacctcaagcaagagctctctcatattctcttaagtttagtttagtagtatcaagctagtggaatagtaatagagtagaaatcaagagtccggaagtcttcggaagagttcgggtatggctctagtagatttcctttcctcttttgtaagctttgtactttatttagaatactcttttttatacatttatggtattgaaatactttccgagtatatgaatgcctactttacattatgttcatgttatactgattatactgctagcttatctagcttatctgagagatactttggtgcgggtataatgtttgcatatgcaattactctatgtcatgacgatgatattagagtagtatctggtagtttaaacgtggtgtctagattacgggatatcattatttggggttatatgctacggatgagaggtgggccgctgatggtgacagctcagtacgggtatttctccgcgcgtgtatatagtcctaagttaattccctagggagggtactcgtccgtatttagccccggttgtatggtcatgatgggctgtcgtaaggaactcagcagtcaggggtggcttctcgaagtaccaggagagtatcggatagagagtattagctagtatatcagttaactaggatgtatgtgtactatgtatattagaagtataggaatagattatctttctcttttctttccacttagcttagataatatattatgagattgagtagctgatgcttgtgtgtcactctacccttggtttatcttaacccctacttagaatatgattatcacaagtaatatataaattattagtcaagttctctctacatgatcttcccacgggataaaataaatatgatacccttggaatactctcgggtgaaatgctacaatggtatatttgtgcgcttgcggataaactctgtaaccataatataccagaagtatttctacgccattgctgggaattatatttctagtaatatcgttaagaaataccaactattatatactgaaaatccattaaatgtctactatatactaaaagttcattgaattcccaaaaatgctctcaaactgtgtcacgtggctttctacaaacgttattaagacgtcatatgacgatctaataaattagaaaaaatccttaaaaaattgataaaaaggaaaaaaaatctaaccattgatattcttttagataggtggaccccactaattttaactgttagatcgccaaaaacaaaattccagtacacccaaccccaccgtatttgggcacacatgtacgtacatactccctcaatcctccaactctccctcgggatcccactctcctctcccattttcgagctaacttttcctattttctagctaacacaaaatataataataataataataataataataaagttaaaatgatcatgactctcaagttacatgcacttttctcaatttatttgcaaattttcatttcccgtgtttttctgcactacactgaaacatccgttcttttcaacactctattttacacatgtattcctatcatatgtatgtaccttttctattctttttttttcaatcctgtgttataaaggaactttaattattattaaatcataattcaagattcatattacctttatttactatataaaatttagataatgtagctgttttgaatacaaatatttgagcaaaatttgtactatgaaaagattaatgaattcaaatgtgtgagtctaaagtccagattcaatcaccaccaaggatcttaataccatgatgcatactctgggcctacaagatattattaggttgtgttcattagatgggtttgggagctaatctcccacgcacgtaaaatgaatcgactcattacattagagtatgattaattaagtattagttatttttttttataaaatggattaatatgcttttttaaaagtaatttttctatagaaaacgtttagaaaaagcaccatttagtagtttggaaagcgtgcgcatagaaaacaaaggagctaagttaggaaaggaggggaaagaacacaaccttagcgaagtagacaccgacagaagcaccaagccgccagaatcgactttccatgacttcttgagcctaatagcacactaggtaacgaggtgaacgacaaaggattgagaggagggtagagggagacttttgcgtcttccacaaggactagaaaatagcttcatctctatcgtcgagccctaccacatcatatccaatgcatcaggagaggcccactgatatggaggtcgataagatactccgcgaggccgatggtgacatgtagatcaattatgaggtgttcgtaactaaattcagaaaaaaaaaacaagcaatttgattaaaatacacattcaaaaacaaaaaaaactaaaacaataaaaaatatataaatagattccacgtagaatataaaatatcaacagaccaaataaaattacgttgacttgaaaaatcgacacgcatcggcctgggagatctgcttaactctagtgcatgtccaggaaatttgccttcgggttctgagcgtgccagatgttttgatcctacaaccaacaagacaggaaacaacaaagagttaaatccatcaacaatagccgatcagcaagattgccgatgacatatcattgagggccacgctgatgcaacagaagtcggaatctgctgttaccttttgagctaagtgggccaaactatcaaattcttgggccgcaaacttctcacttataggtgccaatagaccctgaaaggcgagatcggcaagctgcgaatccatcaaagccaagctaaaacacctgttcctcatgtcccggaacctctgtatgtaatcttggaccgattcgtcgtgtttctgcttgattgacgtcagatcggacaacttcatctcatgaatcccgctgtagaaatacttgtggaattgcttctccagatcggcccaggtgtgcacagagttatgtggcaatgctgaaaaccatgtgaaggccgatcccgatagagatagaggatagcctgactctcaaagcgtcggtagctgatgcctctccgcactgggccaggaatcggcttacatgctcgtaggttgatacattgtcttgtcctaagaacgtcgaaaaatcagggaccttgtatcggtttggtaatggcactctctcaaaatgctccgggtagggatgtcgatacaagtttccactgtctttaggcttgagcccaaattgttccctcatcacatcggctatcatgtttgcccacgacctttgctgaggtgctccttggatctgcttttgtatttgatccagctgattgtattgtggcaggtactgaggttgagacaatcctcctggccgatactgtatttgaggtgagtggggctggtattggaagttgaagttgccccccatatgaggttaagggctctgacggactatgttctattcagggatctattcggggatgagctggctgccgatagttggctgtggctgtgggacaggtgaatgctgccccatggtcagttgtggaactggctcaattatcggctctcttggcccaaacatggctgcaacttgatctggggagacttgagggatattgtgtccagcatgttgcagttgaggtctgaccagaacacgaggattgatggttggctgtctaggtgccgatgccgttggaccctgccccctagggggcactgccctcctccgaccagatctgggaaggaggggggaggggagccaccgccgccgccccgcgctgtcgttgccgccctcgcccccgccggcctcctacctccctcctctggccagatctgcgagggagggagggaggggagccgccgcgccccgccgctatctgtgccaccgcagtcatcgtcctcgccgcgccgccacagtcgttgtccccgccgcgtccccgtagtcctcgtccccgccgtgtccgcctgagtgttgagggagactgagtgttgaggggagactgagtgttgagggagagagagagagttgagaggaaatgagtggtgggaggagaagataatggtagacttaagtttattttttgggtaggtacgtccgcctgcgaaaatcattttcgcatgcgccgtttaagtggtccgtctgcgaaaatagtgaacttcacctcaatttatatttttataggcggttatttagctccaagggttatgtccgcatgcaaaaaaagatccacacgtcgggaaaactgctttttctagtaatgtccgcccagcacatgaatacacaatcgctgcatcatcctggacaagattgtggtggtttcgcggcatgggaccaactgaaactgatcaaagtagtaaaagctaatgtagcccgtttaagttctggccgagtcatcttcgagacaaatcatctctgatcgacatatatatacgcacaagcgaggagagcatatcgatcacaggcgaacatatggctgttctttgattagctgaggaaattatctgaatagtatataatattcttagtgataaactgaaaaaaatatccgtgtgttgcaacaggtaaaaccatttttggattgctgtatattttactctttgattttggaccaaaagttcgatccttcctcactattcagtctcagccgagcccgctacttcgctctatttggcctgcctcttgacccaacccacaagcctgcctcttgcctcttgacctaactcacaagtggagctgtatgtccaactcgcatagttgactaccgtcttcaacctccggaagacaatctagtgtctgtctcgtcaaatccggttgaagaaaaaagtggatgaaaaaacctggaaaaaaggcgacgaaaaaagtaaaaaagaaaagcggacggaaaaagaagcgaaaaaagacggaaaaaaacagcgaaaagattgatggacgacaaacagaaaaaggaagaaaaaaaaaaggaagaaaaaaggacggaaagaaagaaaaaataatagaaagataaaaaaacgaatagaaagaaaggaaaaaacgaacggagaaaagaaaaagaaaaatggaaaaaaaggaaaaacggcgaaaaaacagaggaaatttttttacggaagccttaaaaaacttttcttttctacaaacttttctatttttttaattacaggtatatatagtgcttctaaataatggaatttcaattaaatagagaaaatagaaaagtgcactgtacagagacccacctgtcagtattttttttttatctctcgttctctgctccttcctccttccgttcttctttcttatttcagagagaggagggagaggggagggtgagcaaggcgacggcgctcctgtagccgggaggcggtgatgtcagaggcaaaacgtgtttccactctctgcgtatccgaggaaggtggcagcaaacaatcaaattgagggagaagttggaaacatggtcggcaaaagctcagtcccgaggagagagaggaggcttcggtgtggttcaaggtggcggcagacggagggggaaagtagagaaatgagttcttctcagcgagatagagctggtggtcagagggaataggaagggaagctccggttgaggagatcggctagtgatggtatattggccggcagcctgacggcaacgcgtacgtgtgcacgtgacatcgggaaagccagacaaaaacaacagaatcggactggaactacgtacgaaaagtaggcaaaaacatattaaacttttataatagataaagatatgtcagtgcagcgccttacaaaagtgtatgtacaatatcttgaatcttgaggattgtataacaaattaaaatgtgtataactaattaaaattgatctttacatatatatctctatctcttctctacattctatgttataataaaaattgaagatgtttttgccggtactttggtatgtcattcgtgtatgagtcgatttgtaagttcgttcgcttttgaaaatacatatccgtatttgagtaagttttaaattcgtttgtttttagaaataaaaaaatgaatcatctaataaaactatcttaaaaaaagtcacatgctaacttaagacaatcggactcctaactacagctcatgattttctaaatatgtatatattcaagtgaattccatag

SEQ ID NO: 11281 - DNA, 14742 bp, Oryza sativa
  unsure (1)..(14742): unsure at all n locations
nnnnnnnnnnnnnnnnnnnnnnnnnnnnnnnnnnnnnattaaaatagtcttcacccgttgcaacgcacgggtattttgttagtatatgaataaattaaaaagagagttgacagggtggtaaaaaaattattgccaataaaagtttatcgagatttattgaaaaaagagatacaatgaacacccaattaaaaatagaaaacaccttactctaatttcagtttattttgttagaactattttctaaacctagttccatctaaactctggatccgaataggactctgaatcaaacggaatacgattccatcttgtgaatacgaccacgggtcgcgttcgtcgcctccgccgtcggcggcggtggcggaggcttccagcggccaaattttgagaaaacctcttggggcatcgaaatttctgaaatacattgactgattctgcaaaaatcgagggagaatgtagcatgccgacgagcctcgatgaactattaaaagctaaatcctactgaagctagcagactacgatgagctattccttgtctggcaacccaagagacgcatgtcagcaacagcaagtcccttcctgtcaaagagaggacacaacaacttcacagtgcttgatcaaaatctcctcgccattttccttcttgtcatcttccccttcaaccacatactgtgtatgttatactctctccgtttcaaaatatttgataccgttgactttttagtatatgtttgaccgttcgtcttatttaaaaaatttgtaaaatatgtaaaattatatgtgtacatgaaagtatatttaacaatgaatcaaatgatataaaaagaataaataattacttaaattttttgaataagacgaatagtcaaacacgtacttaaaaagtcaacggtatcaaacattttgaaacagagggagtgttacctcggttccgttttgtttgacgtttcggacagcttcgacaaattaaaaagaacagaagattacatcgtcattctgaatctctatcggatgaacgatgaaccgggacttgctcccaaagttttccaggaatcattagaggcagatggtgtaatttttcttgcacttggcgtttgctgtcttaaaggacaggtgcttgatcttgacgctgtcttcacacggatccacgcgacttctcatccgaacacccaaaaaaatcgaatagaaggatgcgacaacacaaggttatcgtcgttgtggtctgtcgcatttccaaggccttgcggcgattcacgcaaaggcgccacctcctcaccacgagcttagccggagcgcgccgaggcgagccactcataggcgcggcgtttgacccaggccagccagaagctaaggaaggtggcggaatctggttgggttgtccggtccgagcccaccagtaatgtgggggccattcttgtcatgtggtgcacgtctccgcctccgccacctcatccaggccggcgacggcagcagcaacctcagacgagatgacacggcgtcggcgtggcatagcttggcatggcgtggcgctcgcgtctcctcgccgttccgccgccgcctctgaagagggcgatcgagcagcatgccgtcgcgccgcgcaggtgcagcgagtgcctcatcgccctggctggctgccacggtccgtagccggtcgtgacgcacggcgcacggcgcaccacgtcgttcggcatcgacgtcggaaacgtgtccagctagttcgtcgtcgaggccgagctcgtctgcagcgccagtgccgtgtacggcttcgttgcgtcgccgccggccaccgcgtcgaacgacgacatgacgatcacctccgatcaacctgcggagccaaaacacaacgacacctccacgttcttcttgattgcaagcgaagcgagatagatagagaggcattaactgatcgatggagcatggccatgggcgcggtgacctcgttctggagatccttcatctccgacagcgagagctcgggggcagaattgctctcctgctcctgtgggttcgagccggccttgtcggcgtcgtcgcctgcgtgccgaggctaagcgacaccccgcgttgccgcgtactgcaccacacggcatggcgtggcgttgcgcttgggtgtcctcgccgccatgcccgcgcacgcgttccaccgccgccgccgttgaagagatctcggtgcaggatggccggcgatcgagcagcatcttcgatgacgcgacagccgtggactcgcccggcgccgcggcgcacatgcatgttctgtacatgagaccatcgccatcgggcacgatcagccatcagccacctcggcaaactccccctcgcgtgcatgagtcgatttgtatgttcgttcgttttagaaatacatatccatatttgggttagttttaaattcgttcgtttttaaaaataaaaaaaaatcatctaagaaatctatataaaaaaatcacatgctaacttaagataatcggactcgtaattatagcttatgatattctaaatatataaatatatccaaggaattcccaaagtaaatttcgccttaactaaaccatttaaaataataagattaaaatagccttcacccgttgcaacgcacgggcattttctctagtatatgaataaattaaaaagaggggttgacggggtggtaaaaaaattatctatctgtctattatctatcttctattatatacaaaagtctcctacaaacgctcctaagtcgccatatggcgttctaataaattaaagaaattactagaaattctaagaaaaaaaagaaaaacatctgtccatccggtttcacttaaattggtggacccccgttagatcaacttagaaaaaatctttccacatccacctccctcctcccacacgtaaacctctctcccctttgtacgtaccctgtcacgtaccgtgtcaaaaaagtaccgtgtcaaaaaaaatcttcagatacgtacgtgcagcccacatatatctcctccttactggcctattttttagccagcaattcaacataaacatggtgagttaaatggtcacaatttaatttagactagaaaaaatacccgtgcgttgtaacaggtgaaggctattttaatcttattattattatattgatttaagatgaaattcaccgtgttaaactcgcttggatatacacgtagtattttattagaaaatcatgagctgcaattaggtgtccgatcgtctcaattaggtgttcaacaatatgacttggtgtacggcatcgggttgagttgatatgcttcaagatgattgccacgcatggatagagtcctgataaggcaattgtatctattaattaggatattttatgtaatttctttagatatatgtttgggcaaaagtctatcgtaaagacttatggtatcttagagtttgttagagataagagtcgtgtccgatatggacatagtttgtaattttcggatataaatagaccccaaaccacatgtaatcaatcaacacacgttcaatacaatttcggcgcatcgccacccttttttagttttgtttcgacgagttcttgcttttgggttgagctgcatcggtttcaatcttcaacaagaggtaaaacttgttatggcggcttgcgttctcgggattagtgcttccatatttatgatactctgatctcgttttttgtaattcgtcgagttatcatatatcttacataatctctggcaatatcgctatctaatctacaatcggctaacatctgttggtagagggcagccgattaggttagatatcgatgttgacttagattttataaggtatccaccactctatgaaacttccaacggcttgattgtctagatattgtccttcttttcatacttatagttgcatcagttgagtttgatcttatgagtcatgattagaatctcaatctctagcctgctacttggttgccgattagggtagtatcggagtttcagtcgatcttatctgatttaactatatttactttatatgctttattgacatgttaaatctgcccttcatgttgagatcttgttgcatttaagtatattaggcttttatttggtatattctacttgctttaatatcttaatatagagtggtatcggagtattagccgatacatgctagatctatctgatcgactatgctatcaacatatatagtctcattattaatatatatttcgatccaagtgatttatattgactcggcatggcgatcgatctatctcaatcacttgatttaagtatatatctatataaggagtatatattggtaatatctacagccgatcgagtagatttagttccttcatatttatttatgaccgccgatcaacacatatatgacatcggcgcaaagataaatgatatgtcatcggcacctaactgatcggctatcgtttatggatttaaccacggtttctttgtctttatttcttgctgattgcatgatcaaatcaaccggcacgctagcatactcgaaggcgagttttagacctgcactggagttaagcagatctcccaggcctcgtgtttttcatcaacactttcttggttgacatcggagattgactcagacaaacccgcatgaggctgataaggaaagtctaacgttatctctgaactcaccgagaacggtcacgtgagctcgataacagttactccaaggtccgcggttgagaatgtgaagcattgaagtcgggggctaccgtcaaggtccgcggttgagaatgtgaatttcttcatttgcattgaagtcgggggctactgtcagggttatggataccacatacctaatagtagttgactaaatctcgacaggacccaccacataccatgtcttatacgggaactgacttcggatatggagagagtttcggataaggaaagacaaccagagttctacatggaaacgacaaggactactcggattatatccatattagtctccctagttctacttggacaaggggacacctatgagtataaatacaaggccccctaggaggagaggggacacgaaacaacatacaaaccaacatacgccaaggcaagacgccggatatcgacttcagagataggcatggctagtcccctacggtgactatggctaccgtcaggagagatatagcgctgtctctgatctcgccggatgcggattcgaggaggaaggctaccctgttgtcgactacgagtcagtactacagaccgccaagtcgacaacagttagataggctaccccaaatattgtattggtatgattatggtgaataagagcaataccggcttcggccaacaggatgtagggttattacctaataattcaggggcccgaacctatataaaaattctcgtccccatctcttttacctcaatctcgcatatatcctggtaccaacgatccccatactacgcaaataccggaatcgcgacatcaaacgtcgacaaaaatccaacgtttaaagctcatacatgtgggacacataaatagttaaattggtagtgattatgtgcaaggcggattcggacactacgacttaccaagccaccggcaaaaatatcttcaattatttataatagtagagatagggagtaactgataacttaagatcaataaaatccaaaatattctgaaaaaataaaagctaaacattgaaccattgatttacaggtgaagtattattttcaatcattagattagatcgtactaaagtaattaatttctctctcctaatctcatgcgtatttgctagagagaaaaataaatatatactattctcccagagaaaatatacgtatgtatatatgcatgtacaggagactattatttgcaaaacaaaaaaacaacatgcatatgtacgtacataaaaaaatatattaaccatgtcctcctaacccttaaattagaaagtttatacatgatcagtctaccctatgctgtggctcctttcgatctctccagtttatttcctagggtcgttgttgactaggctatttcttatatctgtgatagttaatttataattaggagccgacgtatccgagatcgttgatatgcttagctagtccaaaataaaaatattggttaaatggtagtctaaaataaaacattcataataaaatatggcccaaagtaaaatttgtgacatacatatagcaattctgattaaaaagttatcacatggaacaatattctagccaatttttatatctttcttatacaaataatctcaacaattactccataatttttaataactgatagtggatattatattcatttacaacccattttttctatagaaaatttataactatgttaactatcttttgaataaaaaatattacacggaaccacattctatcacttttcatattattatacatagcattaacaattagcacaaataaacttgatagtatatattgttccatcatatattaccccatgaacatgcatagatgaattagatcaataatacaaagaaacaaaaatatcaaaattcatattacctcatatgttcgtgaacgattactactcgagcaaatatttttccacgtgtttctcaccactgaagctattagattatttgaagtagtatcgaatgttcaactctgcatattttcagaagagaaaattatatctgtaccactaaaatttagtagaccaattaacaccataaacaagtgtcaactctattccataaatggactcaaaacttttaaatttttatttatcactttcatcttatctatgtgtcattccctgaagggcgccaagcatggataacatagtttgctatgctactatacttatggcgggggcatgcatatgactaagttgaggtgaccctaatgagaggctactattcgcaataaaattcaactggcttacttagcgatgtgattctttagctgatagtgaattagatgttaaaattgtgctccacgaggagaacggctatgccgatacgggacacatgtttcaaggcataagggaagaaagccttggtggctacagtcagcttcggggcatttagatctaatttaatggttttatcccatgaattggtaggaataatatttcaaaatatttatgcatatatttaaacacaagtgagacatgaacaatttgatatgaagtagagatgatcttttcgttgtattaatgacataataagtttattttcttggtatggatgtaattccatttaataaaaaggtacctaacttataagacaatgatagtaaatagtagtaacatgcgagtttacatatatccgggacaaagttatttctgtttgaatatgaaagatactattgtcatttggtatatcaaaatttatggtcgacatttatttttatataattatatataaggtgatctatggtccttataattaattaatatggtgagataggatttcttcagcattatttttataaataataaataattggttcttataattaatatcgtgaagtatgacttcttttagcaatcttttataaataaattgcccgcgcatttgcgcgggcttccttcctaatatacaaaaagtcaattaaacttcctacaaacgctctcacgccaccacatggcgctttaataaattagagaaaatcctagaaattctaagaaaaaagcaaaacatctacccttaattttcacttaaattgatgggtccaatattatacaccgttagataaaattaatcctaaaacaaaccaaatactatggggtcccacctctcctccttctcccacacatatactttcctccttctcccgcacatatgtaggcaaacgtgtatggtacgtatgcttccttcccttttttttccttttttcttcttttttaatatataatggatatatttcttttaaataatcataatttcacaaacaaagagtctaccatcatagaactcgcagctaactaaattagctctacaatttttgaaaataaaatttacacattatatgttacccatttaactaataatgtaaaataatttccacttaaatcggtgtttgtactattattttcaaattatgcactattttaaaataaagtttacacaaagtaatttaaattaattattttaaatttaagatctatattaactaatttatatatttacttaaactgatagatccattatttaaatcatcggatctattttttatcacagtggattattattctcaaataatgcactgtttcaaaataatatctataccattatattgtgtacccattaaattaacaatttaaaatctatattaactaattaacacttacactaggaccggtggacccattatttaaattattagatctattgtttgctaataaataaaacgtccaaagttttctttttggcctgctgcacaatgcccgtctgcaccttttcctttcgcacgtatgacaaagtgtcgtgtctgaggcttctaaggtgatcacgatcgctgcagcgctacagctttgccacatatcaaatcatatatgattaattttgctaataacataaaaagaaaattaaaggtgtgatgcagcgagacaagaattaggcaccatggattcggttttttttcaacacttagctctgtttaagttgaaactgagagttgattatagagtaattataatgtattttgttatttcgtatttggattttgaacaatttgttcgtacaagtgaaataaatcattatgttataaatgtgagcacaatattaactaatatcaatataactcttactaagacaagggtgttataatggagtttaatgccctcttttttttcccgattccatagtttggattttcgtttgcacgctttccaagtttctaaatggtgtcctttttaaacaacattttaactttttagaagtcaattcatttgtttatacctcaaatagctatcgcataaatctgataattcatcaatttcacctgtcctaaaccctaagtagtatatattttttttcatgtgagtcatggtgatcattaaattggggatcaacggataatcaaagtcataagatgaatatgtaagagctactatgaacaactgtaaatatgcgtcaaacttatttgctattaattatacatctaatagcttgctagccacataattaatttctctctacatgtatataaccatggacgaagctggaacaaatattaccttatgccccatacatacatattacgcggttaatattctaattacatgtgttaagtcctttaaaatttcttaaaatgctctcaatctgccacatggtgctctaataaattagggcaaatattagaagttctaagaaaaaaaaagcaaagtatctacatattataatctgtacgtccaatattataatctgttagattaaattgatcttagaacaaattaaatactatgaggtcccacctctcctcctgcggcacaggtacgcacctacgtacgtgggtacatacgcttcccctccttttttttcatttttccctttcttcttttttctccatgcatatgcttccctccctttcttactatatcatgcgtcttcatgagacgatttactcacaagaattttgagtatcttactctcgcattttttatttatggccatactacaaggtatgatatagatggaccgtataataattaactagcaatagtttctcctttcttatttactcaagagagaaaaacacatgattcaaaagtcataagtacttaatctatcccctattcaaaagtttgtgaatggttttttaagatatcttaagaaaaatagaaaccttaaattattataaaataatattatccgaaatttagtttgtccttaatttatgagacaaaatttatgaacaaacaataatcttacctttcaataatataaatgcccgcgcatgtgcacgggccaccttcccaattgccaataaaagtgtatcgagatctattattatatactaaaagtccattaaacttcctagaaacgctcctaagtcgccatgtggcactcctacaaacgctcctaaaccgccacatggcgttatctaatcccaccgtcgattttcacttaaattggtggacctattattttacaccattggattagatctattatttaaaaaattataattttctcctctttatacgatacaagcgctactactatcatgtacgatgcgatccatacagacgctactaagttcttctcccctacgtacttacgtacaccaatgaaaacaaaagaatagcttacctgttgtttgcccgaaagaaaaggaaaaactatacgcacgtacatatataaaaaggacagcagaaaaatacatcagtaaaaattgatgaattttaaaatatgattttctaaaatatattgcttcacaaaaataaatatatatagttaaactaagctatataataataatataaaatatccaatcattgttctgtataccttcttctaaattatttttttaaattagatatccaattagttattccattgtatttcgtttagttaaattacaaaagttatattgtagtcctaaatacatcacaacacatagggctaacatataatggttagttgtttgatttttttttaaagttcacaacatattttagggtgtgaaatatcacttcataaatatagaacactaatttaaatctatatataaaaaaataaaaacaacacaatttagttgtgttttttcaaatagatctaattaaattataattggtttgagattaagattctcagagtttttttttgacatttttagaattatttgattggtatttgagtagtgaccagcatacatagtgcatatatagatatgaaaaaaaataaaaaatatctccagccaatgatctttgctataattcaatccttcatccatcatgagatttatggtcattcttctttgccaaatagttttgacacaaatgaacaatgaaacaatatacgcaataaactactcatgatatactttcttatacttaaggaacttcaatatgtcagacacaattgatggatatatgtcataatcttcacagacgtgactataagtgtactacagtggattatttattgtaaataagttttaaaaaaataaatacattctttaaattagtaaaaatgcctcatgtgatcatgaacaataggtgttgaaaacaaacttggcgctaaactatagatatttgtcaaaatattaaaaaaattatatggtgctctggatattatcatggtagtatgtatgtttagctatattttttaaaaataatgtcgaatgattaacctcactcattttcataagagagtattctatctatatcataaaaatttaagtagtaatgatcaacaccataaacaaactatgtctaaaaagactattttgatcacttccatcttctctttatccgtccctaaagggcaccaaacatggaacatatgcctaagttaagttgacctcagtggaggccgtcatcactaatagttgtcatcatatgaattaacatgtaggatctgttctattctattcggaccatatggggattattcagactaaatagggataacataaagtagcactcctatttaccaccatatataagttttatgatttggagactatattaagtaataattaagtaaaagaatagtggaagtacgcttattgtccttcctctttgatttctattaaatatcatgatatgtgagtatttcatactaagtttggttaattaaggaacacaaatcatactaaacttatatattagaattaatgcaataaaaatgtactttataatagtaattgacctaataaaagtgtactttagtctatagcatttatacatttataaattatttgtacgtactaattatatttatataattgcgctcttgtatcaatttaaattcagttttcaagaaagcatatgaaaatgaaggagggagtagaagtaaatagaagtctttctataattagaagaaataatcctatagaaaatatcttccattaatatatcctaaaatccataaagacatctataatatagaagaaaaaataatccttaaatgaatttttatcattatctattatatactaaaagtccattaaacttcctacaaacactcttaagctggcacattatgctctaataaattagagaaattgaagaaatataagaaaaaacaaaacatctaaccctcgattttcgcttatatggtggacttttacaccattagatctatctttttaagaaaatcccaaaacccatccaaatatcatctcatgggcacccttcctcctgggcaccctcttctcatggtatatacatcgtccctccctctttccttccttccttccttatttctctaatataactatttaaatttaattgatggatccattaatgataaacattacatcttcatctaacaagaaaatctggtaaccccaccctcaccgccatacgcgcacacgtacgtaggtacgtactcactccaccctcctgactctccccccccccctcttctatttctttagctatttctagctaacactcaatctatcaaaaaatcaataatcggatttctaagtttatattcaagttacttttttttcttaattatttttgaattattgtgttatttataattaaatacatgatactagatccatatacatatatatagctcaaacttctaatataaatgtttaagagaaaatttttaagagccatcttaaacaaatattaaatatagatatataaacaccataagtcactaagtgacaatcgtacaaatgcttctaaaccgccacgtggcactctaataaattgtaaaaaatcacagaaattataagaaaaaagaaaaacatctaactattgactttttctttaaatttgtagggccaatcattagatctaatcttaatcttatcctacttaaaaacttcaagatgatttggtgctatgtcgcttgatgacgtcatccatgagtcagctgcacgtacttcatgtatatgttccgttcgctagagagagagagagagattttgactcggctcactaaagaaaagcgaggcgttgtacatcagataaaaacttccggcctaatttcattgtagacaaaattaagatttgaaacatcaaggaataagcataaacaaagtttcacatgacctaaacgaacagaacaaggaaatttgatcgtatcatgcatagaggaactatggcttaacatagtacgagatataatcgagagagttaggtcacaactaacctaattagataaaaccctgtataaggaaacgttactgcagaagtatattgtatgataatgatagaaacatagtacaaaataaatttatttcgttgctaaacagcataatcttctatgttactatgtactttgtatagtttgcatctttagttaatcatccaaaaaaactataaacacaattaagatgatgtgctttgaaaatttagatcaaatatagattcaacatcaaaagcaaaaactaaggtgatatggctttgtaagagaagaaacaaaagagatatacctttcgaccagattaatcatcgaggtgctagaaattgagagactagaaaaataacattaactatacatagtgagggttaaggagcgatcaatcgctgccagcgatcgtttttttcttttttttttcttttcctcttttagtaagtttatacatataaagtttacacatctaaagtttatccacctaaagtttgtaaagcgaatgtttacaagtcaaaagtatatatacccgattcaaattcaaattcgaattcaaaaattatatatttttcctcttttagtaagtttatacacgtaaagtttgtagagcgaatgcttatatgtgaaaagtttatatacccgattcaaattcaaattcggattcaaatatttttatatatataatatttctataaataaagtttatgcgtgcaaagtttatggtataaagtctatgcacatgaatgagagtattagattttttttctaatttttttactaactttgtgtttttttttttgaattttgtgatgaaaggaaagaagggagaggagtataggggggaggggcgggttgatcgctcccagcgatcacccgcacggtagcctcacccatgattgtagtacacataataaattaccacgaacataaaaatgcctaattatgtaacacaaagaagcaaaaagatggtaggcactaattcatgcccactgcaagctagctgaaaaaaattgaaaaaatgatcagtttggagagtaaataaactataacagctaactgtaattttatagaaaatatttaatctatgatatcaatgaaaaatccacattgtaaaaacaataacacgtgagaggttatgtttagattttatgtcccaacaatattctttttatttactttatttatatttgctttggcacatacaaaaagacaaaagacaatgataaatatgtgatatcttaaattccaatccttcgcagtagcgtcatggttttttactcttgcaggtatataagctgctaatagcattgcataattgatggactttcatgtttaaaagttatatttttcctaataaatttacatttgatgactcatgttgattgtctttttagaaaaatatcatatgggtgcaacatatcatagacagatgttgtctaagatatgtatatttt

SEQ ID NO: 11282 - DNA, 4365 bp, Oryza sativa
agcgtcatggttttttactcttgcaggtatataagctgctaatagcattgcataattgatggactttcatgtttaaaagttatatttttcctaataaatttacatttgatgactcatgttgattgtctttttagaaaaatatcatatgggtgcaacatatcatagacagatgttgtctaagatatgtatattttcttcgtttttattgatttacatgcaaatatgcaacaaattatatgaatatgaattacagggaatgatagcttgatacacacaaaatatattcatcaataaattcttaatatttcataagaaaagagcgagccgatgaacattaaattaaaaagaatgaaaaaaaatcttacttttagtttgaaattaatttgtcaagccagtttttagcaaagtaatacacatgcatgcccgcgcattgcgcgggctatcttcctagtttattgtaaaaagagatacaatgaacacccaattaaaaatagaatacaccttactctaatttcagtttattttgttagaacgatttccaaaacctagttccatctaaactctggatcggaataggactctgaatcaaacggaatacgattccatcttgtgaagacagaagacggaagcgtggtcgcgattcgtcgccgccgccatcggcggaggtggcggaggctagcttcgagcggccaaattttgagaaagcctcttggggcatcgaaatttcagaaatacatgacagattctggaaaattcaagggagaatgtagcatgccgacgagcctcgatgaactattgaagctaaatcctactgaagctagcagactacgatgaattattcctgtcttgcaacccaagagacgcatgtcagcaacagcaagtcccttccctctcaaagagaggacaacaacttcacagtgcttgatcaaaatctcctcgccattttccttgttgtcatcttccccttcaaccacatactgtgtgtgttatattacctcggtttcattttgtttgacgttttaaaagaagaaaaagaagatccgttttgtttgatgtttctgacagcttcgacaaatttaatagaaaaaaaaagaaaaagaagattacatcgtcattctgaatctctatcggacgaaccggggacttgctcccaaagttttccaggaatcattggaggcagatggtgtaatttttcttgcacttggcgtttgctgccttaaaggacaagtgcttgatcttgacgctgtcttcacacggatccacgcgacttctcttccggacaccgaaagaaatcgaaaagaaggatgcgacatcatcgtcgtggtagcgcagctgtcgcatatccaaaggccttgccttggcggcggttgacgcagaggcgccacctcctcaccacgagctgagccggagcgccgccgaggcgagccactcgtaggcgccgcgtttgacactttgacccaggccagccaggagctgagggaggtgagcgcgctggctgcagctccctcgccgggacgaacaggtggtggcggtggcgtcgccatgagcagatcgatgtcgcgccgcgtgttcttgattcttgagagggttcttggcctcttgcggtcttgccttgcctccctgccctcccggagcgcgcgtccgtgttgtcggcggctggactctgcacgtcgcagcagagcgccgccctcttgccggcggcggcgggggtggggttggagtgagctccggtcgccggagggattgaggttggggctcaggcgagggaaggcgagaatgaagcaaagagcagagggtataaaatataaataaccgtcggcttctagaagagatggaagcggaggtggcagaatctggttgggttgtccggtccgggcccaccagtaatgtggggaccagtcttgtcttatggtgcacgtctccgcctccgctgcctcatccaggccggcgacggcagcagcaacctctgacgagacgacacggcgtaatggcatggcgtggcgctcgcgtatcctcgccgttcccccgccgcctctgaagacgtctcggtgcaggatggccgcccggcgatcgagcagcatgcctttgcgccgcgcaggtgcagcgagtgcctcatcgccctggctggctgccacggtccgtagccagtcgtggcgcacggtgcaccacgtcgttcggcctcgatgtcggaaacgtgtccagctagttcatcgtcgaggctgagctcgtctgcagcgccagcgccgtgtacggtttcgccgcggtgccgccggccaccgcgtcgaacgacgacatgacgatcacctccgatcaaacctgcggcgccaaaacgcaacaacctccacgttcttcttaatcgcaagcgaagcgagacggatagagaggcattacctgatcgatggagcatggccatgagcgctgtgaccttgttccggagatccttcatctccgacggcgagagctcgggggcagaattgctctcctgctcttgcgggttcgagctggccttgtcggcggggtcgcctgcgtgccgaggctaagcgacaccccgcgccgccgcgtactgcaccacacgggggtggcgtggcgtggcgtggcgttgcgctcgggtgtcctcgacgtgcgcgtgctccatgcccacgcacgcgctcccccgccgccgccgttgaagaggtctcagtgcaggatggccggcgatcgagcagcaccttcgacgacgcgccagccgtggactcgcctggcgccgcggcgcgcatgcatgttatatgtcatgagaccatcgccatcgggcacgatcacaaactacgccatcagccaccatattcatcggccacctccttcatcagccaccatataatacttccttcatctcataatataaggattttatcccttctaattatcccataatataagaactttttttagaaacaatataagagatttttgtgtagtacttatcaattttctacctattttaaccccaactacccactccccataaccaaatctcttttaatagggatattttattgttgctatcattaattttttaaaaaattatcccttatattatgggtgcgttattttagagaagtagaaatcagaggtagtctatcgctcgtgctctatctctgcatttagttcaccatcccacgccagaattaagttggattctttttattttgacattagttttgagttggattgtgagctgtgcttgaactgactattaggccttgtttagtcatatcccacccaaaagtttttaccctgtcacgtcgaacgtttgaacacctccataaagtattaaatataggttaaaaaataagtaactgcacatattgcgtctaatttgcgagacgaatctttttagcctaattgcaccatgatttgacaatgtggtgctacagtaaacatttgctaatgacggattaattaggcttaataaatttttctcatggtttactaacggatactgtaattagtttttttattagtgcccaaacaccacatacaataccctatataatacccgatgtgacacgccaaaaacttaacacccctggatctaaacactcccttagttcctaaatttttttcccaaaaacgtcacatcaaatctttagacacatgcatagagccttaaatatggataaaaagaaaaactaattgtacggtttacatggaaatcgcgagacgaatcttttgagcataattagtccatgattagctctaagtgctacagtaacccatatgtgctaatgacggattaatttggtttaataaattcatctcgtagtttccagacgagttatgaaattagtttttttatttgtatccgaaaaccccttccgacatccagtcactacgggagaaaccatttttgctaggttggccaaaaactacactagtcccattcaaaagaccagggatacttttttttttatctttagtcccggttggtttttaatcccgattcaaaacatggcaggcgatgtcagacccttcactactaaagatctatttgtaatctcgggtgttaaacaattgggaataaaattcggccccgagcgcacaacccggccgcctcttcctctacaatctctttctccttctttcctctccctcaccactcacccccatctcctcctacctctcctgcgcctccggcccctgcggcggcggatcgaaccagccgcgcggcggtggccttccctcccgctgattccgctcctccctctcctgcacctgcagcccccaggcagtggaacgagctggtctgtcggtaagcggctgggcggccgaggcctctcgtggcggtggcccacgcgagggcggcagtggcctcccctccgcctgatt

SEQ ID NO: 11283 - DNA, 6632 bp, Oryza sativa
tgttatagtgcacaacccggcacaccaaccgtgggccacacaggtcacattgggcctactccaccaccagcccaatcggagccataactttaggtcctgagcctatacaacccaaaagactagtctgatgggtgaggaccgcccccaccttttatgtcgtgttcccccatcatcgatcaattaccgatgtgggactaaacccaacaattaccctatcacacatcgggcccaacaatctcccccatcatatcaactcatattaccccgaagacgtgttacctgggcctcaggcctaacaatctctcccatcacatcaacccatctgaccccgaatgtcacatcaacccatattaccccgaagacttgttacctgggcctttggcctaacaatctcccccgtcacatcaacccatgtgaccccgaagtcttgttacctgacctccccaccacgtgacccacattgaaattccatcacatcaacccatgtgaccccgaaagtcacatcaacccatattaccccgaagacttgttacctgggccttgggcctaacaatctcccccgtcacatcaacccatgtgaccccgaagtcttgttacctgacatccccaccacgtgacccatggaaattgttctaggttccaaaccttgggctctgataccacttgttaaagtgcgcagcccggtccaccaaccgtgggccacccaggtcacattgggcctgctccacactagcccaaccggagccacaactttaggtccagcgcctacacaacccaaaagactagtctgataggggtgaggaccgccgccatcttttaagtcgtgctccccatcatcaattaccgatgtgggactaaacccaacaatgggcgcgagggcagtggcggcctcccctccgccggaaccgggaggggaggcagccgggcggcggctcgatccggagcgagccggccgggctgcagccggcgacgactctaggttgattcggctgtggagttgatttgtatattttttttctgtgaattgatttgtaatgaatgatttgtcaatttttttttgtcgatttgaagatgattttgtgattgatttgtggattttcgatgggcatgtattgtggatgattgtgtatgtagatgatgtttgtatatgatttgtgtatgtggatgattttgtatgatttgtggggatatttgtgtgtgactgagattgtggttgagtgcaaacagaataaaaacaatggaaataaaaagaaaaaaaatgttctttagtcccggttggggtaaagatcttcagtcccggattgataatcccggtttgttatccgggataaaagggggttacaaatagggactaaaacccctttctagcagtgggtcaaacgttcgatgtgacacccaaaaagttctttttacgaactaaacagggcctaactattctgttcgatcttggagttcatatctaccacctctctgccaatgcagtcgtagtgattgttagtaaggggagcaaatgcgtatactgattgatatcggtttatgtaaaatgtctaagactttatttattgaaagtgtctttcgattctgtagacttcaagtgaaaataatgttttatgttgcttcctcttagaaagtatacgcgtattgaatgagtatttgtgaatgtattaatggtatggaaaccttgcatatagagaactgattgtatgtttgtgagtgagcaatgtattggatgtttctttgttgggaatgaattactaacgttaatatgtttcagagttactaatgtgcggatttgttatttccgtctcaagttgctaggacccaggaggcgcaaactggcacagcagaatcagtgctcactgaagatgggcctgatgtccctttatctgacagtattgttttacggaagcttcttttaagtactaagtgaatttccttgtatatgcacatgtggcacaagacaatactccctctatcccaaaacagaagacataaccactcataatacaaagaccaagaaaacatttattcactttcttgattggatcaccttaatgcatgcaagcaatgtgattgggaggtttgatgatagaagatttaaaacaaatcaatcttataggaccaagaaatgctaattaatgtatctattcatgcataccttatattatgatatatgagaaaaaagctgttgagtcttatattttgggatggagggagtaaacttatgttgcttttcctcatgatctagcgcataccaagatactttgatcctggtgaaactttattggaaacatgctttaattgtggtgaggagggtcatgtagctgtgaactgtccaatggaaaagcggaagaggccttgttttgtttgtgggttgtttggacacaattcaaagcggaagaggccttgttttgtttgtgggtagctccaaggcattattgcttggtgacttgggtatgcatgctcatgcccttgacaagatcatcttatttagttctccattaattacatgatgttgctgcatttgttatttcaactcataagttaacatgcttgccttgtttagataggttctagaattccagttcattaatcacacatatttacttcacaaattttgacaatttgaccctttgcaaaaaactattttttacaaatgaaccgccgccaaaacttatttcaaaactgacccttttgcttaacaccaaatcgtgtggcgctgaacatagacatctcactgccaaatagcatagcactgaatgtacgttggcatgctgacttagcctcccatccgccgtggcacgacattcagcgccagctgaagtggagctgaggtgtttaaattcagcgccacatgatttggcgttgaaaaaaaaggttatttttgaaataagttttgggggcggttcatttgtaaaattagtttttttcaaagggtcaaattgtcaaaatttgtgtatttacttgcccctgccaatttcaggaatcaaacatttgttaatcatttttgtagggtcaagactgtttcatctgcaaaaaaggaggtcatattgcgaaagactgccctgaaaagcacaataggaatgctatcaacagtctacattttatgtacgatgtggagaatcagggtcctgatatgtttggatatgccaatgattatccacgcgatgatgttaaggtcagtattgttttctcatggagggatacttgcctaaggaaaaaaaaatctaactcaacatatctttaaaaccatctctcacttttaatatgcagtggttacaatctaaatcctactgctaatgcaaactgtgctgcttcagaatatacctatgaatgaattgtggttttgtcattttcgttgatccagctttatgttctattcacaagcttggttagattttgtgagctaaggttaattttacattaagcccttccttatacttctgtgttagtcgaatccctgaatccacatgttttgtccacttaattaacatgcaatataacgcaaatcattctcttatgtaacacaaaagtcctgtagcagcgagattgcattaattgaagtcatagtattatccaaacttattttccccctcaacatctactttgttggtctgtgcaggaagaaaattgctatgcgtccgactgatatgtacaacttacatccgacaagggcggagctagagtatttgggggagggggggaggacggctaggaacccgttcaagaaaaaattgtacctatacctgaatataaatttaggcactggtattagcttaaacttgatataaagcagagtaaattaaataagtggcacccccctccatctcgctctagcttcgccccattcccactagtgtatatataggcatagatgctgcttgtttgggtccacatgataagaaacaagctcagtgattagtagatatgacatagtcagacacgagtcggatggctcggtcatacgtatagcaggtttcgtgcaggaaataaaatgctatgtgtgtacgtaatcagaaaggtcatctttgttgcgccgacttctctgatatctgtccaaaagaagttgttataattctgcccaacctggccatactggtttggtaagtttagtggttattaacttattatggcttccttgtttctatatgttacttctcacagcagctgatcaatgtcttctgatacagggatgtgccaagcaacgtacgtagggaagctagtaccgcggcaactccaactttgtgttacaaatgtggcgaggaaggctacttcgcacgtggatgcacaaagaacaccaaggttgttagaagcatcttattaatatattgtctactgatagtgataagagctgcttgggttatttatcctgtgcacatcctggttcctttttaatttgcagtctgatcgtatgaacggtgaatcatccgcacataggcagtgtttagttccaaagtttttttccaaacttccaactttctatcacatcaaatctttcatacacacacaacttttcagtcacatcgtctccaatttcaactaaatttcaaactttaggccaatctaaacacagccatagtcggaaaaaaggcaaaggcaagaaagattttggcactagggctgtgtttagctcatgtcaaaattggaagtttggttgaaattgaaacgatgtgatggaaaagttagaagtttgaagaaaaactttggatctaaacagtcagctccttatgatgctcacaagacaagtaaaaggaaaatccccttatttgaggaaagaaggaactcatctcattttaaatccaaagctaggggtggttggattgcagacgatgcagatgaccaaccataaagaagtacaaacccaatgtgtgggcttctccatctacccctaaaaagcaatacagtaaccatcagttttcctatggcggtgactactctactcctcagtcatcaagtaagcggaaacgtcgagcgcaacttaagatgaagataaagatcaagtgtttcacgcaaaacgaggtgacatatgattaattatgttttaattattataaatttaaaaaatcgattaatctgatattttagagcaactttcatatagaaagttttcgcacgaaacgtaccgtttagcaatttgaaaaacgtgtcatgagtatccaaaatttcattttttgttggagaaacgaacgcagccactcaccaaacgcaaggaagcatagcttttcgtcgtcgagatttgccagcaacactcgtgtccggtttggaagaagctagctggatgctagtttttgatttttttttttgttgccgttctgtttacaaacacaattgatcatctcttgtgcctgcaagggctgtttctgtatcttagattacacatgttgtgttactcctgctcagttccaacttcctttacttccccctttccagctccgagcacgctttcccggtgaaatctcgtggctgtggcgagcagatttatgaacctgtctatttgttataattgtgcagccactgtactgcacatttttagtcccaccttgcttaccgatgacgatgaggcccgtggggcgcagccttcaaattcgtcctgccgctaccacgatgccaccgacggcagaaccgttgcattttgaaatcgttgtttgaattttctaatcgcttcaacgatttgccccatcgttctttctcccgaaaagctactgcgcgcgtgcgcgctggcaactcgcctttcaggagcagttaaatctaaccgactaaattagttttagataatggcgctaactaagataagatttttcctttttttagatttcttttaatagactgaaaactttcaagttaggtttaaaaaacttaagatttaaactttgaagtcaaatagtgaaatctttctactcaaactttgaaaattttcaactcgaaatttaaatttgcaagagaaattttgaaaactttcaactcagatttgaaaaatttttaactcagatttgaaaactgttaacttgagatttgaaaactttcaactcagatttaaaaatattcaactcgagatttaaaaactttctactcatatttgaaaactttcaagtctagatttaaaaaaattttaagttaagattttaaaatttaagatttaaaaactttcaatacaaaacatttaaaaacacgtgtgctacatattaaaaaaaataaaaaatagaaaagaaaaaagaaataaaaaaattgtgaaaaaaacgaaaattaaaatcgcctcgtggggggaggggttgccagctggcacgtgccagcaacgttgctactgcgcgcgcgcaaattaaccgcccccttctttctctgtcgatcaaaacccttctcttgtttcttcctcagcgagtgggaaccagttcatcgaggctgcatacggtgatggggtgggcgtgcggtttgggtgcggggtagaggtttgtggtggggagattcctgatagtgaagtcgtggcgataggagttcacggtcggcggccagataaggtgtgcagtttaagcgcgaggacacatgcattgtgtgaagtggcgtacgccgtcgtagggagttgccctgcggtgaactagatcgccagctccatcctttgttatattgaaggaaaaaag

SEQ ID NO: 11284 - DNA, 6472 bp, Oryza sativa
atataagacaaccgcacgggataaaaggattatcccgtgcggttgtcttaagcggaccgcacgggataatagattatcccgtgcggcccacagcctggcgccgagatcgcctggttccaggcggagccacttacggcccgcttggaacctaaaggggtcggcgtccaagaaaatcacatgtctagtagtgttgatggcctccggtggagcaaggccaacttacttgctgctttctggcacggcaagcacgatgcggtgatccgttgacgtgtgcccaacatcttcagcatgttcatcgcctacatgtccattattggtgtatggaactattccgacgcacgtggatgagctcggcctctgatgatgagctagctggacacattcctgatgtcgaggttgaacgatgtagtgtgcatgcgggggtgacaatttccccgttggaggtagggcctcagtggatcactacccctataggactaggggtaggtccaaatatccaccagcagggcttacgggatgaggccctgatttagtgcagggtcgagactatagtgcgacctcgccacccataggacctcgaagtataagacatgcagcccactggccatcaaatgaggcagcccatgcatataccagctagccaccagaaccccatcagaggaggcaacaccatatggctgtgttctttccaccaaactgccaacctcacctctcttgtttttcgtgcgcacgctttctaaactgcaaaatgatactttttttactaaaagtttcaatagaaaaattgctttaaaagacatattttctattttaaaattttttaagctaatacttaatcaatcatgcgttaatctatcgctctattttgcgtgcggatgggaagggttcccaactcctctaaaggaacatagcctattacgttctagacatcaaaagcccataaagaaagtagcagcccactttgaaggggatataaatagaataacaaaggccaaagcaaaccctaatccatctcagtacgatgctcccggtggcggcagcacaatctggcgatcgaagacgaccgcgtcggcttctttccactcaccacccgccggtgccctagggcgtctcccccatcgtgctagccaactacgcaagcccacgtcatttccctccctctccggtcgacttcccacgatgtctttttctctcccttagttgctccctctggctgtagttgcccctcagtgttcttctctctttccaggaggggctgggtgtcctagttgcccctctggctgtagatatgtagggacctagccgtagtgcggggtcctagagaggctgggggtggggactaatttcaacccattctcccctctggctggggccatgtgaatccacaagcaagcggggatggggatgttcctgtccaacccaacctcacccaacattaatggtgggcctagacaacgtacccaaccgcattgcgccgccttctcttctcttatggcgattatttatatccttgcagcgtgtgtcatctttttctccattaagcttcatgcctcgcctcacctcgcctgagtcccagccatcaattgcaccgacgcccggttcccactagatcaacagggccgcgctacgggagggaggcaagagcaccgtctcaagaagccaatcaagaaactagacacatggacatgccatcgccactaccaccagctgttcgacacggtgaggcagctatagcttgggtgctcacaagggcggaactacatagagccatgggggttcctaggcacccggttgaaaattttttgtaagctgtaagtatccatctttaccatgtcggcaccccgtcgacctaactttgtgtaccccaagcagccaatcaggccgagcaagggcaataaaccaatagagacacatagtgatgagtattcttgtgggcatagcaagtttagtttggctgttaagtataacactagtcgataatttgacaaattgtcatgcttagagcccaacagaaccagcctcgtcaaccttatctttcgtcaaccttatcttaattggtacttcctcgtttttaatagaggatgctgttgccttttgaacacatgtatggttatttgtcttattgaaaaattttatgcaaaatgtgtaagatataaatcatgcttaaaatactttaagcgataaaacaactcacaacaatatcacatatatccacacatgtaatacatttttatccattatagtttatataaatatcaacagctcctttcatcaaactttaatcacttgtaggaaaagattgacactctatcaaacttctcatatcacaaatatatatcacactagaatgtcaatccttaagggttaaaatattgaaggtaggaggtgatcatcatcagcaagagcacttatctttgtttaagcaaaagaataagagagatattggtcttcacattttattgttatggtcagagttaactctagcatgatagttgccgagatgtgttttgattttttcttgtccgtctcctctttatacgatattcagcggctgtaatttaagttgacttgataactatcctattgataacattcttatttgtttatatctaatgttcaaaagaatcttctaataatttttatttctgttgtgatagagaaaacaactctccataaactatatatgatgctatgtttttctatacataatacttatattagtataaataatacatgtcactaaatcgtatatagcagctatcatattttgttatcaaacaatatcacatatatccacgcatgtaatatacaagaataagagtattagtgcatttttatcagtttataaaaatatttttcctccaacataaatataaaaaataataacaactgttaataatttattcacacattataacaacgtagatacctatctatatatctaaaagttgacaaggttactgcgagttgatggtcctatatttactaacacgtgaagcagagctaaaggagagtatacttatacaaattgtgcattaaggttcttagaacacccaattatattgtttattttgtatgactgatttttttttcttccgttctaacaatcctttacatccaaattgtgcacccaacggtttatagatgatgtggctcattttgatgtcattttaagattttcttttaatattcaatactattatactattaaacaattcgatactaaaaaatccataaatattttatcccttactattctatataaaaaaccaaaacaaaagactatataaattagtatatatgagctataaaataatctgtgcactaagagacatgcctaattcataattataaaaaaatataagagtaagatctttagggcaaatatagataagtccatcttctccatctgactttgatcacttataggaaaagatggacaagcctaacttataacagctataaaaagctggacacaacattaaacttctcatatcataattatatatcacactagtaaaggatgtcacactagaggatgtgtaagcttaagggttaagggttacagtattgaaggtatgaggtgatcattaggaagagacccatttaatattattcctccaacctaaatacagacaataataacaatggttaacaatttgttcacactttacaacaacgtagatatctatttatatatctaaaagttggcaaggatactgcgagttgatgatcctatatttactgacacgtggagcaaatctaaaggagagcataattatccaaattgtgttcatgaaggtggatgaaggttcagaacacccaattattgtttgtttttttataactgatttttttctcttccgatctaacagtcctcttcatccaaattgtgcatccaactgttcatagattatgtgcctcattttatccaaattgtgtatctaacggttcatagatgatgtggctcattttggttgcattttgggatttcattttaacattcaattatattaaaccattcgatactaaaaaaatttctaaatattttttaccttattattctaagtacaaatgcaaaacaaaagaatatataaattagtatatatgaactataaaataatcagtgcaccaagatgcgcacctaattcaaagttacaaaatatataaatggattggaggatctacaagaaaatactgtcaaccaaaatatataaatggatgggaggatctaaaaatgaattaaagagttcaattgacaagagcaatgtcataggataagatttatctttgcagaggactttgattgctttggtgttgtatgggtcaggtattaagatgctgaaattggtgcagagagttttctaaagagtgatgtacaagcttcggtatggcgtcatgcttatggctatacttgtaaagtgaccaccaccctcctcgccatgcttatggctatactttgtaaagtgaccaccaccctcctcttcttttgtagttaaccatctactatcgaagaagaagaagagaatatttatattaactagagaaaatgcctgtgcgttgcgacaggtggatgctattttaatcttattattgttatacaatttaattaaggtgaaatttactgtggaaattcgcttaaatcatgagctgtaattagagtctgatcgtctcaagctagtatgtgagttttttaaaagagatttcctatatgactcttctgcatttccaaaagcaaatgaacttaataaacgactcaaatacggatatatatttccaaaagtgaatgaacttgaaaaccaactcatacacatatgacataccaaagcactggtaaaaacatcttcaaagaaaaaatgccagtgcgttgcgatgggtggatgctattttaatcttattattgttacacgtttaattaaggtttaatttactgtggaaatttgcttaaaatcatgagctgtaattagagtccgatcgtctcaagttagcatgtgagtttttgaaaagagatttcttatatgattcttctctacttccgaaagcaaattaacttaataaacgactcaaatacggatatgtattttgaaaagtgaacaaacttgaaaaccgactcatacacatatgacgtaccaaagcaccggaaaaaaatatttttaatttttataatagtagagattaattaagaagggaaagatagatcttttttagacaattttctgatctgaatatttaggcagcacatttgtaattaagaatgtaaatatcaatattcaagcaaaggatctgtaattaaccatgtaaatatcaatccgtgtcacacaattgaacattcgagtaagcagaagatagatatatatgtccgacaatttcatagtttctaaatattcagtcatagcattcctaattaaaaatggaatgattgatccatgttagaaaaatcttctgatttctgaatattcaattagagcaattttaattaagctggtagaggtgtatccatgtgtgataattttccgaattctgaaaagccaaacaatgcatttgtagttaagcatgtaaaggtctatccaatcataacaatcttctgagttctgaacatcgacattcaatcaagcaaagcatttctcattgaacacagaaagatcgatccatagatggagcacctggatcgccatcctcttccggacctcaagcaccaaaagtgctcgtcaacggatcgccacggaattccatcatccaccaccgtggcgtccggcaaggtgatccaatctcaccgatgcttttcatcctaacgatggatgccctctctgctctattcgccctctccacttcttcccctgttggggatcccttattgggtgtctctctacatcgacgatgtgatggtcttcttacacccctcagaagacggaatccttgcaaccaaagaaatactgggtatcattggagatgctcctgggcttcacacgaactacggcaaatgtgtgacgcttgcaatcagatgcactaacgcgaaagtggacgcgtcttccaaggcttgcttccttgcccggtcactaccttcccttggggcttgcctctttgaatccagaagcctcgccgagaaaacctgcaccctatggttgataaggtcgcgcggcagctgcccctatggaagtcgtatttgctgcaaccggtggggtgggcatcgtcgtctgcgaggtcgccttccaagtcaagattctgcgctggacggaaggaggcggccggggacgcgtcggcaaggttttcttggatgagaagattcttggcgccgcagcagcaggaggaggccgggggcccgggcgcgggcctgtcaccctcggtgaggttttcttggaggagaaggttcttggcgcagcagtagcaggaggaggggccgggggcgcgggcacttcgccgtcgatgaggtcatcttcaaacagagcattcatggaggactcaagggtcaagg

SEQ ID NO: 11285 - DNA, 1539 bp, Oryza sativa
ttcgccgtcgatgaggtcatcttcaaacagagcattcatggaggactcaagggtcaaggccaggagaagggaagccatggagcggatcgggctggctccgcgtcttcctcgacatgcttcttgttcttgttcttggagcctctcgccatggccgtcgaacgatgggttctttgagcagctcgtgaacgcggcgaagctagacgagggtgtagtagccggcgacagcgccaggtgactccggcaagctcctcttgtctcccgattggccggtgagagagaacacacggtggtgtgcctcggaagtcgtggccgttgttgagttatgagcagaaggggtcgagggggaggagggggagaagcgaagtagccgaagagatataaatgggcgagtccacgtggatcgtcagatcaagtattttttttttaagaagaggaagaataagtttgggcttttcatgtatgagatgaagaatgttcaggatctttttgtcacacattgccatttatttaccgctaaaacattgtcaggtactagaacacattcagagtatcagattagctgcaccaatgcagtatacatggagaaaaggaagaacttaaaacacattctgaagatgatgaattcaagtagatgaacatgagcatttgtttcaagtcatcagtccaatgcagcatcggaaaggggtttgatttgttattcaggatgaaattgtgccagaacccggaaacatgccatatagcacaaaaaaaagtgtgatatatgtttcagggaaaaaaaagtttcagaatcatcgctcatgctcaaacatcaatcccaatctcaatcaatcctaataaaatccaattcaatttctctcaaaccaaatcttgaaggatcttgaatcaaatctaaatgcatatattattgtatctctatccttcacctttttattcaattcaagaaatctaagttaacatggacattgagtttccaatcttgttaatccattacattaaaaaactttttaatacgaaattatccaaaattttaaactcactgttctttttactgggactggtcttttccctgtagcgtttattctgattcctcattttaacatcgagtttgattttcgtccctaaaccataataccagatataacgcgttcctcaaattacaataccgtgcacccgagatcgtaagcagtatagtgtccgattttgactgtcatggcaagttgattcggctgagtcaatatggaccccacgtgtctgcagcctactcttcttcctcctctttctcccactcctctctattccccatatctcactcggcctcctagcgcgtccaaggacgagttcgctgttaattaactaccctgacgagttactgtaactgccgttgattaattagtgcgtgcttgctaaaatttgcagccatgggagatgtacacgctggacactacgattgacctgaaaatcagcaccacgagccgaaggtcacctactggaccgtcaaggcgttgtgcgtgcccactgacatcttcttccatcgttaat

SEQ ID NO: 11286 - DNA, 594 bp, Oryza sativa
  unsure (1)..(594): unsure at all n locations
nnnnnnnnnnnnnnnnnnnnnnnnnnnnnnnnnnnnnnnnnnnnnnnnnnnnnnnncgtcggcccagatgcccgatgagaagcattctcgctgaaattccatctaaaactcgagaatgctagttctcggtcgatcggcgcgggtgcgttaaatcggacgctcgcccgtgtctcccccatggggcacacccacatgtctcccctgcccccacctgccacttccacacacacaactccattgtaacaaatcacccacatattttagaaaccctatattaggggcatttggtttatttttttccaccaaaaatgttacacctagttactcacaatatttcactatgtgtacatctaacgttgcagtgaacgaaacattccattgcaaccaaaaaaacccgcatattttggaaaccccctattaagggaatttggtttatttttttttccaccgaaaaatgtttcacctaccgacttatatgtttactatatataaatcaaatgttacagtgaactgaaacattttttactatttactgaacattattttatataagctaaaacaacacccgattaaacgagtgaaacattttcggtt

SEQ ID NO: 11287 - DNA, 392 bp, Oryza sativa
  unsure (1)..(392): unsure at all n locations
nnnnnnnnnnnnnnnnnnnnnnnnnnnnnnnnnnnnnnnnncacataccaccacggtatacggacggaagacgtgacatagttcccaacccatcctagccatcaacaagagtaccggcccaaccccacctacgggcggaaccttcgggacaggcaggcaggattgagcccctagcagcaggacaccagccctgtgccatgacatttggactaccgggccgcagctcgtgtagccttcatttgtcctagagatgtccatcgacccccgacttcgtccatctccattcgtgtacttttgtgtataaccagactgagccacaaactaatccttacccactagacatgtggaagtacggtagtgctttgcaacagaagccctagcttaatccttat

SEQ ID NO: 11288 - DNA, 787 bp, Oryza sativa
cccccaagagccagggttttactgtacaaactctgaactctgaagatttgccaacttttgcaagtccgattctgatccagagtttacacggaaatctgcccatgttctcatttaaccactgaagttggtgagatttcctcgtcctgctcgggttggggagctataaattcagagcgatcaggtcacattggagtcttttcttcagaaatcattccaggatagcaagacatccaagagccaggttctttttaacaggcaatatgggctgtacaatctccaaagttttcccaagttttgcagagaaattcttgaaagaagccaaggcaggaaattcaccggagctgccgcaggatgtgctgatggagatctttgccctcctggaggtccctgacctcgttcgtgctggctcggtgtgctcctcatggcgcgcttcgtatatcagtctatgcaaacttggaggctacaggcaggctcagacgccatgcctgctctacacctctgaatctgctggtgagaatgtggcatgcctctacagcctcgcggagaagagggcatacaagttaaccatgccagatccacctatccgtagcaggtatataatcgggtcctctcatggttggatcatcacggcagacgagagatctgagctgcatctcgttaaccccatcacaggtgactagatcaacttgcctacggtcaccaccattaagccggtaaagcctgtctacgatgacgccggcgttgttcacaagtacgagtacccatgtcatgttggcggtcagcacaa

SEQ ID NO: 11289 - DNA, 14527 bp, Oryza sativa
ccataagaattggattgacgattatgtggatcagacggatggagatgttctacaatttgagttagacaagtacgaggatgatttggaacatgcatcagaacatgagaattggagggctggagatggtttgaagcctgagtcagatgaggatgaggatgaggatgatttggagcccgagccaaacactgattcacttgtggtaaataccaacatgattaaagtatttaaagtggatttttctgcaaaaatgcttgtggacataaacagcttaggtaacagtgtgttgtttcttgggtataatcaaactctttgtctaaatgctgatgtatatccacagttgaagccaaatcatatctactttacagaagatgatagcttatatctatttaggtgtaagaagaaccgccgcgatactggagtcctcgacttggaaaatgataccatcgagccgatagtatctccggagctttggtccaactggccagtccctatatggcttataccgaaccccaggaagatgatttcagcatcacacaattagggagaagatgttttccttcatccaacctcttatctgtggctctgattgttagttatgagaaagatatttagtagtaatgtgtaataaaaggatatatgggaaaaataatatttatgtatgtcttatgcgctactaatgataacattctaaactgaagttttttttagcaaattaccactaaactgaagtgtcatgtaacaaatacacatttctagattgttctatgctaaatgctaggaattcatgatgtaccatagcaagtttaaattgacattttttaattcctatatggaattaacttatatattgctaaggccacaacatggttatttcactgttaggattccttggtgtagccaatatgtgcttagtatgatcaatatgatattcgattggtcacgcgacttcatatatcacatatataatttagatgttatgatcatcttaagattatttatttatctcttaaaatatcatttattgataaaagatcaatatcaaattgtataggtaaatagctcttatatacatgcttagagaaaaataattaagtagatggaaagtcattagatgtttaacggaatataagtactgggcctaccagttttatgaaaatttaaggtgggatattttgaattttagtgagaaattttagaattttcttttatttagtggagtccttaatatggatgtgggtccagaatgtaaatttttgttagcaaaatatagtcaatatgtattaaattattgatctcacataaaaaatatggtaattcaaacaaatcataaggggcatagggatagctggctagacctaatatgtggaggttcaattgtgctcttttcttcaaggtaaaaaaaaatcatggccttttctttgtccataaagataattttaattttaattgttatagagatagaaaaagtagagaaaagtaatgccgcacaccgcacaggaatagggatggagggaaagttgggatgtcttttttaaaaaaattgatctatctaatgatctgaaataatgtgttgatgtttaagttaaaactaatggtaggatgttttattttttttccgatttattaggattttctgttatttaagcgagattagtcgcagcttagtaaagtatttatgtactttaatgtcctaattgtttgggatttttttaaaaaaataaatctaataacaaacgtaaaataatgtatccatcgatttaagtagaaacaatggttgaatgttttaagttaattttaagtttaattgtgattaggatgaaaaaaaaagagaaaggaacagaggtagcgtacaatacgtgtgtgctgcacggaggtgcggacgtttataggttttggtttttttaaagatacatctaacattctaaaataatcggttcaccgatttaaagaaaaatcgatgaccagatttctcaattttattagaataccacgtggcggcttgggagtatttttaggcggccacatgacggcttgggagcgtttgtaggaggtttaatggacttttagtatataatagaaatatataaagataaaattagggtgtgtagaaaacaattaggacatgattatttgattttaattattacaaacttgaaaaatgatggatctattcaactttttaaaacaacaggcaccttatataaattgttaaaatttttgtggcgttaggattgtgaatattttgaatctgtccattgatgaaaaatatgaattttaattgtaaatccaaattttatcattgagctacgtaggatatataatttactaacagcgtcttgtatgtaggagatataatttgctagtcccgtaggagtaactaatctagcttgcttttgctaagagatagatttgatatcttatacgaaagtatcaaactaatctacgtgagatggatgcatcgtgctgggctgaacatgtgggtcctcgctttctatacacacaaatacaccatgcatcgtacggggctgcaaatgtgggtcctgatttatcttgttgtgccatgtggcggcttgagaacgttttgaggatgccacatgtcagcttgagagcgtttatatgaagtttaatggacttttagtatataatagaagatagataatagatagatagatagatagatagatagatagatagatagatgtgtaataaaaggatatatgggaaaaataatatttatgtatgtcttatgcgctactaatgataacattcttgtttgtttgcatctaatgtgcaaagacatcttctaatattttatatttatgttatgacagagagcattgtggcagctccctatgaattttattcttctttgtggaagatgatttcgtttactacttgtgatgccatattttgtacatgatgttggcaattatattctccagtcccccacatgcaatatataagagttatagtttgtagggatatcaacaactccgtccatctggctttgatcacttacagaaaaagatggacaattcaaacttatcacaactattgaaagctggacactccatcaaactttttacatcacaatgatggaggacataatctttgtatgatcacactagagaatgttaagctttgcaaggggtaaaagattaagttaggaggtgatataacagttaaatagacaataacagttgttaacaattttttcacacattattacagcaaaataggagtaagatctttacctgtccccagatcatgaccatagccgttcgtgtttaccgatctcacctttggttctccccctcaccatgcatcctttttcttgatatttgatacttcttgacaatgtttttgaacctaaatcagtgggacgcgactcccgctcgggcgcccgatgggaggaggttaaaatcgggcgctacatgcaaaaactactttaaactgatttgtctcttaaattacttatccaaatcatgatccgattgtaccattaaattcgttgcaattaaatattcaaaacaagaccacacatggatatattccaatgaaaaaaattagcttattattgaattattattaaatgttgcgcgatgttccaccaggtatatcggaattgtttcactaagtagattaaaaatgtttcactcgtttaaatcgggtgttgtttcaccttatataaaaaccatgtttcagcaaatagcgaaaaaatatttcagttcactgcaacattagatttatacatagtgaaacattgtgagtacactaggtgaaacatttttcggtggaacaaaaaataaaccaaatttccttaatagggggtttccaaaatatgtggtttttttttgcaatggaatgtttcgttcactgcaacattagatctatacatagtgaaacattgtgagtacactaggtgaaacatttttggtgaaataaaaaataaaccaaattcccttaatagagagtttctaaaatatgtgggttttttgttgcaaaagaatattttaattcactgcaacattaaatctataaatagtgaaacattgtaggtacactgggtgaaacatcttttgtgaaaaaaggggagggagaagtgggttggcccaaacaggtgcgcacatgggggaggaggagcgaccgattttcccacctcccccggtcgaccgatgctgggcattatccaaataagggtggaaagtcaccctgctaatgaatcaaggaatagcaaatgacaacttcaaaccttggatttcttcatagtaatttttttttgagattacacagcagacacacgcatacaccactacacatgcaacactacactcacaaccctcgaatagtatttggtctccctgactttagaaaacatatcaaattttgttttctgaagcgtcgagtagaatgcagaagcttgggtttagacaccagtggctgtcccctcaaaagttagaatagtttctccctgtagcagcactgacttttaatgtgaccacgggcctcttctaggtaacattgtgctatccatcatggtagttttctctttctttttctttttcttttccagagcctgtttagatccaccccaaaattttacaccctatcacattgaacgtttgaacacctgcataaagtattaaatatagtctaaaaaataactaattgtacagtttgcgactattttgcgagacgaatcttttaagcctaattgctccatgatttgacaatatggtgctacagtaaacattgctaatgacggattaattaggcttaataaattcgtctcgtggtttacttgcgagttctgtaattagttttgtcactagtatccgaacaccccatgccacatcccatgaaacatccgatgtaacacgcaaaaactttacacccctgatctaaacaccccctcatttgcttagaacaggtttgaggcttttcttttgtcaagtacagcacattgctattcagttagtagaacattgtcaggtaactatctgcacaaatgcagtacagggacgtcaggtactaacattcataatttcaaactagctgcgccaatgcattacagggagaaaagggagaacctaaaacacattctgaagatgatggaatcaagtacatgaacatgagcaatttgtttacttaaaagccgtgggaatggctgaggattagggcgccacgtcatcatttttttttcagaaaaacccttgctctttccgctaatagcgtgtacatccccgttaacgtggcccgtcggatcacaagctaaggccgatttgaccgtccacgtgtcccagcatgactacccttccaccatcgtcagatcgttggattggaaacggatggtctggattcttcagccagtacaaaccctagccgcccgtcctctcctccccacgcacgccgccttgcccacctcctccaatcgcgccgcagcctcaccgtcctccttccctcgcgtgcgtcgtcgccgccgcagctccctcctcctccactccctcaacctactcgtcgtgccgccattgcagcctcccttctcctccactccctcaacctactcgccatgccaccattgccgctccctaccaacgagtcgccggatctccccgtgaggaggccggggccgccggatccagtgaccccgttctcctcgccggcggatccggcagcccaaagaaaggaatgagaaccgccggtaccagcggatccgatgccctaaagaggggtgagagccgccgctgcccagacggggtcagcaggccgccgccaccaccctgcgtaggctcggccacgactgcgacgaagacaaccacggctcggcgacgatggttgtctggtcattcttttttcctttgtctcacgttttcccctcccagaaatcctccgacgcctgctcatggtctcatggagcctgtggccagctgccgccttcccctcgagctcgcgaagccggagccgctgccttcctctcaagctcgttgagccagccgttgctgccgccgtgcggagccagtggttaccgtcatcgtcttcccagcgagctagcagcggctgctgccaccttcttgcaagttcgatgtccactgtcgccgccataccgtctctttctccatcccacgcgaacttggttctgcaagatctgtgccgcatcgagcgcctacaagcacgcggtaaccaacaggtgaaactcgacatgggtggcagcagccaaatctcctcctgctgatactactcctcaaattgatttctcagttctctttacagtcctgcatctcatgctttcttcatatcaggcttatatgactggtggaaactgttagactttgctctaggatcacctaggttagatgtagtcgggtggttctatttgggattgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcagcagcggtggtcgtgggcgatcccggcgaggtcatggcgcggcggtggcgtttcccgtcactggctgcgccccctctcgatcggattagggtttgtagggtggagttggcggcggcggtgaatctcgtcccttgtgccgtgctggcctccacctctcttttatatggcgcagtgtgacgggggcccaccagccattgggctggatgcccccgatcagggcgcggtcaaggtccgttatgccattgggcccgatgggtgggagatctatctaacattctcccccttgatctcactatttcttttagctttttctattccatcacagatttgtgaatagagcatgtttcatcgtcacagtcaatcaccgatggattcgacagccactatacacatctctattcagaaacatatactttacttttgggccctgtagtccaggattcataaggcttcccttaaacccatgccggctacatgttccttgaacacgttgggtggtaggcctttcgtgagtggatccgcgagcatcctttctgttctaatgtgctcgagactgattgtttgatcccggactttgtccttcacaacatagtactttatgtcaatgtgtttggcagcaccacttgactgattgctgtgagcgtacattactgcgggttcgttgtcgcagtataactttagtggtttctcaatactgtcaaccacctttaaactgagtatgaacttctttagccagttcacctgccccgttgcctcatagcatgctataaactcggcatacatagtagaccctgcagtgatagtctgttttgagcttttccatgaaatagctcctcctgccagggtgaacacatatcccgatgttgactttgtattatcttttgtaaaatcagaatctgaataccccataatctgaagcgattctgatcttctataagacagcatgaggccttttgttccttgaaaataatgcaagactttctttaccaatttccagtgctctgggcctagattactctgaaatctgccaagtaacccaataacaaatgccaagttaggtcgtgtgcacacttgcgcgtactctaggcttcctatagctgacgcatatggctttgttttcatttcattgagctcatactgatttctgggacattgcgatgccccatacttttcccctttgactataggagcaggtgtagcactgcatctgtacatattgaatttcttcaacaccttttctatatatgtcttttgagaaagtcccaatgcatactttgttctatctcggtgaatctctatgcccaaaacatatgaagcctcaccgaggtctttcatgtcaaagtttgaggacaaaaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaattcataaatggatctctttagacgacatcccatatttccgtttcctttcatgacaaaacctttcggttgcgccatgtatactttttcctccaaatctccatttagaaatgtcgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccacttacagcctactgttttgtctcctttaggaatttcttctaaatcccaaacattgtttagtttcattaatttcatttcatctttcatgacttccaaccattcagatgagcgagcgcttctcatggcctcttcatatgaggtgtgatcatcctccatatgcgactcttctatattataaactttatagtcatcacggataaccgatcttttgactctttcagaccttctaggggcctgcacatttggcacatcctgtacctgaggctcttgttgagtctcctgtactagcacattatctatttgaggctgttgcagctcctcctagtgtggcaaccatttctgttgaatcctgtataacaggtttatcattttcattcattgttgccacaggagaggtaacaacaggtgccagtacctcaatgacaggtattgcaggcacaacatcagcaggtagagagaagaaaggttcctgagtcgacggagcgggtacagacacccgcctctcctcaagatcaatttctcgaactaccgagctctccctaatcatttcgtcttccaagaagacggcgtgtctcgtttctacaaactttgtataactgtttggacagtagaaacgatagccttttgatctttcaggatagccaataaaatggcaactgactgttttgggatccaacttcccaatatttggattaaatactttagcctctgcaggactcccccacacacggaggtgagctatcgagggtacgcttcctgtccatagctcatacggtgttttgggcaccgatttgcttggaactctgttgagaatatgaatagcggtttttaacgcctccatccataaacccagtggtagtgtggagtagctcatcatgctgcgcaccatatccataagggtacggttacgcctttcagctaccccattctgttgaggttcgcccggtgctgaatactgggctactattctattctctagcaagaaccttgcaaaaggtccagggacttgcccataaggcgtatgtcaaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcctgtgcttcggttttgcaccctttttgatgctctttacaaattttcctttaatgcattgttctaagtctgagaactccaatggaggcagaatttaattcttaactagtctctcaattccccccctcgaaatatggcccaaacgacagtgccatagtttcgatgagacatcgggagttctctttcttttcttgttttcttttgtcaacgaggacacaacattcacattctcaaaaagagataacaaataaagctcgtctcacagcacagcaagaccaatacatgcattattataccatagttcacatttgccacttccaaagcggcaatcatatccatcaaaatccaactttgataaacttattaagtttctttgcaaagaaggaacataaaagacatctcgaagtaaaagtgtgaagccattcgcgagctctagaggaagatctccaacagcttcaacttttttttcaactccattggcaactctaatggagctttctcttctttgcgtagtcctcgtcgaacggaatgcctttaaacaattacaagcatgaataattgctccagaatcaatccaccatgtggatctagagtaaccaacataatgagattcatttacaaatgtaacaatgttctcacctttccttgccatgatcattttcaagaagtcaggacagtctttcttgtaatgtcccgtcttcttgcaatggagacactgatctttctcaacagcgaactgttgttgctgaggcagatgctgagactgtttagcttttgaggtgggagacttgtggttctttttcttgttatctttaacatagttaattgaaccaccatttgactctttaattctctcctcctcttgcacacaattagcaatgagtttttcaaagttccatttctctggacttatgttgtagttgacaataaaattgtcaaactgctttggcaatgaggcccataaccagatggaccagaaaagtcatctgttatgcccaaatccattggcttcaacttggaagccatgttgctcattctaagtatgtggtctctaacaccacctccatggtacctttcggtcacaagctgcttgatcagctgtgtagcataagtctttgaagagccagtaaactgcctctttattctttcaaggtactctgagacagcgtcacactctgggattgagcccaatatggtaggctcaatcgtgttctttaccatagccaaacatttcttgttggctaaggaccatttcttttgttcaatgtcatacgacatgacgagaggagcattgtccctctgtctcttttgccagtcaccatctgactcattttcacctctgataagttcagcaggttctataggacatggggtagtcaacacccagtccacctctcccaagatgaaagcaaggtcgagttttcttttctattctgcgtagttatctccttttagggtcggaatatctttaatgcaacccatcaagaagtagctacctaaaataatcatgtacggtgagaacaacattaacattaaaatattatgcattaagcctatatcaccgttgggcagaattagacataacatatataaccataactataacattgcaattatcaacgttggtcagaaaattacaatatcatagcacataattaatgttccaaaaattaaattctcccgttggttcgaaatttaattttagaaacactaattttcatcaattttatctatttgcagcggaaaaactatataaaaatcatatgaacagtagcaaaactctgtaatttactctctgtaaaaattctcccgttggttcaaatttaaacagaggtaaaacatgcaaaaatctattcaaaattctattgaaatttgcatgaaaaattgacaaaatttaaaaggaaaaatgctactattcctttcctttctttttcggccccccgagggacctaatttaaactttttcccggtggcccacggccttttggcgcgcgcgggaaaaaggttagatctagtcgggtggttctatttgggattgatgtttgaactatagagattgaaaacgggagaggatttagatagaccgaccggttgaggtgttggaggatgaagaagtgccggccatcgtcgtcgttggcactcggttgtcatggatgcggcgccggtgaggtcgacggcgatgacggctgcaacagcggtggtcgtgggcgatcccggcgaggtcgtggcgcggcggtggcatttcccgtcactggctacggcccctctcgatcggattagggtttgtagggtggagttggcggcggcggtgaatctcgtcccttgtgccgtgccggcctccacccctcttttatatggcgcagtgtgacgggggcccatgtcgcgaccgagaaaaatacattttcccgaacgctagtgtattaatccccgtccaaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctctaaagcttctcttactgaagggggggaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtatccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgcttaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacagggttctttaggttataacaaacattaggagacttgaacggatcgattcagagctcgtatgaccaagatatgatcatccgaagtttaatgctgttacatggagatttgcggattattataattaggttttgcaactataaaacatgtgtaagcgctagcctggaaaagacaggaaggctgcgccgttgacatgcggaccccacatgtcaacctaaaggaccgcggtagaccgagtacacagagacagtccacgggtcgacggaagcagatcccgtgtgtcaaccgaggcgagtggccgacaaacggactccactagacaccacacgggctgcacacgtggaaaccacgcggctaccgagcgggcacactaacacggtcaccacacgcacaagcgaacaactaccgacaccggtacacgggtaccggggtcgacaaccgcacaacgggcacgggcgataccgaaaggacgaggacggggcagcgaaggagagatccttaccaccacgcgacgaggcgagggaacgacaacgatgaacgggcgcggcggagacggccgggaatgacggagacgaaaggcgaggggacgacttcggcggcgatccttggacgaaggcgagacgcggccggcgcaacgcttggcgacgcggaggcgaggacgaagacaacgacggggctgcagcggcacacttgacggacacggacgacggacgagaacggcttgacggagggacgaatgccacgacgaccgggaacgacgagaggacaccgacaggaaccggcgaggaggcgatgagggca

SEQ ID NO: 11290 - DNA, 537 bp, Oryza sativa
tctgcacgttcatggctgatgcatcttcctccatactcaatctcttcgtgggcagacctgtggcaacagttcgtcgccaatttccaagaaacatacaagcaccacgcgatcgaagacgacctacatgcgttgacacagaactctggtgaatcattgagggaatatgttcggcgcttcaacgagtgcagaaatacaatccccgaaatcatcgacgcttctgtaattcgcgccttcaaatccggtgtcagagatcgctacactacctaggagttggcgacaagacgcatcacaaccactcggagattgttcgagattgttgagcgatgcgcccacgcagatgatgcgctaagacgcaagaacgataagccgaagaccgggggagagaagaaaccagccacggacgcatctgagtcaagcaagaagaaaaatcgcaaaaatgggaaaaggaaagctcaagcagaagtcctcgcagcagaatacgcgaaccctcccaagcgcccatacccacaaagtagcgacacaaagaaagtatggtgc

SEQ ID NO: 11291 - DNA, 4078 bp, Oryza sativa
  unsure (1)..(4078): unsure at all n locations
tnnnnnnnnnnnnnnnnnnnnnnnnnnnnnnnnnnnnnnnnnnnnnnnnnnnnnnnnnaaaaccatatgctcacaacccaccattatcaggttttagttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtaatcaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaaatcttctcctgcaaattcggactctccgagaacgtcggaatctaaagagaaaagaacaaaatcaccaaaacagcacacaaacaagcatgaacagtatatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagatgattattacgtcagcggctagggttcacggtggaccgggtgcacggcgggggctcacgaacgccgagatctaaccctatccaatcggacgggcgagatctaatgggtctaccgcgactcacggaaagcgacgatgatgacgtcggcgatgacgtcatcaccggcgacggctcggatggtgcaagctcgccggcgaaatacggcacgacggcactaacgaaaggcatctaccggttgcggacaacacggcgaactcacctgtgaccaaagcagcggcaacatggttgacacgagcctttgttgctggtgtggaggagttgttctgagcagggatgacctttgcgcggcggggcttcggacacttatcagcgtaatgtcctgggccaccacagttgaagcacaccccgggcttactgccttgctccctcttggcatgctattgctgtgacggagctgcaatagagcgtggagcttgattgcggatgttgttgcccgcgctgttgttgaagaactggcgctgcggatgaacaacaaacgaagaacctccctgtggcatagattggggtcccaaagcaagacgcggcctctgactatttccctgctgtgccttgaagtgagcaatccggcgtttcttctgctccatgcgattgtacttgtcctcctggcgaatagccttatccactaacttctggaaatcatgataatccccagtcatgagtgggtaagaaagctcatcatttagtccttccaagaacttctcttggcgctcttcatcagtgcgcacatcttccggagcataatgagccagacgattgaactcgtgaagatactcagtgaccgtgcgagaaccctgagtgagcgacctgaactccttcttcttgagggacaccactcccgatggtatgtgcgtcttccaaaaagcagcggtgaactcaagccaagagataggttcagcagtagtcctgttaaggcggaagtgatcccaccactcagaggcagggccatgcagctggtgtgaagcaaaagagactttctcctgatctgtgcactgaagcaggtccaacttcttctctatggtgtgcagccaatcatcagcttcaacaggattggtggtgctagagaaagtaggcggcctcacacgaagaaagtctaccagcttattctggggaggcgcatggttgtttccctggttctgctggttctggagttgctgcatcatcatattcataagctgtgcctgttgagccaggacttgagcaagcgtgggattctctgcattgttgttgtagttgttgttggggttggggccattcccgttgctgcgagtaagcaccatctggcatagagaggagcacaagaagagaaacaagggaaaaactacttagaatagggaattaattttactaacttaacttttattgatattaactgagtttcactattagaaaactgaaaactctcacacctctaaactcaccaacctcctaaaactagaaagcaaacaaagacatgcatttacatcccaccaatgatgtaaacacatgcaagacccactcacacaaccaaacttaaacaagcaaactaacacaacgatctaaggcaatgacttaacaaggcatctaggtcttccgggcatcggagttgattgaaggctcgttcggtgcgtccccatcgtcttgagttggtccccactcgatcttggaatgggtgcgcttggattcttcttcatcatcatcactcacattgacgaccggaggatccgctggggctggggtagcttctttttccactacacgaacctttggcgccaactggtagcgagggacgaatagagctctcttccttgcggtaagacgaaccttggccttctgcggtggtgcttctcccttcaatgctgctagctccttctccaaatgatccaccttgtcatctagcttgcaaatctttccccggttccggtcttcacgatcttgagcggctatcacaatctcaatgcgggtttcatccatagcccatagcatctcaaccaaatgccttgtggtagcatcattctcaatccctgccggttctaggtagctgccacggtcacttccctggggttgacgaggatggtaacggtactcggtgtcggccaaccgatcattgtaactttcgcggagctctcctatggcgatccttgccacctcctgacaagcatgaatgtagcttccccctccagcctcgaacatcaccgatgggatatcttcacgattactgttcaaggtgactttgacccagcacttctcttcatcacgatcatgagggatctgggcatacaaaggggcaatcccaaatcctatgaggaaagacatcgtacgcaactcctggacaaatccttcagtaccaaacaagtactcaagcttgtagcacagcatctaaagacaagtgaaatgagggagttaagtcatttatctagttaatagcacaagtttttgggttagcttgaataaagttagaaattcaaagtaaaaagtaaataaataaagcaaaccaagcttgcaagataagttgaaacagttagaaataggttcacaaactttgcacttttgaataacaggtatcaaagaaaataaataaaagagagttataaaatcgatatgctaagcttagttcattgcagcaaaattaaataaaacaatgttataaaacttttgatggtaaatgggccattagtacggtaatagatgtacagtactaacaacacaggaataataaataaattttgaatgagaacaataaaagaggtcatgaattgcatgtgccattagtttggtttaattaaaagagagagaggagaacagttctacttttccaatatctttagagggcttctatgggtaaccatttggcaaaacctagggtcaaggaggctccgataccaacttgtcacgcccagaatttctatccaaaattccaaacgcttacatgtgtgtaaaccctcgtccaggaatcagccgaggcacacaataacaaattgataatacagtacaattattactctaattaataagcgaataaaatgtcattacagaggtagatagttcctctcaatcaaaagaaacagcgtaggcgattcctctccacaggtagcttgaccagggctacgcctaatcatccactccatcagcatcactgtagaactcctcctctgatgaatgattgcaaggtgagtatatgacatactcagcaagccacgcagcaaatatgcaagtgcacaggataacaaagaatggcatagtataatctcatttgcataaatagcatttaacaaatatttcagaatttaataaa

SEQ ID NO: 11292 - DNA, 3624 bp, Oryza sativa
gaaaacacaggttacaaagggaacaatggaacatgacggatccagcaagatcgtggtcgagttggttcgactagatcccggcgatttggctccttgcgggctccgacttcgtaggctgtgacggttgtgttagctctgagattcgatgccttaggtactccctggggggtcccttttatatcgcaggtcaggcggtctccaagtagaaatcggagatatcagaccctatacgatacattgacgacccagtcttgtccgagtaggacttttcccatccgtagattctgtgaatgatttccttagtgtacgcaggaagtatccgtatgcgcgtgggtataccataccgatatgtgacgtatatcgaagggtaaagggtatgcctaacccgtaaccctgacagtagcccccgacttctgcttaaaatgagctcgtgtaaccattcacaacttctagcgtcgagactgttgtcgttcccagtgcgaggaccgtaaagacaagacatagtcgagaacaccatttgaagcccaacggtcacgagcgaatttgaactgaagtccaaaaaaccgccgcgcgtaacagacccagaaatttccggcgggcatctcagtcacgcccggaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcatctcaatcaataaagttctaagcagcggaaaattaaaagaaacagcgcaggcgactcctctccacaggcagcttgaccagggctacgcctaatcatccactccatcagcatcattgtagaactccttctctgatgaatgattgcaaggtgagtatacgacatactcaccaagccacgcagcaaatatgaaattgcacaggataacaaaggatggcatagtataatatcatttgcataaatagcatttaacaaatatttcagaatttaataaaacagttaaataacaattaaacaatattaatccaacgctatacaacataccctgttgcataggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcatggttattcgaatagattaaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccgcatcataatcacccccttataaacaaggtatggactccacagcgacccccgtgggcttatctccgccacttcatagtctggtgctctactatgaaccatactatacggaaagtaaagctgttgcccacgctagcttgtggttggcacggttaatgtttcacagccgaaaatcgtgaaccggtccttaattgtcatgagcacaaccatcaaaaccatatgctcacaacccaccattatcaggttttagttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtactgaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgccagcgaactacggcacgacggcgctaacgaaaggcatctacgggttgcggacaacacggcgaactcaccagtgaccaaagtagcggtggaagatcaacggacggtgacggcgacgaggttgatacggcggcgaccttcggcttgacgacgacggcgatgctccggagacctacggcagcgacggaggggcggacgaggtcagccatggcttgtgatcacgatggcgaccttcccgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccgaatcgagctcaaatccgatgatttccaaagcgatatagacgatgcttccaaaaggaaaaaggtagaggagatctcggggatcctttcccctcaatcaatttcatcggatcgggaaaggggcgacggaattggatgggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagagaggggggttttgggccgactttcggcccaaagccagaagagaactttttaaaacctttttcaatttaaattattcatgaaatgcaattccatttattaaaaatacttccttagctcaaataaatcccagaaaaatctaggcactatagaattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattt

SEQ ID NO: 11293 - DNA, 13614 bp, Oryza sativa
  unsure (1)..(13614): unsure at all n locations
nnnnnnnnnnnnnnnnnnnnnnnnnnnnnnnnnnnnnnnnnnnnnnnnnnnnnnnnnnnnnnaattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattttgaagtccgcccaccgtgcagaaaacatcccgcctgcaattgctcttcgtcttcttcgctgccacaagaaaccctagttcatcgacctaagccctttctccagcgatcttcgatcagtgatggatctcggcaaatcattctccaccagttgcgatcgaagactatattctctgcggttttctccctccgccttccgaatttcttctcttggttttaaacttctatggtctttctcttctccatttgaaccccaattctatcacctttcttagcatcttttctcatctttgcgaggcctacattggggtagagccttttcttgatctctttcgcttctactacgagctgcgttggatggagtccaacagggtatctggttgcgtcgtgttccgacttcgcgatggcttgaagtcgcgttatatccccttccagtgcccttcttctcgcagcaaatgtcggaataggtggttctatcttcagatcaaagattcagaccctgtcttcgttgttcccaaagaacaaccggacaagatttcgtcttggaccgcaaagccccctttgaccccctctctctagtcgtttatcgacattattgacgatctccgagtacgaggcttgtcggggtatgaagtcgctgcagacttcgttggtaggcggatccagccgctccaggctcgggcccatctagcctttgactattccgaaccggaggacgcgacccgggtttctcctcggggtatctttctcgcatttatcctgacatgctcttgttcgcgttcctcttgatttatcgagatttggttcttgattcgcaggtctgaacagcgaagccgtggaacgtcgtgtcggccaggtgatgatcagtggtccgacaacggcgagtaacatccccgtgcccctttgtgaaaagggggcggccgaacatgatgacgccatcaacgtaagtgttctcgataggcatcctgcattttcctttcgagatcacattgtgacttgattaagcgtaggctcttcctctgactgacatcatcgggccgctcgcggaccatcaggtggcggcgtctctgaaagagaaggtcgccaaggaggcgtctgatgctgctgctactaccactagtggtggcaatgttccgacaaaggggaggaagttctcctctgtaagcggacatcatcgcaaggcgtcaacccccttggtaagttatcctgtcgtcagatcgtacagccagaagaattacgccttacttcgcatcgaccgtttttcaggcctcggacgcgtctcccccgcctccacgacgacaacgtcttgtgacgattggcgagaagtaagtagacgaatcttaagcttccgtgattttattcgagtgttgtctgaaccgtggtcgtctcacagggcagcgcgggtgaaggctgtgcaagacaagtccggagggacctccggcgcatcgcccgctgcggcctcgacggatgtcgtgctcgcacccgggagccgcgaggtgacaccaagcggcccagtcagcgatcccgcggctggtcgtggtccaccagctgccgtcctcacctgggaggagctccaggtcgagatggggcgcctcctcgaggctggtgctcgcggcatcggccgcgagattgcagaggcgaggtcggaagcagcgttggcgaacgagcgtgctgactggctggtacacgagttagcggaagctcgtgaagacctcaagaagatgagggagttggtggccggcaacgagcgacaatggcaggggctcgaggaccgcctgtcggagctcgggaacaacctgtcggaaatccgtggctcgttgcgggtcacatacactggcctacaccagctcgccggggagtgcggcattaagtctaccatcctggcgaatcccgacgagttctcgctgacatcttctcttgcggaactggcgacggcgatgggggagatcccctccaagcatgcggccaggatcggggaggaaacgtcgaacgggatctacaccggggcgtgccacgtccccgcgtgtgtaaagctatcgcatcctgaagtcgatctgcgcgagatcttggatcaggcggcggctagcaacacgcgtaaggaggtgacaaaagaaatcggtgatctaggggaatctgttctccccctatttgaagagtaggacctcttgtacccccaagacatgctgtgtaaaactgaattttaaccgcctttgtgcgtgcaattatcattgtagtttactcttgtatgttgatcttgggagcttttgtcctttgtagagatgttgatgacgaggatgtccaggagcgcgggcacatgtgtcgcccgacaatgtggaccagacccttgctacggggacggagatgacgacgacttcctcaggttagtagtccgttcatcccttgatgccctcccgactagataaactatgttctcgaaagaggcgtatagcttgacttagttgttatcacattgagcagatctcgagaatgcccttgctggccaagatcgtcgtatccaatattggaagacgaaatttgaagtagcggaactcgagagaaccatgctggcagtgaagaaaaagcaggctgtggaaacgctccgaggtcgtgaggtgtggttcaactcatacttgaagagttgctgcacatccatggccagggtctgtagagaacttcgagtgccccgtggagatccggaggagtcggcggccagatacatctcacggctgaacggagcctgtgctcaactcgatggcatcggcaagcgtattgacgaggccttgaagcaggagtgtcgtcgatcgagctgatatgccggagggcacgtgttggcttgcctacgagatcatcgcccgcgcctggacctcgattgtctccatgagggttttgctcgttctcggaagactccggcggagatagaccatctggcgaggtcgatgtcgccgttggcggagaagatcttccagtctatggactggcgttggccttcttggtaatcttcgtatcctgtgatagatatctcaggaaaaaggtgtaatatagctctgaatttgcgtaaaaactgtaagaagtattttgtgaaatagaaaataaatctatctttaataaatctttcttactcctgatgtcgtgtgtaagagtgcgttctcagttcacgactttagtcagccgtttgagttgtacactctccctagcccccagccttgtcgtcggaggaattttctcggaggataaggctcttgtacctttgacctgccttggttgaataagctctgatcctagcccccagccgtgaagttggaaagttaatttccgatttcgcggcttggttaatacgcacggcgagaacccttacacgaccagatcttacatggtctttcgtctctacaggatctgacaaggccttatcggctctgggcgtccccagccgaagatcccttaggttcctcggaggccttgtcaagacggcgtaaagggacatgaggacaggtttcaacgctaggtgtcattagggtaagggatcatcgggcggaaacactttgactgtaatatgggcctaagaataggctttattgatactgtaaggtgtcttacaggtatggatggtattgactcatacatagaatttacgtagttggtcaatgttccaagaatttgctaactcgcgaccatcaccgtctgcgattttgaatgcgcctggccgcaagacttgtgtgattgtgtagggcccttcccattttggtgagagtttgtttcgccctgcttggctttgaactcgtcggaggacgtagtcgccgatcgaaagtatgcgtgctcggatgcgcttctcgtggtaacggcggagggcctgttgatagccgactgctcgaacggcaactcgttcgcgatgttcctcgagtagatttacatcgacgtttcgctgttcctcctagtcctcgtaggagtgcttctgtactcatgtactcggatgtcgtagctcgctggggagcatggcttcggagtcgtacacgaggaagaagggtgtttccttgttgtcagtgtggtgcgtacggtccatagtactgacgggagttcttcgacccattttttgtcatgtgacatgagcctgtcgtagacgcgggttttgatcccttgtagtactatgctgtttgccctctcgacttgtccgttgctttgagggtgagagaccgaggcgaagcatatcttgactcccagcccgatgtagtaatcctgaaaatcagcgctgatgaactgggagccgttgtcggttatgatggggtgcggtagtccgtatctgcaaaatatctccttgatgaatttgatggcgttgtcggccttgatttcccccgtgggtactgcttcgatccacttagtgaatttgtcgatcgcatttaataggaacctgtagccgccctgtcctcgtgggaatggcccaagtatatctagcccccagcacgagaacggccaagtaagaggtttagtctggagcgcttgagctggtagctttgtgtgtttacagtggaattgacaggcttcacatcgctggaccatgtggcatgcatctttaagggcggttggccaaaaaaaacacttgtcaaaaagctttcccgaccgatgttcgaccggcggcgtgtgacccacagatgccttcatctatatcaaggaggaggtgtctaccatcgtcggacgagacgcatttgagaagtaccctgtttggcactttcttgtatagatcgttgccgaccatacagtagattttttctttacgggttattttctcagcctctgtatcgtcctcgggcaactcctcgctgttgatgaatttgattagtggggtgcgccagtcgtctgtggtctcgatgtcggcaacggcgcgttctgcttttgtggcctccgagctaatgtcgggggtggccgagctgacttcgccgctaacctcttttactgatggcttcgtcaggatgtccagaaaagtgccgggctcgagcggttctcgtctggacgcacgtcgtgctaggtcgtctggctcgatgttgtcctggcggtagatgtgtcggacctcgatcccatcgaaccttttctctagcttcctgacttctgcgagatacttggataactcagggttagagcatttataatctttgtgcacctggttcacgactagctcggagtcccctttgacgattagtcgcttgaccccaagtgcggctgcagctcttatcccggcgagtagtccctcgtattcggctgtgttattggtcgccctgaagttgaggtggattgcgtgcttgaattgatctccggagggagatgtcaagataaatcctgcccctactccttggctgttgagtgcaccatcgaacgccattgtccacgtttcgttgtcgacttggttgtctgatttgttatcaggcatagtccagtcggctacgaagtcggcgagtacctgggacttgatggctgttcatggcgtaaagtggacattaaactggctcagctcgactacccatttcgcaatgcggctgacaacgtctttgtttctcacgacttcaccgagggggaaggaggagataactgtgactctgtgggcttgaaagtagtggcgtagcttccttgatgtcatgatgaccgcgtaaagtagcttttggatctgtggatatcttgtctttgcgtcgtggagagcttcgctgacgtagtagactggtcattgtaccttctctctctcgacaacaatgacggtgctaacggaatatggcgtggcggcaatatagaggaataattcttcattaggttggggagcaacaagtacaggggggtttgataggtagcgcttgagtgcaacaaatgcctcttcggcttcctgtgtccatacaaatgtcttgtttcttcagcagagcaaagaaaggttgccctcgttctcccatcctagcgacgaacctactcagtgccgccatgcatccggttagcttttgtacttccttgagtcttgtgggtgacttcatgttctcgattgccttgatcttctcgggatttgcttctattcctctgccagaaacaaggaatccaagcagcttgcccgacggtactccgaacgtgcacttctatggattgaacatgaggcgatatcgccggaggttgtcgaacgtttcccgcagatcgtcaatcagtgagtcgcttgtcttggtcttgacgacgatatcgtcgacgtaggcctcgacattgttgccgagctggtcgctaagtgcgccctagaccgtgcgctggaaggtattccctgcggttattagtccgaacggcattttcacatagcagaatactccgaatggcgtgatgaatgctgtcttctcttcgtcctcttttgccatactgatttggtggtagccagagtaagcatcaaggaagctcaacagctcacagccggctgttgagtccaccagttgtctattcgaggaagagggaagtgatcctttgggcacgccttattgaggtcggtgaagtcgacgcacattctccattttccgttggccttccgcaccatgactagattggctagccactctggatgaagtacttctctaatgaagccagctttgagaagtttgtcgagctcttctcgtatggcttgttttctgtctggtgcaaatctccgcagtctttgctttactggcttggcatcgggtcgcaccatgagtttgtgctcaatcacctccctggggacccccggtatgtcggacggctgccaagcgaacacgtcagcattatcgcggaggaaggtgatgagcgcgagttcctatttctcgcttagtgttgccccgatcttgacggtcttgtcggggttggcactggagagtggaacgatcttgattgcgccgtacggttttggcgccttgtttgtcttgcacactttctttggtggttcagtcgtggcgggtgggctaggtgtttgctcgaccatgtcgaggctccgtttgtcgcactgtactgccagctttgcgttcccttgaatagtgattgttcccttcggtcccggcatcttgagcacttgatacgcgtagtgagatgcggccatgaacttcgcaagtgcagttctcccgatgatggcgttgtaagctgtatcgaattcagcgacatcaaaggtgatctgctctgttcagaagttgttggcttggccgaaagtcacgggcaacataatcttgcccaatggtctgtatagtccgactaggtatggaatgtgatgtatagatagaatatctttaaagagactcgggttaagttccaaacttgtatgttaaggaaatatccgggatcctagttggttacgattaggtcatatctgcaactacctattccgttagggatatgagctgtattttgtaatacggactccttctcctatataaggaggggtccgggtgcctcttggggtacaacattctactcttagatcatacgatcaataatagactcggcggaataatccccagacaggagtagggtataacttcttattaagaaggcctgaaccagtataaacttcctggtcttcaaacccatcaacttttctagcttgatagccacccccttttagtattgccgaaatcttgtttcgtcatgtatcattgtcattttcatagccttcatcatggcgttgcgaatattgtgaatatatcaatggatcaacttgcatgccctaactgtgagcattcttaaaactccaaggtaaaaagagataaatgctgaagtgtgattcatgcatatgtacatattgctcctcccaaatggacatcatgcaggatcgggactaagacaacacattaaaggctctcatgctatacgcttcttgcagctgtagttaaacaagggcatcgagcagtagttcgataacaataagattcattggcaccaacaaaaccccatccattctaataaatatggcacgcatgtattttaagatttatctttgaccaagaattagtttaaatttacaaagatatttgatagaaaattagcatcatttcaatgtgtttttcaatacgaatacaacaattctatgtatatattactagtcatcaacctgtgcacttgcatgggctagaaaaattacgtgacatcaattaactagcatggaagctttattggtgcctccaattactaaatataagatttttcctttctttctcaattctttcggtcaaaaacgagcatgtgtgttattcatagaaacggaggtagtatttgtaagaagtacggtatcgaatttccaaaaagttccgaccttgtgcgataatatacacacacattaacctacataggcaagctagctagaccatgaaatataccatttctaaacctatcggtcacttactcacgttggggagcctaactaaactaacatggtctcacatggcatgcaagctagccatggtactaactcgtctactacgccatagtatgctacaaacacaactaagttatcttatgaaggactactcaatagtacacataaaacaatgttactcgttgctttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataacgcttctgcctatatataagagcagcagcttacattcaagaatcacctctcaacacacaactaagaaacatagctaggtaaccagggaaggtagcatcagcagcgggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgatttcacttccaatctcacgacttcaggcatatatcttgcaacatgaagacatcttatgctctacttccactacaaaattaactaatgcgctattgggatttccatattttaatttcatagttgttgctaagatggacgaaatgggagttcttgctaagatggatgaaatgggagttcttgctaagatggaaggacaagcctacactacaagaatcaatttaatctgtgacgaaatttgacgaaattttcgtgatgttttcagatatcgtcacggatatgcaactatggatacaaggcccataataccgtgacagtttatcgatttcgtcataaaccggcccaaaacatgtgacgttacagtaatttcgtcccggtttacaaatataatattaaatacttgaaaaccatataagagatgtaaattttgtgaataatgttactatcactttatcggatgaataaatgaccaaaataaaagttatagatattgatgagttgtacaacttttatgttgatgactttttcagttgaaatcatttagtatttgaaaataatattgtttgaagttgtcataatttgaaattcaaattcaaattagtgaaacagagtcatataccaaaatgaccaaaacaaaagttatagatattgatgatttatacaactttgttgttgatgactttttcagttgaaattatttagtatttgaaaatgttgtttcaagtagtcataatttgaaattcaaattcaaattactgaaacagagtcatatagcaaaatgaccaaaataaaagttgtagatattgatgatttatataactttgttgttgatgactttttcagttgaaatcatttagtatttgaaaatgttgtttgaacttgtcataatttgaaattcaaattcaaattcaaattattgaaacatagtcatatagcaaaatgaccaaaacaaaagttgtagatattgatgatttatacaactttgttattgatgactttttcagttcaaatcatttagtatttgaaaatgttgtttgaacttgccataattggaaattcaaattcaaattatttaaatagagtcatatagcaaaatgaccaaaacaaaagttgtagatattgatgatttatataactttggtgatgatgactttttcagttaaaatcatttagtatttgaaaatgttttttttaacttgtcataatttgaaattcaaacaacatgcttgcattgcttccagtcttaatgcctatcataagaatatgtcgtttggcttcaagtcatggccaagatatgttaatattatcttcaataaatagttgaccatatggggcaatctatagtggattcatctggtggtctcaactatatgtatgtggtgcatgtgtgcgctcacaagcatatttaatttgtcttgctgctttaataaggccatagcactgtccaatgtgtcattcgatggtctctgaccttagcaatttattatgaccttatcactttattacgacatgattaatattatttgtgtaggcatgttctttacctaatttatcctgagcggatttctgatgtttttgtgaggtttagactatgggacataattaagattgtcatcccaaaaagtattgcaaaacttagaaggaaagcaaaagagccgggggggtggggggggtgggagtaaacatagtcaatttcccggctgctatcccattcctcgttttctcaggtttgggagacatatagccacactaaaggcagtaaagctgaggaatgacaaccttactcacaaggacaaatagtcgttaaaaaactatgacatcactaaccatatcttatttcagtttaccaaacatacatttaaatttaggcagtattacggagaactaaatcaacaaacaacaaaccatacttcattgtcaaaacaaattgccttctatgtacttcacaaattctcacaagatcatatttgcaatttttcctaaactaattaaccaagagcaaatatgcagtggagcattccacatataatttcacattataagtatataatacagtatggtataatacacatatgcatactagggcctacggcaaaagaggcaaagatcaatgtgcatgctaacttgtgtataatacacatatgcacagtactttgaaataagcataccaggacatatgcattagttcacaccattcattcttgcattcttgcactttcaacaacaatcagatctaccaagcattcttgcacattaaaccacaagtagatctaccaataaatcacaaccttaggtagcaatgggggtaatcggaggggaaaaccttacctcgtcagacgacggaaggacaggagacggcggaagattcaccggctgctcaccatggcgcgcggatccctgaggtgtgggcatcacatctatcagcaccaacgacatcggcgggggggggggggaggactggggctctttcatagaccgatgtaaactagacttattggctttgatttagggagaggaaggaaaagagatagactttacccggcatggctttgggcctgcacggagagggatagtagttggcttggtttcagtcaaaagatatgaagagaattttaaattgtttttttcaatttaaataatgacagaaattatgttagtattattaaaattacttctttagctcggaaaatttcaaaaaaatttaagagagcataattaattattgagaagttattaaaactattccaagtcatattttacaaggtaaaattttatttcacatatcaacttgtaacatacaaggaatttcaccttgaaaaatttttgtggaaaatttaaaactttttgaattcaaaagtttttggtgaacatagaagcatactagagcatataactcccttaaataaaataaaacacatagtttttctggccaaatcaaaactaagtccaaaagtaaaagtttacaaatcttgtggtaaaaaattttaaatcaaaaattttgctttgaccataaactgaaacctaatcttctcggttttgcattttcagcctaactaaaaaaatatatttaagttaaatataaaataaatggaaaggtaggtatcaaaatacacaaacctaaatagagataaaaagaacttgcttgtatatgcatattattcttttaagattgtttttggatattcttggtgcatctcataataggt

SEQ ID NO: 11294 - DNA, 1318 bp, Oryza sativa
  unsure (1)..(1318): unsure at all n locations
nnnnnnnnnnnnnnnnnnnnnnnnnnnnnnnnnnnnnntttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataatgcttctgcctataaatagtagcagcaccttacattcaagaatcacctctcaacacaaaactaagaaacatagctagataaccagggaaggtagcatcagcaacaggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgacttcacttccaatctcacgacttcaggcatatatcttgcaacatgaagacatcttatgctctacttccactacaaaattaactaatgcgctaatgggatttccatattttaatttcacagttgttgctaagatggacgaaatgggagttcttgctaagatggacgaaatgggagttcttgctaagatggaaggacaagcctaaaacaacatatttgcattgctaccagtcttaatgcctttcataagaatatgttgttttgcttcaagttatggcctagttatgttaatgtttatctccaataaattgttgaccatatggagcgatctatagtcgatccatctgttggtcccaactatttgtatgtcgtgcatgtgttcgctcacaagcatatttaatttnnnnnnnnnnnnnnnnnnnnnnnnnnnnnnnnnnnnnn

SEQ ID NO: 11295 - DNA, 1163 bp, Oryza sativa
  unsure (1)..(1163): unsure at all n locations
ccactcatgctaggttgagtgaagtacaagtgggatcatagcctcaaatcactgccaactcctttaaatcgtttctaccgctcatgttgacacctagctctcactttccacctttcctttcaccattcattactacaaccaagatttttctgtgagggctaaaatgatttttgcgtgtgggtaaacggcccgcatacacctaggggtctaggaaaataacgatttttgcgtgcaggtggcgcacctccacgggaaaaaaaaacctgaaaaaacataaattttctttaaaaatgaaaccctagaatctagtggtggcgccgccactcctgcttgccgctgccgcctcctcgtcgtcgtcatcgtcgtcagcggcggcctccgcgccgctcgcctcggatccgtgctcccctctggccgcactgccgccgacgcccctcccctctgccagatctagggagggatggaatgggaggggaggggagctggatgccacgcggggggagggcgcccggctgccggatctgtgcggggacgaccgccaccactggatttttgcgttgatggccgccgccgcaggatccgtgcagggacggccgccacccgccggatcccacgcccaccaccgccaccacgtggaggaggccggcgcgcgcctacgcccaccgcagctgtcgccgcgcgccaccgccgctgccgccatcaggaggacaggacagtagagtggagagaggagaggagaggtgtgagagagagaggactgagaggagaagctctgcgtgcaaattttaaagttgaaaaggggattgaggggaggggagaggagagaaagaggggaaattttaaagtgggtcagagggaaaagagggagttagtattttgcatgcggctctcttaataggtctgcacgggaaaattggctcattttcacgtacggtccatttaagagaactgcacggaaaaatcgatttttccgtgccgtcctcttaaaaggaccgcacgtgaaaatgagctgatttttccaaaagcgacgagttgctgcctgcacggaatctaaaagggtccctgtagtagtgattaatcaagccaactcgccactgtgaacctcatctatttctcatagtgttnnnnnnnnnnnnnnnnnnnnnnnnnnnnnnnnnnnnnnn

SEQ ID NO: 11296 - DNA, 706 bp, Oryza sativa
cccccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctaaaaatataccatttctaaacctattcggtcacttactcacattggggagcctaactaaactaacatggactcacatggcatgcaagccagccatggtactaactcgtctactacgccatagtacgctacaaacacaactaagttatcttatgaaggactactcaatagtacacttaaaacagtgttactcgttgccttttatcttcatctgacgggtatgagctaagtgtatctgaaaatcatctccttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattattcacatcatcacataacgcttctgcctatatataagagcagcag

SEQ ID NO: 11297 - DNA, 472 bp, Oryza sativa
cagtatctgcatgagtttaattgtctggcccgttatgctccagaagatgtgcgtactgatgaagagcgccaagaaaagttcctagaagggttgaatgatgagctttgttacccactcatgactggggattatcatgatttccagaagttagtggataaggctattcgccaggatgacaagtacaaccgcatggagcagaagaaacgccggattgctcacttcaaggcacaacaggggaatagtcagaggccgcgtcttgctttgggaccccagtccatgccacagggaggttcttcatctgttgttcgtccgcagcgtcagttcttcaacaacaatgcgggcaacaacaaccgcaatcaagctccacgccctgttgcagctccgcaacagcaacagcctaccaatagggagcaaggcagcatgcccggggtgtgtttcaactgtggagacccaggacattatgctgacaagt

SEQ ID NO: 11298 - DNA, 835 bp, Oryza sativa
tgtattagcacagccttatctaaattatctttaaggtaaagactgattccaattggctttggcagatagaaaggaatgagaggcaccagaatcaaatagaatagtaactggtttagagtttatggtgaacatacccatcaatatattaggatcttgttgagcttcttctgctttaatatgatgtacttgaccacgtccaagattatgtccactcttaattattggaggatttttctttataaaacctgtagtagatggtttctgataagaagtttggcctcccatattttgacgattagggcatagtcttgcaaaatgtccaattttcccacaaacataacaaggagagtcttccatttttaatccaggtcttggtagtattggtggcatgcctggccttgcattgggtagagatgccttaaatggataaggcctccgaacttgtagtgaacctctagttagtgattgtcattgtaaattcattcttctcttagggagtccttccaccattctacgatcattttctagcctaaccactttattgactaggctttgaaaattttcatgatcttgactaatcattggtcctcgaagttcatcacgtagtccttctataaatctttcaatcttttctttttcatcttgaatgtccgaggcggcatatcgagcaagttgtgtaaatttaatcaaatattcttgtactgtcataaaaccttgcctcaatctacgaaattcattctttttcatcctgatcacagctgtaggtataaaagcatctctaaaagttgtagtaaattccatccatgtaataatatgtgtaggatcttctatagaa

SEQ ID NO: 11299 - DNA, 3430 bp, Oryza sativa
tcttataatagaagcaatcgaccgaggcaagcgagagttcctatccatcagagattgggcccggtgaatcaaggtcgtgatcaggaagatgatgaggacagaaaaactcaatggtgtccttctagtattattaaaaagaatcaaaagagaagggttcaaagattaaggaacatggagcgctttcatgaggtagagcaggagatcaactatcggctgtagaaaacaaagccgaggtaagaatggcgtgttaagaaccaagctgccacaaccgatgaggtcaaagccgatgaagcaaagaggttagctaaagggaagagcattgtgactacatcggttaacatggttttcacgttacatacggaatttggagctaaacaagccgatgttgatgaagttgaggaagcttcggctaggttaattttgtcaccagagcaagtagtttttgagaagccagaagggatagagaatcggcatcttaagccattgtacattaacggctatgtcaatgggaagccgatgtccaagatgatggttgatggtggggctgctgtgaatttgatgccttatgctacattcagcaagctgggcagaaatgctgaagatctcaacaagacaaatatggttctcaaggattttggtggcaatccatcagaaacaaaaggagatttgaatgtggagctgacagtcggcagcaaaaccgtccctacaacattttttgtcatcgatgggaagagttcttacagcttgttgcttgaaagggattggattcatgctaattgttgtattccttcaaccatgcatcaatgcttgattcaatggcaaggcgacaagattgagattgtgctagccgacaggtcagttcacgttgccagtgccgatttagctctttgggagatggacggtattgattgcctgtccggaaaagtttgggatggagattttttaaaagtgtccgattgtgatatatagccaattgaagatggagagcccaagttattatttcgagggcgtcgtggagggttcaaacgtctacaccaaggacacagtagatgatctcgatgacaagcaaggacagggtttcatgtcagtcgatgatttggaagaagttgatataggtccaggtgataggccaaggccgacattcattagtaaaaacttatctcctgaattcagaaccaagttgatagagctgttaaaagaatatagagattgctttgcttgggagtattatgagatgccaagattcagccgatcgattgttgaacatcggctacctatcaaaccaggggttagaccatactagcagccgccgaggagatacaaagccgatatgctcgagcccgtcaaggctgaggttaaacgtttatatgatgctggttttatgcgtccatgccgatatgctgagtgggtttccaacatagttccagttatcaagaaaagcggcaaagtcagagtgtgtattgatttccgagacttaaacaaggctactccgtaggatgggtacccaatgccagttgccaatcaattggttgatgctgcatcagagcacaagatattaagttttatggatggtaatgtaggatacaatcagatctttatggtagaggaacatattcataagacagcttttagatgtccgggtgcaatcggcttgtttgagtgggttgtgatgacttttggcttgaaaagtgctggagcgacatatcaacgggctatgaaatacatatatcatgatctaatcggctggttggttctaacatcctcaaattttaaagtaaaatttgactgcatcatgctgacttttgattaatttagtgtgtttcaaaaatttatttggttcctaattggttcaagtattacttctttagaaccctactaattaaccctaattattccctttattccaaaccctagtgaatttgagcaaattctcttaaatttcaaactatagattatttccttagcttaccctaatattagtgaggatttgctatacttcaaaccctagtgaaacccttccaaattcatagattaaattcattcttttctagggaaatattcaaaaattctgaaattcactgttcattgcacataaggtgttcggtagaatgcctagcccaactagagcagcccaatcccctccaatcttgtacaaagtctagaattgatcctaggggaccacaacccactcaaaaccatggctttctttgcctcttcctccccttcacgcgcgccgcccgggcatccgaatagccgcgcgccgtgtcgccgcgcgtcggcctcggggccgcttgcgcgtgcccgacctccttggcgcgccgtcgcccgtccgacaccatcaacccactgccactgcaccaatcgcaacgacgacaaagccaggacgacgaccgccgcacgaaatcgccgctcgacgccgtgcgctctgtcacatcctgattttcgtcttaggatttataaattatttaataaattattattagaatttatattaaatgttcatcaatttacaattgaagttaaatgtgggaaataaaatttcctaaatataaagcatggatggatttaagttttattaaattctccatggttaattatactctctggaattttctcggatttttcggagatcaactattaattttaatcatacaaagaacatttcagtaattatccacatattaaattaatcattaaatggtctgattataactttgtgaagtactttgagtgtccaagtattttcaggatttttcttgaaattatttgagcattggaagtatttttaacaattcaaagatcatttcagtgattattttaattggaaaaagtttttaaatcctcccctaagccgttgggccgtattcggcccaactctctccctcctcgcacgtggccaagcggcccacgtcggcccagtccaagccgccggcctcccctcctctcagccagccgaaagtccactttacctccttggatactgttcatcttccagctccagcagcccgtgccgtgccctgtagctgacaccgcttcctccgtcgaattcttcgcatcccgagctccgtttgcaaaattagttgaggagaaatattcctcttatcctcctctatcctttcccccaagaatcggactgtcacaccctaaaaatcccaaatatataaattgttgtttaattggaattattagaatttattttaaaagcctagaagagaagatctaattttaattaataaattccaatataaaatggggccagataaaattttattaaatactttgcttaattctataagtcctagatttttaataaatggatttatttgagctaaggaagtatttttaataaatggaattgcatttcatgaataattaatttaaaaagctttaaaaatctttcttttggctttgggccgaaagttggaccaaa

SEQ ID NO: 11300 - DNA, 4583 bp, Oryza sativa
cctttttccttttggaatcatcagctaattcgctttggaaatcatcggatttgagctcgattcagattcccctttcctcccgaaccctaaaactttgcatcgcgtcgccggccgccgtgggccttcgccaccgccccctagcccctataaaaggacccccaggccctccgctacccgtcgccaccctcgccttcgtctttcatcgccggtagagccctagcgccgtaagtcctcgcgctgccgtcgccgccgcaggtccagccgtgcgccgccatcgcttcggtcgtcgtcaccgctcggagaggtcgccgttgtggtcaccaagccgtcgccgatctcgtccatccctccgtcgtcgccgtagaccgccggaacatcgccgctgtcgtcgacccgatcatctccgccgcttcgacctcgacgccgtcgccgcccggtcatcgtccgccgccgttttggtcactggtgagttcgccgtgtcgcccgcagcccgtagatgccttccgttcgcgctgtcgtgctgtcgttcgccggcgagcgtgcgcgtccgagccgccgccggtgatgacgtcatcgctgacgtcatcgttgccgtccgccgtagaccggccgtggacggatagatgtcggccgttcgttttggaaagatagatcccgaccgttcgtttccgtgagccactgccgtgcacccggtccaccatgaaccgagcctgctaacgcaataaatcccttttccttttcaaaaataattcattattgtgtcataattcaattaaaatctatataaatgatttaatccgatttaatctttaaaaattcataactaattcatcttagctcggatttagttggttcaagtctctaaatttttctaaaattgagatctatatgttaaaaatatccacatgtaatgttcatacttgtttatgtattgttttggtaattttgctcttttctctttagattccgacgttcccggagagtccgattttgcatgagaagactttgaagagttccaaggccagcaaggcaagtcacacagatcccaaacaaccctttgagcatgttgatcccgtttaaagctattgtttctattcaactattgcatttattttcgaatgtcattgggtggaattaacctattgttgttatggcccttttgttcttgattactttattctttgataccttgggttattataatttgactagttgagctttatatatgggttcagctagataacttatgctacactattatttaatgatggcttaatgataactcatgatggttaatcataattggttaattaattaatttgtcaactaaaacctgataaaggtgggttgtgagcatatggttttgatgattgtgctcatgacaattaaggaccggttcacgattttcggttgtgaaacatttaccgtgccaaccacaagccagcgtgggcaacggctttactttctgtatagtatggttcatagtagtgcaccagactgtgaagtggcggagataagcccacgagggtcgctggggagtccataccttgtttataagggggtgattatgatccgagagcggagcactactttgaattgtattatatagagggtacggtcacaatctctattcgggtacttgtcaagtatcgcgacgcatggttgacatgatgttgaggttgtgtcttctgggtatagtggtacacctctgatcagagtttaaactattcgaatagccgtgcccgcggttatgggcgggtctaacaatgtctttcgtgattagtctcacacttctcaccctattaaatgatgatgttaataacttgtttagctcatggtttggaatgttgtatagcgttggattaatattgtttaattattatttaactgttttattaaattatgaaatatttattaaatgttgtttatgcaactgagactatactatgccatcctttgttatcctgtgcacttgcatatttgctgcgtggcttgctgagtgtgtcatatactcaccttgcaatcattcatcagaggaggagttctacagcgatgctgatggtgtggatgattaggcgtagccctggtcaagctgcatgtggagaggagtcgcctgcgctgtttcttttattttccgctgcttagaactttattggttgagaggaactatctacctgtgtaatgacattttattcgcttattaattagagtaataattgtactctattatcaatttgttattgtgtacctcggctgattcctggacgagggtttctacacatgtaagcgtttggaattttggatagaaattccgggcgtgacaaattggtatcagagcctccttgaccctaggttatgccaaatggttgcctatggaagccctctaaaaatattggaaaagtagaactgttgtcctctctttctcttttaattaaaccaaactaatggcacatgcagtttataattcctttaattgttctcattcaaaatttatttattattcctgcgttgttagtactgtacatctattactgtactaaaggcccatttaccagcaaagagttttacaatgttattttatttaattttgctgcaatgagctaagcttagcatgttgattttataactctcttttattttatttcttttgaaacctgttattcaaaagtgcaaagtttgtaaacctgtttctaactgtttcaacttatcttgcaaacttggtttgctttatttatttaccttttattttgaatttctaacttcattcaaaataacccaaaaacttgtgctattaactgggtaaatgacttaaccccccctcctttcacttgtctttagatgccgcgctacaagcctgagtacttgttcggtaccgaaagatttgtccaggagttgcgtacgatgtctttcctcataggatttgggattgcccctttgtatgcccagatccctcatgatcgtgatgaagagaagtgccgggtcaaagtcaccttgaacagcaaccgtgaagatattccatcagtgatgttcgaggctggaggaggaagctacattcatgcttgtcaggaggtggccaggatcgccataggagagctccgcgaaagctacaatgatcggttggccgacaccgagtatcactatcatcctcgtcaaccccagggaagtgaccgtggtagctaccttgaaccggtagggatcgagaatgatgctaccacaaggcatttggttgagatgctgtgggctatggatgaaacccgcgctgagattgtgatagccgctcaagatcgtgaagaccgaaatcgcggcaagatttgcaagctagaagacaaggtgaatcgtttggagaaggagctagctgcattgaagggagaagcaccaccgcagaaggccagggttcgtcttaccgcaaggaagagagctctattcgtccctcactaccagttggcgccaaaggttcgtgtggtggaaaaagaagctatcccaggcccagcagatcctccggtcgttaacgtaagcgatgatgatgaagaagaatgcaagcgcacccattccaagatcgagtggggaccaactcaagatgatggagacgtgccgaacgagccttcaatcaactccgatgcccggaagacctagaccgttttgtcaagtcgttgccttagattgttgtgttagtttgcttgctttagtttggttatgtgtgtgggtcttgcatgtggtttacatcattgttagtaagttggtgagttaggtggtgtgagagtcttcagttttgtaataatgaaacttagttaagatcaataaaagttaagttaatcaatttaattccctgtcctaagtagttttcccctgtttctcttcttgtgctcctgtctatgtcagatggtgctcactcgcagcaacgggaatggccccaaccccaacaacaacaacaacaacgcagagaatcccacgcttgctcaagtcttggcccaacaggcacagttgatgaatctgatgatgcagcaactccaaaaccagcaaaaccaaggaaaccaccatgcgcctccccagaacaagctggcagagtttcttcgcgtgaggccgcctactttctctagcaccactaatcctgttgaagctggtgattggctgcacgccatagagaagaagttggatttgctccagtgcacagaccaggagaaggtctcttttgcttcccatcaactgtatggtcctgcctctaagtggtgggatcacttccgccttaataggactactgctgaacctatctcttggcttgaattcaccgctgctttccggaagacgcacataccatcgggagtggtgtccctcaagaagaaggaattcaggtcgctcactcagggatctcgtactgtcactgagtatctgcatgagtttaattgtctggcccgttatgctccagaagatgtgcgtactgatgaagagcgccaagaaaagttcctagaagggttgaatgatgagctttgttacccactcatgactggggattatcatgatttccagaagttagtggataaggctattcgccaggatgacaagtacaaccgcatggagcagaagaa

SEQ ID NO: 11301 - DNA, 4338 bp, Oryza sativa
  unsure (1)..(4338): unsure at all n locations
catgtgatggaagtagaagagcttagacgtcctttgatggttagtaccccaagtaaccaagcactctcatcacaacgtagcccctctgtcagaatagagatccaaggtgtaccctccctggccaaccttattctgttagaatccaaagatcttgatgtcatcctagggatggactggttagccagatataaaggtgtgatagattgtgccaatagaaaagtgactctcaccagcaatgatgggcgagttgtaactgttcatgcactgccctctgaacctctaaggtcaagtttaaaccgaataactttggaagaaattcctatagtacgggagtaccccgatgtgttccctgatgatttacctggtatgccgcctaaaagggatatagaattctgaatagatttggtaccaggaacaactccgatccataagagaccttatagaatggcagccaatgaattagcagaagtcatgtcgggtcccaaaactaatgattcggaaaccgacatgtttagactgtatcaagccctggatcagtagattgatacaggttcaacaatctagatcttcattgcatacatttgattaaggtttcaaaggagatacaaaataatattaggatatttacaagcttgtggttaactattacagcagaagctatagaatgactcaactctaatgttttgctatagacttaaaccatctatctaatctatacttgagaactaagttaaaatgagattaacttatatgattgaactcccagtttcggcaagactccaaattaactctgaaaaaggggttgaagcaagggtgagtacaatgtactcagcaagctattatattcaataataaatgtatgaaatggtaatatttgagtagagctaggtttaattgcagaaagctgagaataaagaagtagaaatcctgaaatgtttgatatgcaacagtatttaataaagtttgaaattatgtttctaaccaagataccattgtgagtcccaatgctcgataaccgcgagcacggctattcgaatagttttaataatattcatactgcagtagatgtacgctttacccgcaatccatgacgtgccaaacacattagccttgtcatggcaaagcttttcggttactaacatcagtggtacttgttccatgaactctagtccccatgcgctctgaatgtaacgttatcagcagtgagaggagttctggcgttcccgaggtttttggagagaactggttgagagacccccgtcatctcaatcagcttttcataattcacacacacagctcgcgagataatcaagatatttacctgcgcctcggtaaatatcacaatcgccctgctcggcgtaagttgcctcctgcgcgaggacttaagaagaaccactatacataggtaccacctttgctagataacttaatcagctaggtctatacccatacgagaattgaggtcgtactcgtatgttgttcacatgtacttggcaattttatatcggttggaacagtactagccacccggaaatcaaccatttctaccatactgtcccaatctaagttaattaaattttatgcataatctaactaggcagggctaagcaaaagctagcatatctggtttgctatgttcaggttatgcatttgaaatcatgtatgactaatgcatagaacagagatatagaatatagggtatttatgctcaaaggagaggaataataacttgccttgctccaacgccaataaatacgaaataggcaacctgattatctgatgcttgaaataccataggttgccatccatataaaatagactctactaaagaagaggaagaaccaaattcaataaaagccataacatagcaagaaagagataaacggttaggagggctagggtttagggtatagcttatctcttttatggggtatatggattactggctgatattttatatgtggtttctaaagagttggtggctggggtagagagggaattaagcggctaaggtcacctatattttatgtgcagactctgattagttggtggataggagtatagtggataattgaactggttgagcagatatgtgactggtattggctgatagtaggtttgggtaggattatacctagggtttggttatatttaggccgattgaggagtagggcagtatatcggccaggttctacattttatgtataggagctggatagatggagagtaaatggttgagattatagctggtggggagtctggctaataagctgactaaggtttcagttatcaagccgatatcgaggtaagataaatatcggctagggtttgggtgttcgctagtcgttgctaaagcatgacgactaggtttggtatcttctctagccggtgttgatagacaatataacgactagagggaagggagttttgtgcacgtttagcgaggcggaagtgttactccgacaaccgtgagtggcggcggagcggctaggatcacacaggtcccgaaagctaactgtgcggcgtgctgtggaggtcaaggaaatagtgaagctccgaccgctgtacgcatcgaggcgtggggtgccaggagcagcacttcgaccttaggtttggttttgccgggctttacaaccaacggtccgacgtcggggccaatagaccgcaaacatccccatggaaggcgtaaagttccaaccggcggctttttagtggctaatgggtattttggggtaaaagaaaatatttgaaaaaggcaaatataaattcaaatcatatttgaataaattcaaataaaattataaaataacaaattaggcatcaaaatgaagcatttgaatttatatgaatttaagtccaggtttcactgagaacggatctacggtttaggagatatgggcttctaaagattgggatttgaattaaataaagaaaatgggaaatagtactgtgcaggggcccacttgtcagcctttcctttcctttttcttttctctttcttcttcctttgttctcttctttctctgcctctcagtgagccgagagaagagagaggagagggcaagcggggcgtcggctctccggtggtcgaaaggcggcgacgtcggcggcaaaacatgttcccgagcgacgcgcatccggggagggtggtagctagtcaaggtgaagagggagatggccggaacggcggcgacaaaagctcagctccggctataagagaaggtggtggtgtcggtttatctcaaggtggagggagaggggaaaggggaaaaatggaatcacctcgtcgaggcgaagctaatggcgcgaggatttggttagtggagctctggtgagggagatcgggcggtggcggcaatggccggtcatggctggagagagagaggagagcttcaagctttgatgtggagagggaagggtggtcttgccggctatttataggcatcgggatgtcggttcgcagaggaggtcgtcgtcttggtcacggcggcagtggcgtgcaaggaagggcaaccgcggccggctttagtttcttagcggcgacgtttgcggcggctgcctggttgggccgatttgggccggctcagcttagctgggccggcagcccaagaggaaggaggaaaatagaaggaaaaaggattgggccaaaaggaagaaagaacggagtttcggcccgatgacaaaaagaaagaagtctaatttgtatacttgatttgaataactgggttttgcgaagaatttgaatttagagagaattcacaaaggagatttcctaatttatttgagtgcaatgtttagaggtggagtttgagggaatttatttggaagcactcaaataggaaaggaaattaatagtattccttaaaatatttttgggaatgtggtaggaaaataggtggaggcaaaaggataggatttgaaccctaaaatatatggcataagtttcaaggaattgtttgaggctaaaaggaaatttaggtgacaagggtataatttattttcttagcacaagaggaattattcacaatatttgtaataatattattcttgtgccgagaaggaaatcaagccacaggaattaaattagtggctagatcaaaaggaggaatttagatatttggcggcaaataagaataggtttggaatcaagggataggtttaagatcaaaggatgggtcgacaattaaatccaaatggaatcgtttggtttaagttctaggacaatagtggagaatttcttggaccataatctcataccaatagaaaggggttttnnnnnnnnnnnnnnnnnnnnnnnnnnnnnnnnnnnnnnnnnnnnnnnnnnnnnnnnnnnnnnnn

SEQ ID NO: 11302 - DNA, 13672 bp, Oryza sativa
  unsure (1)..(13672): unsure at all n locations
nnnnnnnnnnnnnnnnnnnnnnnnnnnnnnnnnnnnnnnnnnnnnnnnnnnnnnnatttttgggaatgtggtaggaaaataggtggaggcaaaaggataggatttgaaccctaaaatatatggcataagtttcaaggaattgtttgaggctaaaaggaaatttaggtgacaagggtataatttattttcttagcacaagaggaattattcacaatatttgtaataatattattcttgtgccgagaaggaaatcaagccacaggaattaaattagtggctagatcaaaaggaggaatttagatatttggcggcaaataagaataggtttggaatcaacggataggtttaagatcaaaggatgggtcgacaattaaatccaaatggaatcgtttggtttaagttctaggacaatagtggagaatttcttggaccataattcataaaaatagaaaggggttttcaaactaaatttgaataaaagaattttaatcaaaagaaggttttaaaccaaatcaagaaatacctcaatttaaccaaatatatatttttaaatgaaaaacacaaaagagattaaatactagagaggttttgagcgagttagttttaggaggtacctctaattacattgtcctaagtttaggaggttattaaaaacataagaatcggcatgatgcaggattagaaaatgacacattttcaggatgttacaagtcacgaggcaagtagatgatttgttacagaaaggatacatcagaccaagttcgtctccatggggagctccagttatctttgtggaaaagaaagaccatacccagaggatgtgtgtggactatcgtgcccttaatgatgtgactatcaagaataagtacccgctaccaagaattgatgatttgtttgatcaactcaaaggtgccaccgttttctccaagatagatcttcgatcagggtatcaccagttgaggattaaagaagaagatatacccaagacagtttttaccactcggtatgggttgtttgaatgtacagttatgtcttttggacttaccaatgcccccgctttcttcatgaacttgatgaataaggtgtttatggaatacttggataagttcgtagttgtctttattgatgacattctcatttattcttgaaccaaagaagagcatgaagaacatcttcgtcttgcatcagagaagctgcgagaacatcagttgtatgccaagtttagcaaatgtgaattctggttgtctgaagtgaagttccttggtcacgtcatctcagccggaggagttgccgtcgatcctagtaatgtggaatccgtaaccaactggaaacaaccgaagacagtttcagagattcgcagtttcctaggtctcgtaggttattaccggaggttcatagagaatttctccaagattgccaagcccatgacacgattgctttagaaagatgtgaagtataagtggtcagaagaatgtgagcagagttttcaagagttgaaaagtcgcttaatatcagctcccattttgattttgcctgatccaaagaagggtttccaagtgtactgcgacgcatccaagcttgggttaggttgtgttctgatgaaagatgggaaggtggtcgcctatgcatctcgtcagttacgtccgcatgagaagaactaccctactcatgatctcgagttagccgcagtggttcatgcattgaagatttggcgtcactatcttttcggtactcgtacggaggtgtatacggatcacaaaagtttgaagtatatctttacccagccagatttgaacatgagacagcggagatggttggaattgattaaggattatgacctggtgtcacgaccggaaataacccaacgggcgttccttacgtgcgtgtattattccttgtcccaggaggcaaggtacaccaaaagttgatacaatttagagtttaatcaagcggaagcgtaaatagttaattattacatgggcaacgaaggcctagcacacagaaagacaatgaaaaacagcggaagactagggcgacgaccacaggcgcttgacggcaggcacgacctaaacaccaaagccttcatcatccaggggctcctcttctaggtttgggaaaaattgagcaagactgagtacaaccaccgtactcaacaagacacacccacaagtgcagcataaatgcaatggagttataatatagggggttagggtttgcagtaaacagcatttaaaagacacttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaagccaacccaggccaaccattccacattttagttgttaagaaggttttaagaattaaaacactaacttgggtacattgctaggcttgcccatatccgagggcgcggctattcgaataggttttactctgatcagaggtgtacatctttacccacaagacacgtcttcctcacgtgcaaccacgtgccacataccaccacggcatatggatggatgacatgacataatttccaacccatcctagccatagacaagagtaccgacccaaccccacctacggccggaacctccgggacaggttggcaggactgagcccctagcagcaggacaccagtcctgtgccatgacatctcgactaccgggccgcagctcgtgtagccttcatttgccctacagatgtccatcgacccccgacttcgtccatctccatccgtgtacttttgtttataaccagactgagccacaaactaagccttacccactagacatgtggaagtacggtagtgctttgcaacagaggaccgaagaccggtccttatgtggccgaggtgctactatcaaaaccatgcaccccgagcccagtctaaaaccattttgggggttttgaatagaggggaaggtgtgcatccaattccgcaataatccaaccattccataatgtccaagtgatatgaatattcccaaagtctagagttataaaaccacctaatgttgcctaaataattagcgaagcatctacctaaattcatactagtggcaccatgaatagagtacccactagctggggttttgtttattctagggtgaacaaggtaataataacaatagcaataataataaggtcataacaaaggtaaacaggcatagctaaataaaacagtgataacgcggaaatttaagtaaagcgataatgcattaatttaaatcaaaataatgtcacaaactaggatccaatatgttcaaagatgatgtgacttgccttgctcgctttcccaaacgtcggcttcaaccttcacgaagagcggatcttccgatgctgcagcgtctacacgaccaacagaaaggaaaaagtcttttactctaataaactccatataacaagcaggaaaaaaaacacaaaaatgggttcttgacttcttaaggaaaaattagagacttgaacggtccaattccgagttcaaatggccaagttatggccatttgaagtttatatgctctttaaatgagtatttaagaatttcttcatttaaattttaatttaaaaagggtttattacgtcagccgaggggagagggcgcgcggaccgggtccacgggagtggggcccacgcggcagcctcacagtccacggtggaccgggtgcacccgggctcacaccggctggcgctgcgggccccatgcgtcagctgcacccgagggcacgggcgacggacggccgggccccacgcggcagccacacgccgcgcccgaaggcggccacgtcggcgcggccggcggaaggcaacgcgcccgcgcccctatggtcgccgccggcgaccaccggcgcggcggagcggcgcccgagagaggggtgggaagggggaagcgaaacggcggtccacggctcaccccgggtcgacggcgacaacgggaacggcgaccggagcggagagaggcggcggcgcggctcgggtcgacggggacggcggcgttccggcggtcggcgaccgaaacggagaggtggacgaggtcggcgaggatgcggcgaagccgaaggaggcggcgccgaggtgggaggcggtccggggtgacgacggcggcggaccggagctcggcggcgacggcggagagagagagcgacgtcgcgagctcaaatccggcgaggaggaagggcggcgagaggcggaaccggacggaggaggtgcggggagggtttaaatagagccggggagagagggggtggccggggaagggaggaaaccggcgcgggaggtcggccgccatcaatggcgccggcgagatttgcgggggcaaatccgcccgtttgaacgcgggagagagagggagaaatggggggaaagagagagggaatcacggggaatatttccccccactttattgcgcgcgtggacggcgggaggcggcgggattcgcggcggcggcggcgctagggcacgggcgagcggcgggagcggcgggaggacagggatgacaggtgggccccacccgtcagcgagggtggcgggcgagcccacccgtcagcggcgcgcgcgcggggaggaggccggatgggccgcggggaagaggagagagagagaaaggtgtcacgcccagaaattcacgaaccagaatttctaagctgaatgtgcatttaacccctgtccaggaccagccagggtacacaaacgacaattgttgacatacagatccacgtcttacaaaaatataaaagattacaaatgcagcggaaaaagataaaagcgagctaagtctgaaggcttgactcctgcagcgggcgactccattccacaagcatccttgacggcagcgacgaaaccaacctctaagatacataatcaactgggaaggacttcaacgctggtgtgggggaaaaaagagcaaaattagtataccccttgtattagcaagtcacaccggaagagcaggtataatgccgaatatagcccacgaaggctaaaggttcttttgcataaagccggcatttcaagcagtagttgaaagcagtaaaacagttgtagtaattaatctatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacatatcggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaaatgccatgggtgcgactagcaagaccatgcacccacagcccaccatgacgtgtattttaattaaccaacaccattacggtggcactaaatcaaagctataccaataatcaagtctatgctttaatgtgatccccctttgtgcactagttgaactaagcatggctaagcatctcctaaaccaacatctagtcattttaatacccaagttatcaatggcgtaagggaaacaacatatagctgagtaataggaccaatcccacatgatattgtaaaacaatgcaatatttaatagaaatgcgggacacttgtatattaggtacaatatgatcaattgcaatgtatgacttgccttgctctcgcactgatgaggccacagcaacgtcttcgagaaaccgggaaccgacgaaacggccgaaatctacgcgacaaacaaagcacacaagcaaaacatgctataagactactgaaacagataacaaagccatttttaatggattctacacatttttatgaatttactgagacttgaatggacttaatcggagctcggatgaattagttatgatttttagaagattctctgtgtttttactattaaagaaaagccttaatcaatttattgcgcaatattgccccagggctgacgtcagcaaggggtggggcggcgccgacatgcgggccccactggacagcggtgctaagagagggagagggggcggctggcaggcgggcccactaggcagtgtcacaaggggggggaaggcggcctggctcggctcggcttaagccggccggccggttgtggcgagggcggcgcgcgcgcacggtcgccagcgacggcaaccggcggcgggaggcggcggcggacggcgcaaagacggcggcggcggccgaagcggcagcgcgagcggccctagcggcggcgctacgcggcgggcggcgcggcaaagggagagaggaaggggccccggtgctcaccaaggagtccggccgacgcggagggaggcgacggctaacggcgacgaggagcgaccggcgaaccttgctggacagcggacgggaagcggaaggacctagagagaaggttgggaggggttagagagagggaggtggtccatggcgcacgacatagccgatcgaaggcggcggcaatggtggaagctcaccggagtgcgaggagatgcgagctccggcgatggaattggacgggagaacagcggacgaggtggacctcgggatggcggacgcggcggcgccgatggcggggtgcggcggtgaccgtagcggctgctagaggcggccggagcagtggagatggcggcggcgggtgggtgcacggtgctaggacgatagggagctcgggagcggacggcgaaagagggaaaaaggtggagagaggcgcggtggtcggttatatagaggtggggaggccggacgtggccgggagcggcggttccgcggcgacgacgtggagaggtggaggaggagagagagggggagaggattcaaatcgaatcctgtccgtgcgggcgcgcgcgcggacgggagagggcagggcgtggggcggcgacgtggggacgtgtgggcgcggagtggggcgcggatgcggaggaagcggcggcgtgggcggcggtttcggcggcggatggtggcggctgccggaggttagggacaaccgacaggtgggccccacctgtcggcgcccgggaggagaggggaggtgggaggagggaggagccggcttgggccggctcagccgagggaaggccggcgctggagggaatgggccgggcccaagaaaaaggaaaaaggagggaaaagaaaagataaaaggaaaaaggattttcccagggatttaatattgcactatgcttattttaattggttaaaattatttccaaggctctgaaaattccactaaaaatcctgttagcatattttgacatgtagaatccaagaaaaattccacatgtcgattccgattattatttgcatttattaatttgaggaattagctctaggttaaaataaacaatttcttcggacgatttattttatgaatttagagcaagggaggggtacttcagggcgtgacaaaagggatgggccgagccggcccaagaggggaaaaggggggggggaaaaagactttttagggtttttctttttataaaatcattttaactttgtttatttcttaataattgttatttgtgctctgaaaattccactaaaatttgagggctctttttagaccaaggagattttaacaaaaattctccgggccacatttgaatttttcttgtacgtattttagtgtttgccaatttctttccgaattttaattaattctattattccttttagcgaatgatttttaattttgggatgaatttatcaggacgtgacaaatccaccccccttacaagaatctcgtccccgagattcgaggaggccagcaagaagataggttgggcggtcttctcttcttggttgacttcttccgtcgcgtcttctataacacacttgcctagcaaaacttctccactctggactgcttggctcgatctcctgttgtagatggaatcttctcttcacatgacttttccctggttgcacctctagctgacttcgactggctacggcattggaagatggggcttcagttccagaacttcttataactcatatctttggagtcaccctcatacaagttaccacttcatgtcatgcgtcaacactagcttgtcattactaagataccatgcttgtcatcatgagaataccatgcttgtcatttacttctaacttgccaccaactgcctcatattagctttcctgctctccgggtgctagctacttctgctattcgatgcaagggtcggtaactttgcctttgaattatgcttcccaagagaaccaacttatcccacttgacatactttgacgtcttcccaaatggctttattgctggatttgttattgtctaatcattatcctgccaaatttgaagcttcgttgttagatgtgattttaatctgacctctgtagactatcttcgaacatatcacttggttcataactgggaatagctcccacgaacaagcaactcggattcactttctttacattcagttttcttcccattattatcttcaggttgtcctcagttagcattcaacgtattcctttacacctttaaccttgatgtgttctttcccattggatcatctcccaagacatggcattgcctggtaaccggtgcttgcacttttcactccgtgtagcatctgataccgagttgaagatttcactctttgccttcatagaaacacttttacctaggtcatcttgcatacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagtgaaaccttgatgtggtttgtcaaaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatactgatgtctcctggatcttcttaactgtttgtaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgaggttagaacatagttcctctgaaatgagaccctaggtctcctttatcagcaagcaattatacacataatcacatatccgcatcttccaaaagaatcctcatagaacttgtctgtattacacatttctccctcattacatgaatactaagcactgcctaaaaggaaaggtgcttagcatcggtacattgtttctgctatgggttctgattaacacgaggcctcacgggtacggcgtttgctccagtgaccacaatacgattgggatgtctgcttcgtgtaaattggcggtaatgtggaggtcgactttgccttggttgcaggcagtccctcgagtaatgccctggttctttgcaattgtagcaaatcaacgtcttctttgctgagctatccgtctggggacggtcattctgacttggagttggaattggtggctggaaatccttgctaacattggcatcagtggtaccatagttgctatcaccatcggagtctttctcagagtcccaattgctagggttgtcattttgggtgccatcattgatactatcgtcgacatcttggtgaatgatgttgacattgcacgcttgattcgagtggtcactattggggcaagaagcatggttgttggtggtaacatcatcatcattagtattgctaatgttgttgtctgcattgtgtccatcttcttggggcggaaactcttgatgcgcaacagaagatccggtgatctgaagtggctcagtgcgctgtccttggttaccacatggaaatactggaatgttgaccatccttctcttgcagttcgtcatccgattatgctcactttcaagttgcatggctttgtccacaagtttctcaaaatcttcataatcctctaggagtagttgcactgcaagctcatcttttaacccctggagaaactgctcttgtttgtcttcatccgtttctacatcttctggtgcatagtgagccaaacgatagaactcgtgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcatagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtgggtacttgaacgttggttgcccctgctgggttgttccaattctgtaatagttgaaaggctgttgccaacatgttggtttggttaaccacaatttggattagctctggtgaggtttcgttgatgcttttctcattcccactggcttgggttcttgagtcatcggatccatcattcccatagcctttgttaccagtgttatccatctgtcacaaggtagaggttgagaggggaagcatacaaggaaagaatcgaccagaactagggacaagaccttaaaggaactaactctttttgttgatgtgttgtttgttttgcttattctgcaggttgattaagcaaacaacctagcatggttacatcacaacccaccgatgcaaaccacgcgctacacacacaagcaaggaacacacgactaacaacactaccctatagggtggcttaggttctgcgacgggttcccaagatcttcactccttcacagctggcttcactgcttccttcacttcactagcggatcctgcagccttctggagcttcggcagacaattgacgacatcttcttcttcacaaagctgaccaactagtactagttgaaatttgaagaaggaagaaaagggtaaaccttgtgcaaatagcattagggaaaggagaaaaagaggaactttcgcaaatagttttagttataaaatatgtccttaggttttatccacttggcttatcctacagtcgagatggctctgataccagcttgtcgcgaccgagaaaattaccttttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggggaaagatagagcaagaatgagtacaaccacagtactcagcaagccacaccggcggatgcatgattaatgcaaggggtacaaggggtgataatatagggattaagttttgcagaaaacagcatttaaaagtcacttagttgcccaaagccattttaaaaagacgatcctagagctacacagtattattaatcaaggccgtgacccctcacgaacctgccttaacccaaggcctacgatgattcagaccgaactggcaacccgaccctgggtcccagctcgtcccaagccaacccaggccaaccattccacattttagttgttaagccaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggaatgagcccccagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgcatgtccaattccaccataagccaaccattccatagtgtccaaatgatatgagaattcccaaagtctaaagttataaaaccacctaatgttgcctaattaatcagcgaagcatctacctaaattcatactagtggaaccaggaatagagtacccactagttggggttttgtttatcctagggtgaacaaggcaataataacaatagcaataataatgtcttaacaacgataaaaaggcatggctaaataaaacagtgataacgcgggaatttaaataaagcggtaatgcattaatttaaatcaaaataattttataaactgggattcaatatgctcaaggatgacgtgacttgccttgctcgctttcccaaacgccggcttcaacttccacgaagagcggatctttcgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaatttaannnnnnnnnnnnnnnnnnnnnnnnnnnnnnnnnnnnnnnnnnnnnnnnnnnnnn

SEQ ID NO: 11303 - DNA, 3438 bp, Oryza sativa
tctttttataaaatcattttaactttgtttatttcttaataattattatttgtgctctgaaaattccactaaaatttgagggctctttttagaccaaggagattttaacaaaaattatccaggccacatttgaatttttcttgtacgtattttagtgtttgccaatttctttccgaattttaattaattctattattccttttagcgaatgatttttaattttgggatgaatttatcaggacgtgacacatctacctctgacaaatccgtgggatacacaacaaacaaatctaatctctaacctaaacaccacgtctaagttattaattactactctaattcttgcgcaggaacttccttctctatccggagtcctagtactagagcacttagtatgaatactaaataatgaacccgcaaagatggaaatctatcttactcagactaaataattaaataacaaaagaaatgaacacaaatgcttactttatagaagaagttctccgaacctggagcagagtgtaccgacagctctggtactcctccagaattcctcctaggaagctacactcgtcgaggtagaagtcggatgagcgccaaacttccgggcactcctccagagcttcccctcactctctaccttattctaatatacaaaagatacaatagagcctcttgtaattcagctcaaagttgtgtgttggaaatgagagtgagctcctcctttcataggcaggtatgacggttacagcctatgcgaaatgaccaaactaccctggaaccggcattaggatgtgatccaggccgtccacgcaaaatttggcgatcaacggccaccaaaagggttcggctgaactggaggttcagtcgaacccgggacggctccgttcggcccgtttttcatcgtggacacttattttgaggccctcagcccattggcatgatagttgggcccatttggagttgtttaattgacttatggggcctccaatccatgtaaatgtgtcttgaatgcacggaggtgcagtttgtcgcttgacggatgtgttttcttctcaaaatacctgcatacacatatttcaccaacactagtagaaatgattagtaataatacctaccactaagttggataccatgttttatttcattatatgcaggtattgacggtcagatattatgatttaaggaccgtcaatagcacccccacacttaacctttgctcgtcccgcgtgaaagctttggactctacaacagagttatgactttcttactacaaattattcaaagccatacctgtacttgtgggtctttgtagagtctaccatgcgatcctgagcaactgagaaatggaacaatcttgactcatgtcaccctaacttttcatgaagaacaacttgggtttttttttttcaagtaaaacaaaactattactttgctttgctcctcaattgattctctcgatcactcaaagtgtatgattcctcacaaaggcatatgattgtgccttttcttttcctaccacctaataagccttatgtggagctcagggtatggaaaagagtagagcattacttgcatcacatatattgcaaagtcaaataatggatccacggaaatacaagacatactttctggtcaagaatgtgcatgtgtatgtgtatggtgaatttgtgggtggataaaggaaaaataaagataactccttttgtatacctcctcctccatttattttctcttttgaaatttgggagagtgcatggctatttttttctctttggtttttttcttttttttttcatcatcatgctccatacttgtataagcattttttctctctttttgcatagccatgcctctctctcattttttttgaaagaactttagagggagaggcataaatgatatggagtatttattttgtgcaaaatgaatggaatgaatggtaaatgaggaatgctaacttccagtgtagaagtcaagcataagtgggtgtatgtgtaatgtgtgtgaacttgaccatgaaagtatgaaaagcatttcactagtgtgacaaaacttgacaacgctcaatgtaatgacaagcaacgtatgtagcaagctaatcatgaatgatcaacctatggctttagtgggaataaaaatatcaatgagaagtttagcatcgttatatatttttcttttttttttagataaaattcccaagtgagcaacatgaagagcaagatttctatcatcagaccatatctcatttatcaattaccaagatagcatggggtccctattgaatatatcaccacaagcaacaagtaataagcaaagaataataggcgtgcatgttattttaagggagatcatgaactctaattgtaccatccctagcttgagtttaattatcttcgatattttagaattgataatcaaatcaaactcaagatagaatggatgttcaaaggaaaaattgggcaaacctgcactctgtataaaacaaaggacgattcatggtaaaggaggttcagctgaactgagggtttggctgactcctcattggttctgaccacaacaattttccttgtgtggttcgtcatggctcatcacttctggggtgatcttgctttcgttatggcgttgatgtgcaagatcacccccacacttgtatttgtatctgggaggctttattggacacaaaaaagaaaaagaaagacaagagtgaagcaaaaagggctcacttggttggaagaccaagaagccaactttattttattttattcatgaaagctagacctaagataactggagggggggcctaaggactcgttgcattgaaataacataagaccacctgccatctacctctgacaaatccgtcggatacacaacaaacaaatgtattctctaacctagacaccacatctaagttactaattactactctaatacttgcgcaggaacttccttctctatccggagtcccataactagagtacttagtatgaatagtaaacaatgaacccacaaagatggaaatctatcttactcagactaaataattaaataacataagaaaggaacacaaatacttactttatagaagaagttctcccaacccggagcagagtgtaccgacagctccgatactcctccagaattcctcctaggaagctacactcgtcgaggtagaagtcggatgagcgccaaacttccgggcactcctccagagcttcccctcactctctaccttattctaatgtacaaaggttacaatagagcctcttgtaattcagctcaaagttgtgtgttggaaatgagagtgagctccttttataggcaggtatgatggttacagcctatgtgaaatgaccaaactaccccggaaccgccattaggatgtgaccagggccgtccacgcaaaatttggaggttcggccgaacccgggacgg

SEQ ID NO: 11304 - DNA, 4072 bp, Oryza sativa
cgtggacattaattttgaggccctcagcccattggcaagatagttgggcccatttggagttttttagttgacttatggggcctccaatccatgtaaatgtgtcctaaatgcgcggaggtgcagtttgtcgctttacggatgtgttttcttctcaaaatacctgcatacacatatttcaccaacactagtagaaatgattagtaataatacctatcactaagtgggataccatgttttatttcactatttgtaggtattgacggtcagatattttgatttaaggaccgtcaacagttcccgatcttccgaaaggttataataaacaacgatttgggcggagtcgcgacactcttaacgaccaaatttggtaatccaagtatcagagatgaagataggattgaagcagaattcaagatggaaattgttctggaaacagagtgaggatcggctaaactccgaatcggctatgactatgatcagcagagttcgagtcggactaggttggccgattcagccgatactgtcaatgtgacgtggtacatgttgtcgggttgagttaatatgcttcatgaggattgccgtgcatggattgagtcctgagaaggcaattgtatctattaattaggatatttcatgtaatttccttagagatatgtttgggctaaagtctgccacaaaggcttatggtatcttagagtttgttagagataagagtcgtgtccgacacggacatattttgtaatctcgggtataaatagatcccgagccccatataatatgataacacatgttcaatacaatctcggcgcatcgccaccctttactttcgttttgtttcgacgagttcttgctttcgggttgagctgcatcggtttcaatcttcaactagaggtaaaacttgttatggcggcttgcgttctcgggattagtgcttccatctttatgtaattcgtcgtgttatcatatattctatataatctctggcaatattgttatctaacttccaatcggcctatatctgctactagaaggcagccgatcgggttaaataccaatgttgacttagattatataggatatccaccactctatgaaataaccagtggcttgattgtctagatattgtccttcttttcatacttatagctgtatcagttgagtttcaccttataagtcgtgattagaatctcaatctatagcctgcttttggttgccgattagggtagcatcggggtttcaacctgatttaactacttttatcctatatgcttgactgacatgttaaatctgccctttatattaagatcttgctgcatttaagtatatttaggcttttgtttagtatattctacttgatttaatatcttaatatagagtagtatcagagtattagccgatacatgctagatctatctgatcggctatgctatgaacatatatagtctccttgttaatatatatttcaatctaagtgatttatactgtctcagtatggtgaccaatctatcccaataacttgttttaagtatatatcgacataaggattatatattgttaatatctacagccgatcgggtagacttagttcttttttattcattcatgatcgccgatcgatactcatatgacattggctcagagataaatgatacatcatcggcaactagccgatcggctatcctttatggatttaaccgcggtttctttgtctttatttcttgttgattgcaggatcaaatcaactggcacgctcacacacctaaaggcaagcttttggacctgcactggagttaagcagatctcccaggcctcgtgtttttacatcaacacgcttttggcacaccctgtaggacgaacaaacatgtcagcagaaaagcaatctccgtcgtcaacgggcaaatcggtctgaggttaacgaagcagatatcattccagtcactgtagacaagctttctccagagcaaaagaaagagtttgaactgatgatgaaacagacacaacaacagttcatgaattcattcatagagactcggcatgggagagttgttcaaaagtacaagttgaagctagttgccgatgtccctggaacaggttcttctaaagatggtgaggtgcaaaaaactcaagttagtatagatgattcgggtgataaaggcaccacaggcggctcaagcggcaaaggtgacggttttcaggaaggaatggttgaggatcttggtccagatggtagtggattacaaccatactttaacaatttccaagatcagattgactacgctgtgcaacatgctttgatcaatcaatcaggagtcttagtcaacactttaaccaacatggtgaaaacaatggttgatggcacaatagctgagcatcaagctacatgaccagtgtatttgccaggtggagtttttcgaaattataggcctttggttacaggaaatcaacagggttcttctaacacaccatcaactcagccgatggcaccggttacaacttctgctccggctgcacaagctacaccatcatcggcacaaaggcaaatgaccaatcctcgattgttgacaagaggacagccacaacaaggtggacaaaacatcaatcggctgactcaggagtaggtggctgctatgttcctgccaaacccaccagctaccgatccagcactgcaaagccaacatacgccaccaagacaacacattacttagccgattcaacagcaaagtttgctaaatgcatcggctaggttggggacacctgataatcagctaaggcagcatgttgcaactcgagtcgtccatgagcacttggttcataatgtacaaccagatcaatcagtgatacctcaagttatacctgaacatttggtgcgtaacatccagccgaatactcagaattacaatgggggtcacttgaattatcattatcagcctccttcacctcatgtccaccaaggggggtcacctcaacttcagtttgctcctcagttcaaccagttcgagctgatacaacagaatacgcaaggggtgccttagcagagacagtgggccgacatgatcgcagatgtgatgagggatcaatttgggcttaagccgaaggatactgggaacttatatcggcatccataccctgagtggtttgagagagttccattgcctgtccgatacaaggttccagacttctcaaaatttttagggcaagacaatgtttcgacatatgatcatgtcagctgattcttagctcagtgtggtgaagcatcggctattgacaccctgagagttaggctgcttctctaccatacaattctatcaatggttgggccgatttggagaaacaatttcatagctatttttacagtggaattcatgacatgaaactactttctgacctgacagcaattcggcaaagacatgatgaatctattcaggactacattctaaggtttagagagacaaggaataggtgttacagcttggctctaacagattcccagctagccgatttggctttccaaggtttgatagctccgattaaagaaaagttttcatcccaggagtttgaaagcttatctcacattgcacaagtgatgttgcatgagcaaaggtttgcagaggctaagaagaatttcaagaaaatcaatcatgtgtatccttacatgtatggatctgatgatgaggatgactccgaagtagcagaagtcgaatgggtcaggtgcaaaaaggttgtgccatgcccatgggtgaggagttctggaaaagaagaaagatttgattttgatatcaccaaggctgataagattttcgacttgttacttcgggataagcagattcaacttcctgctggtcatatcataccatcggctgaggaactaggcaaaagaaggtattgcaaatggcataattctggttctcactctactaatgattgcaaggttttcacacaatagatctaggtggccattgaaggggggaagattaaatttgatgactcaaagaagccgataaaggttgatggtaaccctttccctgtcaatatggtgcatacatccggaagggcagccgatggagggaaaaat

SEQ ID NO: 11305 - DNA, 1922 bp, Oryza sativa
cggtgcagggaggcacggggagcgtttaaatagtgttgggagggggagagaacggccggatgagggggaatcgaccgcggaagatccggccgccattgatgcgccggcgaagtttgcgggagtgtttccaaacgaatccgagggagagagagagggaaaagtggggggaaagggagagggaatcacggggagtgatttccccctctttattgcgcccgggggcgcgctggatccgacggaatcctcggcggcgccggcgctagggcacggtcgagacgccggtttcggcgcgaggtaggggatgacgggtgggccccacccgtcagcgagggtgccgggcgggcccgcgcgtcagcggcgcgcgcgcgggggaaggccggatgggccgcgggggagaggagagagagggagggagctgggccgagccggcccaagagggggaagggggggaaaaagactttttagggtttttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcacaattttgaggatgtattttagagtcgttttgggacgcgacaaacctaccccccttaaacggaatctcgaccccgagattcggaagaactggcgaagagatcgggatgggctgccttcagcttgtcttcacgctcccaggtggcttcttcttcggcgtggttgctccactggaccttgcaaaaccggattacccggttcctggtcctgcgctccatggtgtccaggattttcactggcctctccacgtaggtcaagtcttcgcgaacttcaatttgctctgagtcggcctgctcggatggcactcggaggcatttcttgagttgcgacacatggaacacatcatgcacgttgcccaaggaggcgggcagctccaattggtaagcgacttctccgcgtcgggcaatgatacggaaaggacccacataccgaggtgcgagcttcccttttgtctgaaacctgtgtacaccccgcaatggcgtgacccgaagatacacaaaatcatccactgcgaattccaggttacggcgacggttatctgcataacttttctgccgggactgggccacctttagattatcccgaatggttctgactttagcttcagcttctctcaggatatcagtcccgaacacttggctttccccaacttgatcccacaaaagcggtgtccggcatttccgcccatacaacgcttcataaggtgccatttgtatgctggcttggtagctgttattgtaggagaactcggcataggggagactcttatcccaggtcttcccgaaatccaggacacatgcgcgaagcatatcttctaggatctgatttagacgctcggtctgcccatctgtctgcgggtggtatgcggtgctgaagtttaatcgggtacccagctcttctggaagcttcttccaaaagtgagaggtgaattggcttcccctatcggatacgattttcttgggaacgccatggagactcacgatccaagtgaagtagagctcggctagtttgttccctccataggtggtcttcacaggaatgaatcgagctaccttggttaatcgatccaccactacccatatggaatcatacccaccttgggtctttgggagtccggtgatgaaatccatcccaatttcatcccatttccattcaggtacttggagaggttggagaagtccggccggtcgtaggtgctctgccttgacacgctggcacacatcacaaagggccacgaactctgcaatttcccgctt

SEQ ID NO: 11306 - DNA, 487 bp, Oryza sativa
caagaaaaatcttgaaaatacttgcacactcaaagtacttaacaaaattataattagaccatttaatgattaatttaatatgtgggtaattactgaaatgctctttgtaagattaaaattagaaattgagctccgaaaaatccgagaatattccagagagtataattaaccatgtagaatttaaaaaaaaattaaatccatccatgctttatatttagaaaattttatttcccacatttaacttcacttgtaaattaatgaacatgtaatataaattccaataataattcattgaataatttataaatcctgaaaccaaaatcaggatgtgacaaatacatggccaaaacatcttccgtcttcttagctccaaaatgtcccatcaactctcctccatgcgcttcctgtatcaacaaaagacgaacggaaccaactggaatgcatagacggttagctctataaacaaacccaccattgatcacagatt

SEQ ID NO: 11307 - DNA, 11290 bp, Oryza sativa
  unsure (1)..(11290): unsure at all n locations
tgcgggagcaaatccgtccgtttgaatgcgaggcagagaggggaaaaaggggggaaaggaagaggggatcacggggagtaattcccccctattaatttcacgcgggggtggcgggatgcggcgtattcgccggcggcggcgacgcttggcgcatgtgggcggcgggaacgccgggaggaaggggatgatgggtgggccccacccgtcagcgagggtggcgggcgggcccacccgtcagcggcacgcgcgcgggagaggccgagtgggccgcggggagaggagagagagggggagggagatgggccggattcggcccaagagagggaaggggaatttttagggtttttctttttataaaacctttttaactttgtttatttcttaacaattattatttgtgctctgaaaattccactaaaatttatttacacattttaggcttttaggaaatatacaaaaatcctctaagccttatttgacttttaactttgcacattttaatttttggaagctttcacaaggattttaattattctaggcataatttaaaggatatattttagggtcgttttgggacgcgacacctgggaattcattatcaccctggaaaggctaatgttgtagcagatgctctcagcgggaaaggttattgcaatgctacggaagggcgacagttgtcattggagttatgcaaggaatttgaaagattgaatctgggaattatcagtagaggctttgttgcagctttagaagcgaagcccactctcattgatcaagttagagaagctcaaatcaatgatcctgatattcatgagatcaagaagaatatgagaagagggaaagctatcggtttcttggaagataagcaaggaactgtatggttgggtgaaaggatttgtgtcccagacaacaaagatttgaaagatgcaattctgaaggaagctcatgatatgctatactccattcaccctggtagtactaagatgtaccaagacctcaaggaaagattttagtgggcaagtatgaagcgcgagatagcggaatatgtagcagtatgtgatgtttgtcagcaagtcaaggcagaacatcagaaacccgcaggtttgctgcagcctttgaagataccagaatggaactgggaggaagtcagtatggatttcatcactggtctacccagaacgtcgtcaggtcatgactctatttgggtgatagtcgacaggcttaccaaagtggctcattttattccggtgtgaaccacctattccggaagtcgtttggcggaattgtatatggcaaggattgtgtgtttgcatgttgttcctaagaagatagtatccgatcgaggtaccagtttactttaaaattttggatgaaacttaggaagagatgggttccaagttgaactttagtaccgcttatcatccgcagacagatagacaaaccgaaagggtaaatcagattctggaagacatgttgagagcctgtgctttagacttcagtggaagttgggataagaatttgccttacgcagaattctcgtacaacaacagttatcaagctagtcttcaaatggctccttacgaagcactgtatggtcggaagtgccacactccgcttttgtgggatcaaacgggagaacgtcaagttttcgggactgatatcctaagggaagcagaagagaaggtaaaaatcattcaagaaagattgcatgtggctcagtctcgtcataagagttatgccgacaattgccgtagagatcttaaacatatcctttgattcttgatccaaattcttccttttgatctagccactgatctaattcctgtggcttgatttccttctcggcacaagaataatattactacaaacattgtgaataattgctcttctgctaagataatagattatatccttgtcatccaaatctcctattagcctcaaacaattctttgaaacccatgccatatattttgaggctaaaaatcctatctatcttcctccatttattttctctccctctcatttgagtgcatcaaataaattccgttatattctatctctcaaaatattgcactcaaactagaaaatatctcttttggaaattatatccaaatataatttcctttcaaaattccctattcaaatttcttccaaatactaatctcatccaatttctatcatacaaataacctacaaaatttagaattgatttctaaatttaattgggctaaaatccctttgtctcttccttttggcccatcttcctcttcggcccagcccaggcgagctgccccttcctcctaccgtgggcgcatccaggcgcccgcatgcgccgctactgacgccgtgcacaactcagctaccgctgccgacatattgccttcgatgccaagcaatcgccgccaatgtcctgccgtcgccgctaaggcatcgacgncgacgtcatatgtcacctcacgccggcgacgtnagactatggagcaaaccgacatcttcaccaatcacaagccacaagccgtgccgtagcactttcttttcacgntcgacgcaccaagaccaagctcatcttttgctttacaaccgaccttcacaaccgacgtccgacgcctataaatagaaggccagccctccccttttctccacatatgagccgagctcctcgagctctctctctctcctgttatgtctagccaccaccggccactgtcgatctccctcaccggagtgtttctggccaagcccttgcgccatcaggtttgcctcgatgaggtgaactcattttcctagtttccccttcctttccccttccgaaaccaaccatcacagccacctccttttgttgtcggagcaagctcttgcctgcgccgttccagcctcctctctcacttcctctgccgactgtcaccctccccaggtgcgcgtcgctcgggaacatgtttttccgccaacgtcgcagcctctcaaccaccggagtatcgacgcccgtcctgtcccttctctctgtttgttcgtggagaaagagagaagaagcaggaagaaggaagaagaaggaaaaagaaagagagaagaaaaagaaaaaggacagctactgacaggtgggcccctacagtactatttcacattttctagatttaattcaaatcctattctttagaagcccatatctcctaaaccgtagatccgattccagtcaaacttggacctaaattcatctaaattcaaaccctaccttttgatactaaatttgctatttaaatattttatttgaatttccttgatttatttaaatgccatttgcctttcaaatatctcctgttactccaaaataccctttagccactaaaagccgccggttagaactttacgccttccatggagacgttcgcggtctattggccccgacgtcgaaccgttggttgtaaagcccagcaaattccaaaaccaaggtcgaagtgctgctccgggtatcctacgcctcgatgcgtacaactgtcggagcttcattattccctcgacctccacatcacgccgcacagttagctctcgagctctgtgtgatcctagccgctccgccgccacccctctcggatgaggcttattcagaattcttgcaacttcagggggttctggacaccttgaacttacaatcagggatgggggatgcttggaattttatctggggctcagataagtacactgctaagaaattctataagttaaattattcttcattgcaaccccccagacccatgatttggctatggaaaacaaaatgtgtcatgaagatcaaggtctttgcctggctaatgttctgtgatagacttaatacaagagatatgctggatagaagatattgtgccaaagaagatgatgatctcacatgtgttttgtgcaatgcgaactgcagagagacaagactgcacctcttctttttatgccctttcagcatcaggtgttggcaatacctgggaattgagtggaataacaatttggagtttttccaaatgatctctctagcaagaatcaaatttgctcagaagggtttcctggaaattttctttttggcagcttggcacatctggaaacaaagaaatggcttcatatttcagaacatccaaccctcttttcaggcatggagatctcttttcgttaaagaagttcttctgcatatgtgcagaatgaatgaacctttaaagcaaactgtttttaattgggtacaaaccttatagtatctctgtgtgaaccgcatgtaatatttgtaaccttgtaaatattttgtttatttataaaactacactactgggcaaagcattggcagttttcctggtcaaaaaaaaattgttagtttcgggtcccgacaggactggtatcagagcatatgtttgactataggatgaaccttaaggattactgactaagctaagtttgaatttatttcaagcttacctttttaagggggtagatttaatccacgagcatgcattataatatcatttgtgtatttcaggacaatggcagaagtgcatgagcaagaacttatagaaactgcaattactatccacgataatgactgcattgatcaactaatcaatttgatgactaaactgaagataaatgagaagccggaattctattcacatgcctatcaacggggagaacgttgggaatatgatatgaccgtgaagatcaatcctccacgaggtgaacgtgatatgtattacttttgaacacgtcataggcgggataccgtgcgagctgcactatatgatgtgtccagagaggcttttctacgtcttaatcatatctaccaagacaggttacaacactctcgctattcttatcatcgggcgaagattattgtaccctccagaatgtggattatcatgaacaaccagtaaaagcaactatgtccatctggatggaagccgtggatgatatgtatgaagaagctttggaacatatggacatacaacgtaaacgtttggaggaagctgaacacagagaagctgttctcaaacacaaatatcgtatacttcatgaattatatgaggaaagggaaaaacaaaattctatcctcaatatttgtgttgcaggagcagccttctgtcttcaccaaattccaagtatgggtagtgatgacgaagacgatgaaggtggtatggaaggacatatctcaccagtacgtgaaggtgaaccacatgggccaaaccctcaggataatggtgaagaattttacaaggtttaccaccatcaccaccaccgttgtatcctattcattctgatgacgaagcagaagaaatgcattcagccatggatatcagtgaacctagccaagaacctaaaatactcaggccaaatcgggtgtttcatatcaataaccaaaatactgccccaatttggactgaatctccagaggaagaggaagatctagaagaacgagagcttgagatacaagaacatctttctatacatgctgatgatcaagaaaataatgaagacccctactcatgctctgctctcagtaatactgcatcaacttctgcatctcatgaattttcacacttcgaacctacatcgttatttgctaatcccgcagaaggcagtggtggatggcttgacgaatagaagttatagatagttaaaggtcttaagtgtagaatagttagtgatcctactcctctctaacttctatgtgtgattaccccttcttttgtggttgtggttttctttggtttgtttcttttgtagcatacaccatgtacaatgttgttcataaataaaatctatgtttaattatggatgttgactcccctttgagaagatatcaattaccccattttctagatgaatccgggcaatggcagtatgggtgaaggagatacaggagaaatcccttcaccaaatcctactaccttggcagaagtaatggcaagacaaactcaattattgcaagccatagcacaaaatcaaggaaatataggttacagcgcacatgcagaatttatgagaattaaaccaccgatcttctctaaatctgaagaacctatggatgccgaagactggctaagggctattgaaaagaaactaaccttggtcagaacaaacgaacaagagaaggtaacctttgcaacccatcaattagaaggaccagccaatgaatggtgggaagcatatcaagcttctatagaagatcctacacatattattacatggatggaatttactacaacttttagagatgcttttatacctacagctgtgatcaggatgaaaaagaatgaatttcgtagattgaggcaaggttttatgacagtacaagaatatttgattaaatttacacaacttgctcgatatgccgcctcggacattcaagatgaaaaagaaaagattgaaagatttatagaaggactacgtgatgaacttcgaggaccaatgattagtcaagatcatgaaaattttcaaagcctagtcaataaagtggttaggctagaaaatgatcgtagaatggtggaaggactccctaagagaagaatgaatttacaatgacaatcactaactagaggttcactacaagttcggaggccttatccatttaaggcatctctacccaatgcaaggccaggcatgccaccaatactaccaagacctggattaaaaatggaagactctccttgttatgtttgtgggaaaattggacattttgcaagactatgccctaatcgtcaaaatatgggaggccaaacttcttatcagaaaccatctactacaggttttataaagaaaaatcctccaataattaagagtggacataatcttggacgtggtcaagtacatcatattaaagcagaagaagctcaacaagatcctaatatattgatgggtatgttcaccataaactctaaaccagttactattctatttgattctggtgcctctcattcctttctatctgcaaaagccaattggaatcagtctttacctaaagataatttagataaggctgtgctaatacattcacccagaggaaactgtattagtatcatctatttgtagaaatgttccggttaaattaggagatcaaatatttttaattgacttgatggtactacctacccaaactatagatatcattttgggcatggattggttagccaagaataatggactgatcaattgtgcaacaagagaggttatccttactgatgaacaaggaatgaatacaaggataatagttaaatccaatctatctatggaacaacatatgacagacatttgtatgcttaaaccaaaagaagaagttccagtggtgcaagaatatttcgatgtatttcctgaagaactaagttcattacctccagatcgggaaatagaatttattatagaattacttcctggaatggcacctatatcaaaaagaccctataggatgccaattaatgaattggaagaattgaagaaacagatagctaagctgcaagaaaaaggctttattcgaccaagttcttcagcttggggagctcttgtattattcgtaaagaagaaagatggaagtttaagaatgtgtgtagactaccgggctttaaatgaagtagctattaaaaacaaatatcccttaccaagaatcgatgatctatttgatcaattaaaaggagcaagtgtattttctaaaatagatcttcgatcagcatatcatcagttgaaaattaggcaagaagcatttggattaaccaatgcccctgcctatttcatgaatcttatgaacaagatatttatggaatatctggatcaatttgtggttgtatttattgatgacattctgatatattccaaaaataaggaagaacataaacaacacctacgaatggtattggagaaattaaggcaacatcagttatatgccaaattcaataaatgtgaattttggctagacaaagttgcatttctaagacattataactaaggaaggagttgccgtagatccggagaagattaaagcggtaatggtatggagaacaccaacctcagtacctgaaataaggagtttcttaggacttgctggatattatcggagatttattaaagatttctccgctattgcaaaacctatgaccagattacttaaaaaggataggaaattcgaatggacaccagaatgtcagagtaattttcaaagattgaaacataagcttactactacgccagtattaatcttgccagacatccaaaaagattttgagatctattgtgatgcctctcgacaaggattaggatgtgttcttatgcaagaaggtaaaatagtagcttatgcgtcaagacaactaagaccccatgaagataattacccaattcatgatttggagttagcagcagttgtacatgcgttgaagatttggcgacattacttaattgggaatcattgcaagatttataccgatcataagagtttgaaatatattttactcagatggatcttaatcttcggcaaagaagatggttagaattaattaaggactacaatttggaaattctataccatccaggaaaagccaacgtagttgctgatgccttaagccgaaaagctaattgcaatctacaacaagaaataatatcagaacaattgcaagcagaaatgcttaaactaaatctgggtattattaagtttgaagaattaaacactttggagttaaaacctaccctaatggatcaaataaaagaacatcagaaggaacattctgaaatacaaacttttaaggaacgaaaggtacaaggaaaggctgcagatattaccgaagacctggaaggaatattttggtacggagatagaattgtcgtaccacaatcaggaaacttgaggaaggtaatactaaaggaagcacatgattcagcctactctttacacccaggtagtacaaaaatgtaccatgatttgaaagacttatactggtggccaaatatgaaacgacatattgcagaatatgttgcactatgtcatgtttgtcaacaagttaaagcagaacaccaaaagcctacaggattattacaacccttacaaatacctgaatggaaatgggatgaaataggaatggattttattactggattacctaaaacttctactggatatgactctatatgggtaatcattgatagacttacaaagactgctcgattcattcctgtgaaaacaacttatactggagcacaagttgctgaactctatatgacaaggatagtatgtttacacatagtgccaaaaagaattatttctgatcgtggtaccaatttacttcacatttttggcagaaattacattatgaattaggaagttatctggatttcagtacagcatttcatccgcaaatcggaggacagacggaaagactaaatcatacattagaagatatgttaacagcctgtggtctagattttgctgctagttgggacaaatgtctaccttatgcagaattttcatataacaataattatcaagccagtttaaaaatgtcaccacatgaagccttatatggaagaaaatgccgaacaccattgatatggacataaaccggagaaagatgtatattcggaacggaccttttaaaagaagctgaagaaaaagttcgactgattagagacagacttaaagtagctcaatctcgacaaaagagttatgcagattctagacggcgagagttaacttttaatactggtgattatgtttatctaaaggtttcacctttacgagggataaaaagatttaaagtcaaaggaaaattagctcctcgttatattggaccatatcaaataattgctaaacatggagaagtagcctatcaattggctttaccagattatctatctgatgtacatcctacattccatgtttcacaattaaagaaatgtttacgtattccagaagaagaaatatcagtaagtactgttgaactgaatcaggatttaacttatccagaataccctatcagaattttagaagaagcacagagaacaactcgtactaaggcaataagaatgtttaaagttcaatggaatcatcatacagaggatgaggcaacttgggaacgggaagattatttacaattggtattcccgtatcttttcgaagactcctaagcaaatctcgggacgagatttctttaaggggggtaggtttgtaacatcctcaaattttaaactaaaatttgactgcatcatgctgacttttgattaatttagtgtgtttcaaaaatttatttggttcctaattggttcaagtattacttctttagaaccctactaatttacccaaattattccctttattccaaaccctagtgaatttgagcaaattctctcaaatttcaaactatagattatttccttagcttatcctaatattagtgaggacttgctatacttcaaaccctagtgaaacccttccaaattcatagattaaattcattattttctacggaaatattcaaaattctgaaattgattgttcattgcacataaggtgttcggtagaatgcctagcccaactagagcagcccaatcccctccaatcttgtacaaagtctagaattgatcctaggggaccacaacccacttaaaaccgtggctttctttgcctcttcctccccttcacgcgcgtggcccgggcatccgacttagtcgcgcgccgtgtcgctgcgcgtcggcctcggagccgcttgcgcgtgcccgacctccttggcgcgccgtcgcccgtccgacgccatcaaccccactgccactgcaccaatcgcaacgaggacaaagccaggacgacgaccgccgcacgaaatcgccgctcgacgccgtgcgctcctgtccaagccgccgccgagtgtgatttcgtttctatccggggtgaatcgcgccaattcttgccgcacggttggattgaagatagacggtggtatcccctctcacaattcaaaccattcacccccgagccggccgttttcaccctcgccgccattgcgtgtcgcgcctggattggcgccctcacgtcgccagccgattccaaccgcggtcaagtcaatccttcgccggtaagtatttgaacgtggcctcccgccactcaaatcgatcttacccgccctctcacagcctctgctgccctagctctatccaaatcccgagctcatccatggcgatgacggtgtccgagctcatccgctcctcctagccctataaataggaccccaatcccttccttgtccatcatccatcatcaacaatcaaagccctacaaccccgaagctctgcttcg

SEQ ID NO: 11308 - DNA, 2575 bp, Oryza sativa
ttaaattaaaatttaaatgaagaaagtcgcaaatatccatttaaagagcatataaacttcaaatgaccataacttggccatttgaactcggaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatctgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatggctatttacctttgttatgaccttattattattgttattgttattattaccttgttcaccctagaaccaacaaaaccccaactagtggacactctactcatggtaccactagtatgattttaggtagatgcttccctttaattaggtaacattaggtggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggattagagatggacgaagtcgggggtggatggacatctctaggacaaatgaaggctacacgggctgcggttcggtagtcgagatgtcatggcacagggcggtgtcctgctgctaggggctcagtcctgcctacctgtcccgggagtttcggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttagcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactgagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaatcggctcggtcttgattcaggagcttgaggggaaggaaagagttgtgttttatttgagccgtcggcttttggaggcagagacaaggtattctcctgtggaaaagttgtgtttgtgcttatatttctcttgcataaggttaaggcattatctattgtccaatgaatgcactgtaatatgcaaagccgatgtggtcaagtacatgttatcagctccgattctgaaaggaaggattggaaagtggatatttgctttgatggaatttgatcttcggtatgagtcaccgaaggcggttaaggcacaagctatagccgattttattgttgatcatcgtgatgactcaatcggctctgtcgaaattgtgccttggactttgttttttgatggatcagtgtgcactcattggtgtggtatcggcttggttataatttctcctcgggaggcaagttttgagtttgcctatactatcaagccctatgcaactaataatcaggctgagtatgaagcggttctcaagggcttgcaattgctcaaggaggttgaagccaatgctgctgaaattatgggtgattccttgctgttgaaattatgggtgattcaattagtagcagaatatgagtgcaaaaatgatatattaatggtttacagtgagaagtgtcgagagttgatggatggatttcggctggtaactttgaagcatgtatctcgagaacaaaatgtcgcagctaatgatttggctcaaggggcatcggaatataagccgatgatgaaggatgtcaaagtagaagttgccacaataatagccgatgattggagatatgatgtttttcgatatttgcagaat

SEQ ID NO: 11309 - DNA, 2108 bp, Oryza sativa
cgattgatggggtattacttaaatgtttgagtgccgatcaagctaaggttgcgataggagaggtacatgaaggaatttgtggaactcatcaatcggctcataagatgaagtggttgctttggccatttagaggttgattctggggatgctataaaatttgttcaagagcatattatttatcgatttggtattcctcaaaccattacaaccgatcaaggctcgatcttcgtgtccgatgagtttgttcagtttgacgatagcatgggtatcaaattgttgaattcttcaccatattatgcacaagccaacgggcaaccgaggcgtctaacaagagtttaatcaagttaattaagagaaagattttcgattatcctcggcaatggcacacttgattggctgaagcattgtggtcctataggatggcttgtcatggttcgatccaagttcctccttataaacttgtttatgaacatgaggctgttttaccatgggaagttagaattggctcaaggagaacggagttgcaaaatgagttgacagccgatgagtattataatctcatggccgatgaaagggaagacttggttcaatcgagattgagagcccttgcaaaagttaataaggataaggaacgtgttgctcgacattacaacaagaaagtggtgtccaagtcttttttcggaaggtgaacttgtgtggaaattgattttgccgatagagactggagataacaagtttggcaagtggtcaccaaattgggagggactgtttcaaatccataaggttgtatctaaaggggcttacatcctacaaggacttgatggggaagtttatggccaagcgctaaatggcaagtacttgaagaaataatactcaagtgtttgggttaatgcatgatcggctggtgttgccgatacatgatagccgatgtatttacatcgccttgagatggccgatattgctatatcgcccttagttgtttttatgttgtaatcggttgtgatttgccgatgtacaatggccgatattgttatatcgcccatagttcaatttataattttatcaatgccttcgtccttgtaaaattaggggggcacatatatagaaaagttgcaaatttgaatttttgagtttttgaggaaattttttgagcaaattgaaagttatattaatcggcacagcagtacagtgatacaaggagcattaaagtttgctagccgattacaaagataagttatcctattacaagaccaatcatccagacaaataacactggatagccgatacaacccgttgtctaatttgaactacttcttcgatggcttggatgtcttgggcgtcggttccagggatgattttgagggacttggtcatatcagccacattctttatagccgatttaagtatggatttatgttcttcgacagcatttggaagattggctaacttttgcttctccagatccaactcagcattgcattcttcaagttgagctattagatcaatcttgcgggcttcaagccgatctatgttcgattgaatcggaccagcagagagttgatcaagcttggctttctcctcatgcacaagctgccgattggcttggatagtggcttcaatatcttttcgctcccgtcgatcagctattctttgcttagccttctccagcttgaattgatgttgctcgaggtatacagctggagtaatggtgttcgccagatcatccgggattaaggcttggatttcagcaaaccgtgcccggattgagccacaatcggccaccagattatccaatgatgactctagcggaagggatatgtcttcaagtgttttcttgatagtttcatccagagggtctagagccttgctagtggtttcttcctttgtctcatcaaagtaatcctttatatcaaaagagaacaaatcggctaaggcctgcaaaagagaaatccgaagacaattaaataatcaaacaaatttagccgatctaagatcttattatagagagaaacttactaggatggcacgagcggctggttggtcttcttcttcatgatgatgacttcctgtagctgatggggtacagtcacttgacatctgctatacag

SEQ ID NO: 11310 - DNA, 6305 bp, Oryza sativa
agggcctcttgccaccttatataggatgggggccaggattacaagatagaaactttaaccaatgcggtatcggtttcgtaaatctactttacaatattaccaaccaggactttaggctgttccgtaatatataaggaaacgtaatacccgagccatgatctgttacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatcttcgtcatggtctcccgagtacttttaccaaatctgaagactgtggagggctggaaaataaagtcaggtgcaccgactggatgcacctaataggtgtagccctcgactatgcggttaagtgaacaaaccaagcatatagtcaaggaataaataatccaaccaaccgagtggcttcgataattatagttaaccaagcgacttgatattaatatatagcatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaatttccaaagtattgggcatacgccatgcgcacactgctttaacagatgtgcttaagtccctaaaagacacatggtttcaccactcctggaaatatatggcatatatggtataacatccgagtaagtaaactcataaaggatctaccaaccgcctgaaaaatgaccataatatataatcagcctaagccataatattggtcaataaaaatgcacacttacatggcaaaaagcaatgatattgtatccaatcaattgcttgataaacccaaacagcaccttgactatataaaaaagtcagcggggcagctatataaagctttactgtttgacaccttttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggtcaaccgtcaaggtgaaataataagtcggcgaaaacataatcatccattagcaacagcggagatgtcagggtcgatgaagcagaggtgctggagatgatgtcagtgacaataatccatcaaattaatgttatagctgttgtagatgcttcacttggaggagagttgatgatgttgtccaactcgtccaaaccgaaatatttgaagttgttggagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcatggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcgggggcagcataatcagtcggcgacggaagatgatgatgtccatcagtagtggtagctgtataatccagacgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagtcagccgtgaagaagatagcatcagttggcgttataacaggccagccgtgcaggcggtgacaccagtcagcggcggatgcggtggccggtcggtgaagacgtagacgcccaccaacggcagcataataggccagccgtgcaggcggaaacaccagtcggaggcggcgaaggcaagccggtcggtgaagacgtaaacgcccaacaacggcggcataataggccagccgtgcaggcggaaacaccagtcggcggcggacgaggcggccggtcggtgaagacgtagacgcccaacaacggcggcataataggccagccgtgcaggcggaaacaccagtcggcggcggacgaggcggccggtcggtgaagacgtagacacccatgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcagaaacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccaacaacggcggcataaaggccagccgtgccggcggaaacaccagtcggcggcggcgaaggtaagccggtcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacatagacgcccaacaacggcggcataaaggccagccgtgcaggcggaaacaccagtcagcagcggcgaaggcaagccggtcggtgaagacgtagacgcccaataacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggacgaggcaagccggtcggtgaagacgtagacgcccaacaacggcggcataaaggccaaccgtgcaggcggaaacaccagtcggcagcggcgaaggcaagccggtcggtgaagacgtagacgcccaacaacggcggcataataggccagccgtgcaggcggaagcaccagtcggtggcggacgaggcggccggtcggtgaagacgtatacgcccaacaacggcggcataaaggccagccgtgcaggcggaaacaccagtcagcagcggcgaaggcaagccggtcggtgaagacgtacacgcccaacaacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtggacgcccaacagcggcggcataataggccagccgtgtaggcggaggcaccactcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcgatgcatggacgcccatgaacggtggtgtgac

SEQ ID NO: 11311 - DNA, 5195 bp, Oryza sativa
aggcggaggcatggacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccactcggcggcgacggaggcaggtcggcggtgaagtcgtagacgcccaacagcagcggcataataggctagccgtgtaggcggaggcaccaatcggcggcgacgaaggcaggccggcggtgaagtcgtagacgcccaacagcggcggcataatatgccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaataaatacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaagggggtagcgcacgagatctaaaagtggatggatgcagagacaaaggatttagacaggttcaggccctctcaatgagaggtaataccctactcctgtttggggatttgaatccgccgggtgtagtatagatctgacgatcaggttgtctcatatgccccctagagggcctcctgcccaccttatataggatggggggcaggattacaagatagaaaccttaaccaatacggtatcggtttcctaaatctactttacaatattaccaaaccaggactttaggctgttccgtaatatataaggaaacgtaatacccgagccatgatctgttacatattccatagatataagttatcccctatgactagtcggataaccatgccgtatgggtatggggtacccataatatccacaccggtggagctggtttaagtattgttgctgccgatttcttcctcacagcagtcttctttttctgcaaaagtgagatttataagtgatcggctatgaatgaaataactgcaaaaggaaattagtatgagtggtttacccttgagaaatgagctagggtagcaggagttgggggagtttgcttgggtgaagccgatggtgttttttctgtatcacttactttggctgcagcttgatcgacatcttcttcgatctcttcttcatccagggcttgctcgatggatggatctaaagcaggcaagtcatcggctggcttaggtttgttcttcttggtcttcttcttgggagccagagctgattggtcaatagccaatgccttggcctttctcttcctgccaacatcggccggttctctcatctgtcgttgaagcagacttgaggtcttaggggcatggtagccgatgacaggaggagctaatccacctccgtttggtagaaggcatggagcatattctatgtccctgccgctattgctcttgcgaggaggagaagattctgttgtctgcaaggtaaagagagaagttagtcaagattcaagtcagctaataattattcaaacaaaattggcaaaataaagatgtacctgagggacaacatcaggaaataggtctgtcatgtacatagaagccgactgatggaatatatgttgcttccattcgccccaccatttgtcaaaattcctactcctgagtcttgccaactctatgttctcgatgctgcccagagggggtgatgtgcactagggttcccgatcttcctaaaggtcctgataaacaacggtttggacggagtcgcgacacagatcgacccggcttcttgaacgcgcacgctcttgagccccgcaatcgcagcaccacgtctcctctggttatcacccgtgtcgaaacgtggatgacctcgccgagaaggctaatccctgtttgccaatcgaagaacacaaacaagaacgggatagaaaaacaaccaaaattgcatatgaatgattaagctcacgagttggggtcttacaaaccgatctagcggcgaaactgttctcgacagattaatctaagcaaaacccaaaaacctaaagatgttggtgggtactgatatatagagtttaggtcgtgtaaacccctctcgacgcaaccctaatgggttccaacacgatacacgggccaaaggcccaaatacggtgacgcagcaccaggacagattctggacgtcaaattgttcggacaattcccgttgactcggaaagaatttggatgtggaaccaaaaccattggaaaggttttcttcttagctttccatccatataaagaacgccctaatccgagcacgtatgtgacctgggcgcccattttagtgtagactggtcctggactccgaattgcacccgacgtcgagttggtttgggcctccaccttgacttggacgtccccgatggtcctccatggctctaagtatttctccaagtgtctccttgtcccctccattgttcctaagcacaatataatcattaggtagcaagctattcttgaattcatacaaagaagaacataggaatgaactcacctctaaatttaattgtcgcgcacgagctcttgttatcgggccttgaatgaccattggaggattgttgtgtgtatctgaggtagtgatgtccgcatcagggggtcctgggatattgagtagccgatccatcatcagtgtggatgagatctcctcgcttcattggattttatcggcaaagaataagccgattggcgtctatcccattccaaactgtctagcatgggcaccaaacttgtatgtttcttccttgatggatgccgacaggaaggatgcatggactaatagcagccgagaagacttatctggacttgtcaaatttttcggaattgatatcctcaaatctgaagtctgctgggatacccaaatttacttaatcttcgtatgggaaccaaactcgagcatctctctggaagccttcataaaagctacagaaccaatccttgagcaattcagccgataactttgctccagcatcggctggtgtggatgcatattccccataggacatacacctgcggtgggtgcgctcttctccatcatcattggtaatcggctttaatcttggaaactcagcttctgtcatagctggccgattgacagctttcatggctaccaggtttagccaggtttgcagcaaccaccatggcccgcctacactaacagctgagcagacaacaattttagccgatgcattgttcagcatttgatacaagtagccgaggaggatcttgcctaaaggaaattgcctctttgattctaaggcttcagctaaaaactgccagttggttgtggggccgcaacttgatccacaaaaaaggaatttctcaagccacatcagcagaaaggccacttgttctcgggaggtggcagttcctttgcccatatatgctgctacataatcagaccagccacatatgctcttagttctgaagtcaaactggttcttggtgttcaagctcatgaggttagccgacgaggtcatatccaaaccgatgatcatggtgatgccaagcaaaatggggttcatcggcccttggttgaacaggaaagcattaatggtgttggaccaaaaataggtggcagcggccatcaggggttcatctttagctgaatttgctatggtaaggccaagtgcctggccgatgccgatttcgtcccaattgccctgcttgctacccgataccagtttatgccacacagaccaacttttctccgtagtggttttctcaagagaaggccaagacataaaggtgtttttccagtgacctagatttgggttggccaatctaaaagggatcctattggtttcagcgatgatgaactcggtgggatcaagattgccgatcggaccaaggaaataatggtgctcatgtgacagactcgggatcgtgtccagattggacaagtgctacagatgtaaacaagaatagagaagaagaaaataagatgaggcaaggaagaaccaatctattgcgaaagaagaggatctagccgatgggtacttaactctgcgtatttttccgatggcgcgacggatggactggcggaggacgacatctttgcgagcggatgcttggccggagaggaaatcatcttagggtcgtctggtgcacccaggggatcgccggagagagagaggacgaagttggcttaagcggtgaaaaaggagctaatggtgtgaaatttctcggggacgacggttagtatttaaagcagcgcgataacggtcggaaaaacggaagtgcgatattctctcggagatgagatatggcaaatccgaaacattaccaaatattccggacttggggtcatgtgttaacgaccaaatttggtaatccaagtatcagagatgaagataggatcgaagcggaattcaagatagaaattaatctagaaacagagtgaggatcggctaaagttcgaatcggctatgacaaggatcggcagaattcgagtcggactaggttggctgattcagccgataccgacaatgtgacgtggtacatgttgtcgggttgagttaatatgcttcatgaggattgccgtgcatggattgaatcctgagaaggcaattgtatctattaattaggatatttcatgtaatttccttagagatatgttcgggcaaaagtctgccgaaaaggattatggtatctttgtcgacgggtggcacccgtagaccggatatagacggtattggggtatgttggtac

SEQ ID NO: 11312 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnnnaagccttacccactagacatgtggaagtacggtagtgctttgcaacaggggcccgaagaccggtccttatgtggccgaggtgctactaacaaaaccatgcaccccgagcccagcctaaaaccattttgagggttttgaatagagggggaggtgtgcatccaattccacaataatccaaccattccatagtgtccaagtgatatgaatattcccaaagtctagagttataaaaccacctaatgttgcctagttaatcagcgaagcatctacctaaattcatactagtggaaccatgaatagagtacccactagttggggttttatttattctagggtgaacaaggtaataataacaatagcaataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgagaaccttccggaacgacagaagctacgcgaagcacacaagcaaagctaaaccctataaagaagcaattacaatacataaaaagaaagcacacggttctttagggtataacaaacatta

SEQ ID NO: 11313 - DNA, 1412 bp, Oryza sativa
taaaacaagtggaagcgctagcctggaaaagacaggaaggctgcgctgttgacatgcggaccccacatgtcaacctaagggaccacggcagaccgggtacacagagacggtccacgggtcgacggaagcggatcccgtgtgtcaaccgaggcgagtgaccgacaaacggactccactagacaccacacgggttgcacacgtggaaatcacgcggctaccgagcgggcacactaacacggtcaccacacgcacaagcgaacgactaccgacaccggtacacgggtaccggggtcgacaaccgcacaacgggtacggggcgacaccgaaaggacgaggacggggaagcgagaagacggatccttaccaccacgcgacgaggcgtgggaacgacaacgatgaacgggcgcggcgaagacagctcggggacgacggaggcgaacggcgagggaacgacttcagcggcgatccttggacgaaggcgagacgcggctggcacaaggcttgatgacgcggagccgaggacgaagacgaggacggggctgccgcggcttgcttgacggatgcggacgacggacgagaacggctcgacggagggacgaacgccacgacgaccgggaacgacgagaggacgacgacgacgacgaccggggaacgatgccacggtgtcgaaggaggagacggcggcgtcgatcggcgcaccggcgacgccactggacgccggcgggaacgtaactccgggggtctccgcgggaaacggagggcaagccggggaaggggaggtgactgcgatgccgggagaggcgacggcacggccggacggtgcgcgggtgaggtggcacaggcggctggaggcggccggcggcgtgggagagagaggagggcggcggggagaggtggtgaggccacgggagaacgcgggagggggctaaaactggagaacggatcgagggggttccattttatagcggaagggagggagccggccacgggagagacggggaacggcggcggaattcgtggtcggcggccatggaaggtgaccggggttggcgcgggcgttcccgacgattgggggcacgaatcaagggggaaattggggggaattgaccaggaaggaaaggggattaattccccctaatcaatttggaaagagccggctcgaatggggtggatttgcaggaggaacggcgctaggttttgcacgggagagagaagaggccgtgcgggaggaaggagatgaccgggtgttgggacccacgcggtcgcgcggtcagcgcgcgtgacgggcgcgtgcggcgcggcctgggaaggctcggctgggccgggacacggcccaggtgggaggggaagagcagggagctgggccgagggggaaggggaggcccaagagaaggagggagaggaggagaggg

SEQ ID NO: 11314 - DNA, 2099 bp, Oryza sativa
agtttttggtcgtgatgacatagtggactacagtaccatcattgtacagcgggtgctcagcacgcaggtacagcagcatgacaggttgcaacgccataatttgttttagatttttttcgtcatcaacaactgtcgtgcacgtgtgatcattgatggatgtagctgcaacaacttggtgagttctgatttggtcaataagcttggcttgactacatgtacacatccacatccttaccatattcagtggttaaacgattccggaagagcaaaggtaacacaggtttgtagggtttcgttttccattggctcatatgcagattctgttgattgcgatgtggttcctatgcaagcttgttcacttttgctggggcgtccttgggaacatgataatgatgctacacatcatggtaggagtaataaatacacttttatgcataatgggaagaaaattactttgctacctttgacccctgctgaaattgtagaagctgataaagaacgagctgctagtttgaaagttgatgaatctgaaaatcagcaagtggctaaatctgtttttccacctaaaaaggataagctttcacctagttctaaggttgagggaattaagttgaagggtggtgttatgcttgcaacgaaatgtgacattggtgatatttcaaatgatgatatgtgctatttcttgatatgcaaacaagccttggtttctttagatgatattgctagttcgatacctcctgttgttactaaccttttgcaggagtatgaagatgtcttttcagctgagatacccccaggattcccacccatgagagggatagagcatcaaattgatttgattccaggagcatcattgccaaaccgtgctgcttatcgaaccaacccagatgagactaaggaaattcagtggcaagttcaagacctttaggaccgcgggtatgtacgtcaaagccttagtccctgtccagttcctgtaattttggttcctaagaaagatggttcttggcgaatgtgtgttgattgtagagccattaataatattactatccgatattgtcatcctattcctaggttagacgacatgcttgatgagttgtgtggctatattattttcacaaagattgacttgcgtagtggctatcaccaatttagaatgaaacttggagatgaatggaaaacagcttttaaaactaaattcggtttgtatgagtggttagtaatgccttttggtttgactaatgcacctagtactttcatgagcttaatgaatgaggttttaaggccttttattggacgatttgtggtagtgtactttgatgacatattgatttacagcaagtctttggatgaacacatggatcatttacgtgctgtttttaatgctctacgcgatgcacgtttgtttgctaaccttgaaaagtgcatcttttgcatggaacgagtctcttttcttggatatgttgttactccacagggaattgaggtggatgagtcgaaaattgaagccatcaggagttggtcggttccccaaaccatcacacaggtgaggagctttcttggtcttgcaggattctaccaccgtttcgtcaaagattttagtacttttgctgcaccattgaacgagttgacgaagaaaggcgtggtcttccattggggaaagacacaggagaagtcctttgacattttgaaggagaagcttacgcatgcacctttgctacaacttccaaactttggtaagacttttgagttagaatgtgatgctactggagttggcattggaggtgtgttgatgcaagatggtaagcctgttgcatactttagcgagaagttgcatggtcctattttgaattattccacatatgataaggaattgtatgctcttgtacgttccttagaaacgtggcgtcattatttttggcctaaagaatttgttattcactccgatcacgaatcgacttacaatatcttcgctctcaaaataatttgaatcgtagacatgcaaaatgggttgaatttattgaatcttttccttatgttatcaaacacaagaaagggaaagataatgtgattgcagatgctttgtttaggcgctatacttt

SEQ ID NO: 11315 - DNA, 4627 bp, Oryza sativa
ccttgagcatattgaatcccagtttataaaattattttgatttaaattaatgcattatcgctttatttaaattcccgcgttatcactgttttatttagccatgcctatttacctttgttatgaccttattattattgctattgttattataaccttgttcaccctagaataaacaaaaccccaactagtgggtactctattcatggttccactagtatgaatttaggtagatgcttcgctgattagttaggcaacattaggtggttttataactctcgactttgggaatactcatatcacttggacattatggaatggttggattattgtagaaatggacgcacacctccccctctattcaaaaccctcaaaatggttttaggctgggctcagggtgcatggttttgatagtagcaccttggccacataaggaccggtcttcgggcctctgttgcaaagcactaccgtacttccacatgtctagtgggtaaggcttagtttgtggctcagtctggttataaacaaaggtacatggatggagatggacgaagtcgagggtcgatggacatctctaggacaaatgaaggctacacgagctgcggcccggtagtcgaaatgtcatgtcacaaggctggtgtcttgctgctaggggctcagtcctgcctacctgtcctggaggttccggccgtaggtggggttgggtcggtacccttgtctatggctaggatgggttggaaactatgtgtcacatcctgatttttgtttcaggatttataaattatttaataaattattattagaatttatattaaatgttcattaatttacaagtgaagttaaatgtgggaaataaaattttctaaatataaagcatggatggatttaattttttttttaaattctccatggttaattatactctctggaatattctcggatttttcggagctcaattcctaatttttaatcttacaaagagcatttcagtaattacccacatattaaattgatcattaaatggtctaattataattttgttaagtactttgagtgtccaagtattttcaggatttttcttgaaattatttgagcattggaagtatttttaacgattcaaagatcatttcattgattaatttaattggaaaagtaataataatcctcctcctcagcttgggccattttcggcccattccttcctttccttcctctctctttcgccggcccaacctgagccggctcctctcctctcagccaagccggaaaagtctacttttcctccctgagctactgttcatcttccagctcaggcagatcccgagctagccgtgccgtgcacagtgccgccgtctcttccttctaaatctcgcctccccgttgctcctttttccaatttaggtgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccattaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgattcattatagtgcgccagactgtgaagcggcgagaagtccatgggggttgctggggagtccatgccttgtttataagggggtgattatgatccaggaaaggtgcgctgtaatggcttatgttgtgcaaggggtattgtcacaactcctttccgaggtaccgtggtggtattgaggcacatggtgacatgatgtggggttgtgtcttgtgggtacagtggtacacgtctggccagagtaaaactattcgaatagccgtgcccgcggttatgggcgggttgagcaatgtttttcttgattagtctcacacctctcacaataattatggatgttaatacttggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctctggtatccttgtgcacttgcatatttgctgtgtggcttgttgagtatgtcatatgctcattcttgcaataatcatcaaacctcagttgaagataaaggatccagaaggagaagacatttggcttataccccagttgagctgcctgtgggagtggagctgaagccatcgctagaccgttaattccgctgctgttttcttttctttttaagtatgtaacgttattattaagatggatttgtatattaaaattgtcagtttgtgtacctcggctgattcctggacgaggattttatgcacaaataagttcggaaattactagtgaatttccgggcgtgacactatgtcatgtcttacgtccgtatgccgtggtggtatgttgggacgtggttacacgtgaggaagacgtgtcttgtgggtaaagatgtacacctctgatcagagtataatctattcgaatagccacgccctcggttatgggcaagcctagcaatgtacccaagttagtgttttaattcttaaaattttcttaacaactaaaatgtggaatggttggccttgctgggggtgtcttcttctgtttgttcatcaagatagtctttgatatcgaaagagaacagatcggctaaggcctgcaagaagaaatttgaagacagttgattatcaaaatgagttattcagccgattcaagattttcatagacaagacttactgggatggcaggagcggctggttgttcttcttcctcaacatggtgacttcctatagccaatggagttcaatcacttgatgtttgttgtacaggaggtgaagatgggggaggaggctgtaaaaagacaaatgttaagtaaatatcagctatgattggattaatgaaaataattatacacaatagtctttctggtggagctggtttaagtgttgttgctgccaatttcttacagcagttttctttttctacaaagatgagatttataagtgatcggctgtgaatgaaatagttttaaaaggaaatcagagagagatgtttacccttgagaaatgagctggggcagaaggagttggaggagtttgtttggatgaagccgatggagttttttctgtgtcacttacttcggctgcggcttgatcaacatcttcttcaatctcttcttcacgcaaagcttgctcaatggatggtgtcgacgggggatacccgtagaccggatatagagagtattggggtacgccggtataaggatctacgtagtacgacatcgagcaatcaaaagacaagaattatactggttcaggccccttgacaggtaatagccctaatccagttg

SEQ ID NO: 11316 - DNA, 1241 bp, Oryza sativa
tatgggttataatttgattagcatgaaccttatatattggtttggttcagctaaatgctatatgtatgtttgcttagccatgcttagaaacattagctaattaaaggggattaaatataaattatattatattattcttattaattatggttatatttaatggtagctcacgatgataattaaaacctggttaaggtgggttgtgagcatatggttttgatggttgtgctcatggtaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatttgcctctggttttgagggggagattatgatccaggaacggtgcactgttttgagttgtgttgtgcaaagagtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacactactcatccatgttaataatgtgataattaatttgactcctggtttggaatgaataattcatggtttggaggtttgatctgtacgaccggggttggttgttcaggtttggttgggcctaagcagcatgggtgtgctgtttagtgttgattaaaattgatgattaactactctactgttttacttatcttaaatctttgctaaatgctgcttttgcaaatgagactatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccattgctagaccgttaattccgctgctgttttcttttctttttaagtatgtaacgttattattaagatggatttgtatattaaaattgtcagtttgtgtacctcggctgattcctggacgaggattttatgcacaaataagttcggaaattactagtgaatttccgggcgtgacactatgtcatgtcttacgtc

SEQ ID NO: 11317 - DNA, 1194 bp, Oryza sativa
acgccggtataaggatctacgtagtacgacatcgagcaatcaaaagacaagaattatactgggtcaggccccttgacaggtaatagccctaatccagttgatatgggattatatggtggaaaacacagattacaaaggaaaagacttaactcgggagattcgacgagatcgtagtcgagatgatccgactagctctcgtcgacttggctctttgtaggctctgacttcgtaggctgtgttggttgtctaggctttgagattcgatgagctatggctccgcggggggtcccttttataccgtaggttgggcgatatctgagtaggactcggatgtaccaaacctggtacgatacgtaggtaacccaattcttgttcgagaaggtttctccttgtttgttgtctttacgaagaatttccttaagtgctagaggatttatccatatacacgtggatataccttgtcgatacgtgacgtatatcgtagggtgaagggtatgcctaacccgtaaccctgacagtagcccccgacttctgctcaaaaatgaactcgtgagaccgtttgcgactccaggtgtcgagaacgttgccattccaggtgcgagaaccaaggagatgacgtgtaatcgagcgcaccgtttgaagtccaacggtcacgaatgaattttgaactgaagtccaaaaaccaccatgcacaacggacatagaaatctccggcggggatttctcctatttccttggaattcgcaccgtcgggagtgcgtctatttaaaggtatttagggcgtgagctttgaggtccgcctacttcattaagtatacactgctcctttgcattcctcgccttcctcgccgccgcaaaaagccctagcctcaccgattcatcgtccgtttccggcgatcttccggcgatctcccgacggccatggatcttgggaagtcgacctccaccgccgcgaccctgaagaaacttcaggaggagggtggcctccctggccacgacaaggcagagagggaagcaggaggtactactccccagcccgtcctaggtcgcatggttgcgattgaggattacattgtctgcgggtttcttcctcccccctctgaattccttttgctggtcttaaacttctatgggctttcacttttgcacttgaatcccaactccatcgcatttctcagcattttcgtgcatctt

SEQ ID NO: 11318 - DNA, 11328 bp, Oryza sativa
  unsure (1)..(11328): unsure at all n locations
nnnnnnnnnnnnnnnnnnnnnnnnnnnnnnnnnnnnnnnnnnnnnnnnnnnnnnnnnnnnnnnnnncgatctcccgacggccatggatcttgggaagtcgacctccaccgccgcgaccctgaagaaacttcaggaggagggtggcctccctggccacgacaaggcagagagggaagcaggaggtactactccccagcccgtcctaggtcgcatggttgcgattgaggattacattgtctgcgggtttcttcctcccccctctgaattccttttgctggtcttaaacttctatgggctttcacttttgcacttgaatcccaactccatcgcatttctcagcattttcgtgcatctttgtgaggcctacattggagtagagccttttctagatttgtttcgcttttattacgagttgcgttggatggaactcaacaaggtgtctggctgcgttgggttctgacttcgtgatgggatgaagtcgcaatacgtccccttccagtgcccctcttctcgcagcaaatggcagaacaggtggttttatctcgagattaaggactcgaatcctgccctcattgttcctgacgagcagccaaacaagattccggtttggaccgccaagccccctttgaccccctctctccaatcgtttatcgacatcatcgatgatcttcgagaacggggcttatcggggtatgaagtcgttgcagacttcgttggtaggagtatccagccgcttcaggctcgagcccacccggcgtataattattccaggccagatgacgcgacccgggtttctcctcggggtatgtttcttgtattcactttgatatggccgtattcgcgttcgcttttgacttatcggaaaatgattcttctttgatagctctgagcagtgacggcgtggagcgacgcgttggtcaggtgatgatcagcggcgcgacaaccgcgagcgacatccctgtgcccctttgtgaaaagggagaggcggaacgcgacgaggcgatcaatgtaagtctatttagatgtctttttcctccttcatttggaatcagcttgtgatcggacttagcgtaggcccttcccttgactgacgtcatcggaccgctcgcggatcaccaggtggcggcttctctgaaggagaaggtggtcgaggaggcatccgacgccgctgctggtagtggtggcaaggctccgagtaagccaaggaagttctcgtccgtgctcggacaccgtcgcaaggcagagacttcgacggtaacattcgccttgtcgttaagctgagcaactaggaaagttcttgttctcactggcgactttgcaggtttccgacgcatcccctcctcttgcagtcgtcaacgccttgtgacgatcggcgagaagtaagtcgcgaaacttctcagattcttaagtcttctttttgaaccgaactctgatccatcggtgttgacagggaggcacgagcgaaagcggctcgggccaagtctggggggacttctagcgcgtcccctgtaacagcgtcgactgacgtcgctcccgtgatcgggactcgggaggcgacgccaagcgggcccagcggcgaccccgtcagaaaccgtggcgcgccagagtccatcctcacctgggaggagctccaagtcgagatggggcgccttctcgaagccggcgctcgcggcattggtcgcgaggtcacggaggcgagggcggagacagcggcggctaacgcgcgcgcggagcggctgttgcgggagctggccgaagcccgcgaggacctcgtgaaaatgagggaactagtggccggcaacgagtgccaacgcaagggactcgagaaccgcatggcggaactcggagataacctctccgagatccgtggttctctgagggtcacatacaccggcctccaccagcttgccgcggagtgtggggtcaagtcgacgatccccaagaaccccgacgagttctccctcacctcttctctagcggagctggcgacggcgatgggagaaatccctgcgaagcaggcggcctgagttgcggaggagacgtccaacggtatttataccggggcgtgtcacgtcctcgcgtccgtgcggttgtcgcgtcctgaactagatctccgcgagatcctggatcagggggcggcaagcgacgcacgtaagggggtgatggaggaagtcggtgatctgggggagtctgtcctccccctcttcgaagagtaggagcacttgtatttttatttccttctcatgatttgtgaaccccaaactttggttgtcttcatgtatattactaccagctctgttcatctttgatcttgaaaattcatcttatcgattgtagagatgtcgatgatgaggatgtccggcagcgcgggcaacctgaatcgatggcgataaccccggtactcgagttagaaccgagcgcggcgcatatcgtcgatggccaggttgctgatgcagagaccgaagtggcggcaactgacccgagtgagtgatcttgtgcgccttgtcgctttttgttggtttccaagctgtggtaatgaccatcatttttggcagatctcgaggatgcctttgcgactcaagatcgtcgtatccaatactggaagacgaaatgtgaagtggcggaactcgagagggcgatgctagccatgaaaaaggaccaagctgtggaaacactccgaggtcgagaggtgtggttctcctcttatctgaagaattgctgcacctcgatggcgagggtgtgccgagatcttcgggtagcccgcggtgatcctgaagagtcggcggccgggtacatctcgtggctcaatggagcctgcgctcaactcgacggcattggtcagcggatcgacgaggccctgaagcaagagtgtcgtcgagcgagtcgatatgccggggggcatgtgttggcctgtgtgcgagatcaccgcccgcgcctggatctcgaatttcttcgtgagggttttggccgttctcggagaaatccggcagagattgaccatctcgcgagatcaatgtcgccgctggccgagaagattttcgttggccttcttggtagaatttgtaccctgtaacaagatatcttgggaaaagacgtaatttgacataatatttatgtgctaactgtaaggaatattttgtgaataaagaaatatatctttaacaaatgtttcttactctgggtgttgtttgtaagagcgtgttctcagttaacgaccttagttagccgtttgagttgtacactctccctagcccccagccttgtcgtcggagggatgtcctcgggtgacaaggctcttggactcctggcctgtcttggttgaaatagctctgatcctagcccccagccgtgaggttggaaaagtcaatttccgattacacggcttggttaatacgcacggcgagaactcttacacgaccaggtcttacatggtctttcgtctctgaaggatctgacaaggccttatcggctctgggcatccccagccgaagatgtcacgcccggaaattcactagtaatttccgaacttatttgtgcataaaatcctcgtccaggaatcagccgaggtacacaaactgacaattttaatatacaaatccatcttaataataacgttacatacttacaaagaaaagaaaacagcagcggaattaacggtctagcgatggcttcagctccactcccacaggcagctcaactggggtataagccaaatgtcttctccttctggatcctttatcttcaactgaggtttgatgattattgcaagaatgagcatatgacatactcaacaagccacatagcaaatatgcaagtgcacaaggataccaaaggatggcataatataggctcatttgcaaaagcagcatttagcaaaacttttaagagaagtaaaacagtggagtagttaatcagaaattttaatcaacactgaacagcacacccatgctgcacaggcccaaccatcctgaacaaccatacccggctgtacagatctaactccaaaccaggagctaagcaaattattaccagttataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccgcttcacagtctggcacactataatgaaccatgctatacaaaaggtaaagccgttgcccatgctggcttgtggttggcacggtaaatgtttcacaacagtagctcgcgaaccggtccttaattgtcatgagcacaaccatcaaaaccatatgctcacaacccaccttaaccagattttaattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcaaattataacccataggaaaataagatcatcttcggccattaattaatggggaaaggttcaccacccgatgacattaaaaaataatgcatagttgaaataaaataatagctttaaacgggtttaacatgctcaaagggttgtttgggatctgtgtgatttgccttgggcttccgcaaacgcttcggaaccttcctcaacggaaacgctctcctctggaacgtcggaaactaaagcgaaagaataaaaatcaataaaacagtaaaaaaaacaagcataaacagtacatgtgaatatttttaacatgtagatcttgattttagaaaaatttagcaacttgaaccacctgaaacagagttacggttaattagttatgattttccgaagatttaatctattagaaaaacgggaaaaagagaaaccgatgatgtcacgatgacatcatcaaaggtggccggcttcggatgacaagctcgccggagttagagcagccggctgcggatttggaggacacagacacatagagggcgacgagacgaacccaacggtactcaccctcgaaccaaacgacgaacgatgacggccggcgacgaagaggcgacggcggcggctcggcttgcacggggcggcggagctccggtgaccggcaacggaaaaggaagggtggccgagcttcccctcaccacggcgtacccaacggtggtgacggcgaccggcgacgacgatggaggcggcggcgcggcggcaccggagatggccggcggcggcggtttgcttggcggcggtggcgacggagctacggagcacgggaaggctcgggaacaggggcaaacgaaagaggaggactagggggtcctatttatagccttggattgaagagatcggactcctcccgcaagaaatcggctcgggaaaaacaaaactcggtttgggagataaactcgaaaacgagttcgattcggacaagatactcaacgaatagctccgattcttgaggggaaagatagaggaggatgtggggataaaaacccctcaactaatcggactcgagggcgaccggaagaggcgaaattggcggagagaggcggcagctcgggctcggctaggcggccggccggctggaggttagggatgaccccgacaggtgggccccacatgtcggtggctagaggaggagggggcggggcggctcggctgggccgacttgggccggcttggccgcgcgcgggaagagaagagttgggccggaaacggcccaacaactttagggaggggttttggaactttttaattaaaataaatggtgaaatgttgtttcaattattaaaaatacttcccttgctcaaacaattcccagaaaattctagaaaatagaggaacaagcaaagtatttaataaaattttatctagcccaattttatattgagatttagcaaattaaacttagatcttctcttttaagcttttaaaatcatttctaataattccttttaaacaacaatttataatttaaggattttaaacgataaaagcacttaacaattataattagatcattattgatcaaataattactgaactgttctttgtatcatttaggaattgagctccgaaaaatccgagaaaattccagagagtataattaaccatggagaatttaatgaaaattaaatccatccatgctttatatttaggaaattttatttcctacatttaacttcacttgtaaattaatgaacatttaatataaattctaataataatttattaaataatttataaatcctgaaataaaaatcaggatgtgacagaagatcccttgggttcctcggaggccttgtcgagacggcgtaaagggacagtaggataggtttcaacgctaggcgttgtcagagtgaggggttgtcgggtgaagatactttagttgttatatgtgaacaaaaaagtagtctttattgccttacaggtacaatggtattgactcatacatagaatttacgtagttggtcaacattccatgaatttgctaattcgcgaccgtcgcccgtctgcgattttgtatgcgcctggccgcaaggcttgtgtgatcgtgtagggttcttcccatttcagtgagagtttgtttcgacctgcctgggtctgaactcgtcggaggacgtagtcgccaattgaatgtatgcgtgctcggatgcgcttctcgtgataacggcggagggcctgttggtagcttgctgctcatacggcaactcgctcacgatgctcctcgagaaggtttacatcgatgtctcgctattcatcctggttctcgtcggaatgcttctgtacttgagtactctgatgtcgtagctcaccggggagcatggcttcagaaccgtatacgaggaagaagggtgtttccttattggacgttgtcggtgtggtgcgtatggcccatagtactgatgggagctcttcaacccatttcttgtcatgtgacatgagtctctcgtagacgcgggtttttatcccttgtagtactatgccgtttgccctttcgacttatccattgctttgagggtgagagaccgaggcgaaacatattttgactcctaagccgatgcagtaatcttggaaatcggcgctgatgaattgggagccgttgtcggttatgatgcggtgcggtagtccgtatctgcaaaatatccctctgatgaacttgatggcgttatcggccttgatttctttggttggtgatgcttcgatccatttggtgaacttgtcgattgctacaaacaggaatttgtagccgccctgtcctcgtgggaatggcccaagtatatctagcccccagcacgagaacggccaagtcagagggatagtttgaagcgcttgtgcaggtagctttgtgtgtttgctgtggaattgacaggcttcacatcgctggaccatgttgcatgcatctttaagggccgttggccagaaaaacccttggcgaaaggctttgccgaccaatgtccgaccggcggcgtgcgacccacatatgccttcatgtatgtcgaggaggagttgtctgccgttgtcggtagagacgcatttgagaagtatcctgtttggggcttttttgtataggtcgttgccgatcatacagtagatttttgctttacgggttattttctcggcctctgtatagtcttcgggtaactcctcgctgctaatgaatttgatcaatggggtacgctagtcatccgtggtttcgatgttagccacagcgcgttatgcctcggtgacctccgagctgatgtcgcgggtgctcgggccaacttcgccgctaacttcttttaccgacggttttgtcagtacgtcgagaaaggtaccaggttcgagcggttctcgtctggatgcacgtcgcgctaagtcgtctggctcgacattgtctttgcgatagacgtgtcggacttcgatcccatcgaacctcttctcaagcttcctgacttctgcaaggtacttggataactcggggttggaacacttgtagtctttgtgtacctggtttgcgacaagctcagagtcccctttgacgattagtcgcttggccccaagtgcggctgcagctcgtatcccggcgagtagtccttcgtattctgcagtgttgttggttgccctgaagttgaggtggattgcgtgtttgaattgatctccggatggagatgttaagataaatccagcccccgctccttggttattgagtgcgccatcgaacaccattgtccatgtctcattgtcgctttggttatctggcttgttatctggcatggtccaatcggccacgaagtcggcgagtacctaagacttaatggctgtttgcggcacgaagtggacatcaaattggcttaggtcgactacccatttcgcgatgcggccgacaacgtctttgtttctcacaacttcgccaagagggaaggaggaaacaattgtgaccctgtgggcttgaaagtagtgacgtagcttccttgatgtcatgataactgcgtagagcagtttttgaatctgtggatatcttgtctttgcgtcatggagagcttcgatgacgtaatagactggttgctgtactttctctcgctcgacgacaatgacagtgctaacggagtatggcgtagcagcaatataaagaaataattcttcattaggttggggagcaacgagtacaggagggtttgataggtagcacttgagtgcaataaatgcctcttcggcttcctgtgtccatacaaatatgtcttgttttttcaacaaggcgaaaaaaggctgtcctcgttctcccatcctagcgacgaatctgcttaacgccgccatgcatccggttagcttctgtacctccttgagtcttgtgggagacttcatgttctcgattgctttgatcttctcgggatctgcctctattcctctgccagaaacaaggaatccgagtagcttgcctgacggtactccgaacgcgcacttctctggattgagcatgagacgatatcgtcggaggttgtcgaacgtttcccggaggtcgtcgatcaatgaatcgcttgtcttggttatgacgacgatgtcgtcgacgtacgcctcgacattgttgccaagttgattgctgagtgtgccttggaccatgcgttggaaagtgttgccagctgttatcaatccgaagggcatcttgacgtagcaaaatactccgaacggggtgatgaacgttgttttctcctcgtcctccttggccatgctgatttggtggtagccagagtaagcgtcgaggaagcttaatagttcgcatccggctgttgaatccaccagttggtctatttgagggagagggaagtgatccttggggcacgccttgttgaggtctgtgaagtcgacgcacattctccatttaccattggctttccacaccataactggattggcaagccactctggatggagtacttccctgatgaagctagctttgagaagtttgtcgagctcttctcgtatggcttgttttcgatctgttgcaaatctccgcagtctttgcttgactggtttggcatcgggtcgcaccattagtttgtgctcaatcacctccctggtgacccccggcatgtcggacggttgccaagcgaacacgtcggcattgtcgcggaggaaggcgatgagcgcgagttcctatttctcatctagtgtagccccgattttgacagtcttgtcggggttagcactagagtgtggaacgatcttgatggcgccgtccggcttcggcgtcttgtttggcttgctcactttcttgggtggcttagacgtggcgggtggagtggacgtttgctcgaccatgtcgaggcttcgcttgtcacactgcaccgccagttttgcgttcccttgaatagtgattgtccccttcggccccggcatcttgagtacttgatatgcatagtgggatgcggccatgaacttcgcaagtgcagtcctcccgatgatggcgttgtaagctgtatcgaattcagtgacatcaaaggtgatttgctctattcggaagttgttggcttggccaaaggttacaggcaacgtaatcttgcccaaaggtctggatgatgattggggagtaatcccatggaaaggttgatcagtcggcgtcaactcactttttgggattcccattgcatccagagtgctagcaaaaaggaggttgatcgagctgcccccgtcaatgaggactcgtgctaccttgatgttccgaatagtgggttcgaccacaatcggataccgtcctgggataaccgcggtcttgggatggtctacttccgagaactccatcttctgctcggaccacttcatcttgggtgcagccccctgccatgtcgagcaaacttcgcgttccactttcttgtattctcgcttggaggagtacgtcgtggaaccgccgaagatgtgcgaaacatggaggtcggagtctgggtacgcggagttcgattcgtgaggaggcgactcctcgttcttctcgacaacgcgtactcgcttgcctttctcaaacgccatgtgcttctcgagcgactttttgaaaagaaggcaatcctccagagaatgtctatctgttttgtgtatgggacaccatgatttctttgtgtcgctgctttgtgggtccgggcgcttggaagggttcgcgtactctgctgcgaggacttccgcttgagctttccttttcccgtttttgcgatttttcttcttgctcgactcagatgtgtctgcggctgactttttctctcccccagtcttcggcttgtcgttcttgcgtcttagtgcgtcgtcgacgtgggcgcatctttcaacgatctcgaataaccttcgagtagttgtgatatgccttgttgccaactcttgggtagtgtagcgatctctgacgccagacttgaaggcgcgaattacagaagcgtcggtgatttcggggatggtattcctgcacttgttaaagcgccgaacgtattccctcaaagattcacctgagttctgtgttaacgcatgaagatcgtcctcgatcgcgtggcgcttgtatgttccttggaagttggcgacaaactgctgccacaggtctgcccacgaagaaattgagtagggagggatatg

SEQ ID NO: 11319 - DNA, 5088 bp, Oryza sativa
  unsure (1)..(5088): unsure at all n locations
gactttttctctccnccagtcttcggcttgtcgttcttgcgtcttagtgcgtcgtcgacgtgggcgcatctttcaacgatctcgaatacccttcgagtagttgtgatatgccttgttgccaactcttgggtagtgtagcgatctctgacgccagacttgaaggcgcgaattacagaagcgtcggtgatttcggggatggtattcctgcacttgttaaagcgccgaacgtattcctcaaagattcacctgagttctgtgttaacgcatgaagatcgtcctcgatcgcgtggcgcttgtatgttccttggaagttggcgacaaactgctgccacaggtctgcccacgaagaaattgagtagggagggatatgcatcagccacgaacgtgcagatcccttcaacgcggttggtaaatagtttgccaacgcgttgtcatctgctccagcggcataaagcactatcgagtagacttgaaggaattcttctgggtcggtgctcccatcatacttttcaatagctccgggtcgaaatctctcaggccatcggacatcacgtagggaacgaccgaaagccctacacccagcgctcggagtggtgggttgtcggtggtcgcgtgaccttcgtggatgtcggtctgacgatgaagaggacgcggaggatgatgatgatgacgatgggtcgcttggttccggcgtgcgattacgagggtgacgacctggatctcgggaatcttgtcttcgtctctcgttgttgtctcgacgccgatctcctccatcttcgtcgttacggcgacggccgtgactagtgttgtctggccctcgccgatcacgatcatcgtggtttcggttatcgtgtgggcgacttcctcgatcatggcgtagtgaggagacatggtgccgagagcggtttgcttcatcccgtgtgcgtcgtgcttctcggcgcccattgatttgatctcgaaggtcacccgtgccacgaggtggaggggtagctcgttgaggtgattctctatgttctggaatttcaccgttagcatcgccgatgggtgattggttttgttgtgccgcggtggcggcttcttcgaacgcgttgctgaggttagccaccgatgcccgtagtcgttccgtccaacgctcgaggtctttgttcaggacaggatcgtaaggtgtttccctcaatatggcttgaacagccctgatatgttgggctggggtggtcgattgatccgccgtctccgcgtttgcttgtgctgatgtgccaacgtcatcgatagccaacacctcccgcgccgcgtctgatgtcgatgacccataatcttcgaggagatgtaaaacagatggttcgtggggattaagattgattaccccaacgaaccgatctggggccagagtcgctccttgttccttgccgttatcccggactgggacgtatgacttatgagacggagttttcatggcgccaagtggaactttgcaactcgagaggtcgtgattctttgtcttatggatgggacaatagacgttccgagttggagaagtacgctggattccacgttctttgcaggcgcggatctcagcacgagcattgacgaatacccagcaatcttgaagagtatgtttcttggttttatgaataggacaccaagacctgatagtttcggaagtcatctttgctggcccgcggtttgtgtcggagggacaaggcctggtcgcatcagaatccttcacgaacttagatgtagtcggcaatccgttctccgtttcaacgggtggatctttcgacgtagaggcgtcttggtttgtaaccaccgcgttctcgtacccagtcattggacgactggttgagatcggcattgtggtgtaaaccgggcagacgatttcgccgacttgagtccataccagcattgtcgaggtgggaagaacttgaccggagttggtgttgacgttgttgtcgacgaagcttgatggcataatagtagaaccttgaataccaaggccccctacctggcgtgccactgtcgacgggggatacccgtagaccggatatagagggtattggggtacgccggtataaggatctacgtagtacgacatcgagcaatcaaaagacaagaattatactggttcaggccccttgacaggtaatagccctaatccatttgatatgggattatatggtggaaaacacagattacaaaggaaaagatggaactcgggagattcgacgagatcgtagtcgagatgatctgactagctctcgtcgacttggctctttgtaggctctgacttcgtaggctgtgttggttgtccgagctctgatattcgatgagctatggcctccccggggggtcccttttataccgtaggttgggcgatatctgagtaggactcggatgtaccaaacctggtacgatacgtaggtaacccaattcttgtccaagaaggtttgttgtctttacgaagaatttccttaagtgctagaggatttatccatatacacgtggatataccttgtcgatacgtgacgtatatcgtggggtgaagggtatgcctgacccgtaaccctgacagatggatctaaggtaggtaggtcatcggatggcttgggttttggcttcttagctttcttcttaggagctagggccgatggatcaattgccagtgtcttgatctttcttttcctgccaacatcggttggttctctcatttgccattgaagcagaggcctggaggggttaatccaccaccagttggcaagaggcctggagcatactctatatccctgccgctgttccttttgtggggaggagaagattctgttgtctgcaagacaaagaaaagtcagtcaagatctaagtcggctaacaattattcaagcgaaattaacaaagtaaaggtgtaccggagggataacatcagggaacagatctgtcatatacatggaagccgactgatggaatatgtgttgtttccattctccccaccatctatcgaagttcctgctcctgaactttgccagctctatgttttcaatgatgcccaaaggaggtcttgggatgttgagtagccgatccatcatcagggttgatgaaatatctcctcggcattggattttatcggcaaagaacatgccgattggtagctgtcccattccaaattgcctggctgagctcatcggatggtagaattcgttggacacttgtatatttcttccttggtggatgccaacacgaaggatgcatgggctgatcgcagctgagaagacttctctggatttctgatatctctcatgattgatatcttcaaatctaaagtccgatgggagatcaagattcaatgagtcttcataagggaaccaaacctgaggttctttctgaaagccttcataaaagctgcagaaccaatccttgagtagctcagccgataattttgctccagcatcggctggtgtggatgcatattctccataggacatacatttgcgatgggtgcgctcttctccatcatcatttgtagtcggctctaatcttgggaattcagcttctgtcacaggtggccggttgacagctttcatggctatcaggtttagtcaagtttgcgacaaccaccatggcccgcttgcactaataactgagccgatagcaatcttagccgatgcgttgttcagtgtttgatacaaatagccgaggaggatcttgcctaaaggaaattgcctctttgtttccagggcttcggctaaaaattgccagttggttgtggggccgcaacttgatccacaaaagagaaacttctcaagccacatcagaaggaaggcttcgagttctcaggaggtgacaaatccttttcccatatatgttgctacatagccggaccagccacctatgctcttagttctgaagtcgaactggttcttggtgtttaagctcatggggttagccgatgaggtcacgtccaaaccggtgatcatggtaatgtcaagtaaagtggggatcatcggcccttggttgaaaaggaaggcattgatggtattggaccagaaataggtggctgcggccatcaagggttcatccttagccaactttgctatggtgtgggcaagtgcctggctaattccaagttcgtcccagtgaacttgcttgctagccgacacacgcttataccacacggcccagcttttctcgagggaggttttctcaagagatggccaagatttgaatgtgtttttccagtggcccaggttagggttggctaatctaaaggggattctgttggtttcggcgatgatgaattcagtagggtcaagattgccaatcggaccgagaaaataatggttctcatgtgacagacttggaatcgctaccagattggacaaatgctacagatgtaaacaagaacagagaagaagaaaatgagataaggcaagagaaaactaatctgttgcgaaaggaaaggatctagccgatgggtacttacctccgcgtatttggctaatggcgcgacggacgggctggcggaggacgacatctctgtcaccacctgccatcttgtcgcgaccgagaaaattgccttttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtattcagcaagccacaccggcggatgcatgattaatgcaaggggtacaaggggtgataatatagggattaagttttgcagaaaacagcttttaaaagtcacttacttgcccaaagccattttaaaaagacgatcctagagctacacagtattattaatcaaggccgtgacccctcacgaacctgccttaacccaaggcctacgatgattcagaccgaactggcaacccgaccct

SEQ ID NO: 11320 - DNA, 1385 bp, Oryza sativa
  unsure (1)..(1385): unsure at all n locations
nnnnnnnnnnnnnnnnnnnnnnnnnnnnnnnnnnnnnnnnnnnnnnnnnnnnnnnnnnnnnnnnnnnctcggtctgcccatctgtctgcgggtggtatgcggtgctgaagtttaatcgggtacccagctcttctggaagcttcttccaaaagtgagaggtgaattggctgtccctatcggatacgattttcttgggaacgccatggagactcacgatccaagtgaaggtgagctcggctagtttgctccctcaatatgtggtcttcacaggaatgaatcgagctaccttggctaatcgatccaccactacccatatgaattcatacccaccttgggtcttttggagtaccgggaatgaaatccatccaatttcatcccatttccattcaggtacttggaggagttgtagaagtccggccggtcgttggtgctctgccttgacacgctggcacacatcacaaagggccgcgaactctgcaatttcccgcttcatactaactcaccagtatttctccttcaagtctaagtacatcttcatactgccagggtggatggaataaggactttcgtgagcttcctgaagtaacagctgtttaagttctctgttatctggaacgcatactcgatttccgttccatagggttccgtgttcatcctctgtgaaaccagcggctttaccctgtttcatattcttgaggagtccatgcatgtccggatcgttcttctgagcctcgcggatttgatcgagcaaggtaggcttggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattctgacgcgaccgagaaaattgccttttcccgaacgctagtgtattagtccccgtcccaggaaaagccggggtacaccacacaaacatgatataaaagacacatctttattatatcgataatatttacattattacaaaggcacttaaggcctgacaatcaaaaataaacagcagcggactagcgggcctacagctccatcttcacaggcgctcaactggggtataagccaggactccacctaggacttcatctccaaagcttctcttactgaaggggggaaagattgagcaagaatgagtacaaccacagtactcagcaagccacaccggcagatgcatgattaatgcaagggggtacaaggggtaataatataaagggtaggttttgcaagtaacagcatttaaaagtcacttagtttgcccaaagccaattttaaaaagacgatcctagagcttcac

SEQ ID NO: 11321 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnttcatcctctcttcttctctcagccaaagtccggttttgctccctcttctaatcaggctgagaaaagaaaagcccggcaagaagtctattatccttcccccgcgctactgttcatcttccagctccagccgccggctgtagctgagccgagccgccttgccgagtcgccttgccgcgccgtttcctccccaatctctccccttttcttccgattgtttgaggggattttatcctctcgttctcctctacctttcccctcaagaataggagcatttcgttgagtatcttatccgaatcgaactcgtttttgagtttatctccaaaaccgagtttttgatttcccggatcgatttcttgcgggaggagtccgatctcttcaatccaaggctataaataggagcccctagtcctcttctttcgtttgccccctctcccgtggtctcccgtgtcccgtagcctcgccgccaccaccgcctagctcaccggttgccgccggccatctccggcgaggtagcgcagccgtctccgtcgtcgtcgccgcttgccgctgccgcgtttaggtgcgccgtggtgaggggaagcccggccgcccgtcccctttcgtcgccggccaccggagctccatctccggcgaggtccgagccgccgccgccgttcatctcgtcgccggccgtcgtcgttcgtcgtttggt

SEQ ID NO: 11322 - DNA, 510 bp, Oryza sativa
gtcgtcgtggaggcgggggagacgcgtccgaggcctgaaaaacggtcgatgcgaagtaaggcgtaattcttctggctgtacgatctgacgacaggataacttaccaagggggttgacgccttgcgatgatgtccgcttacagaggagaacttcctcccctttgtcggaacattgccaccactagtggtagtagcagcagcatcagacgcctccttggcgaccttctctttcagagacgccgccacctgatggtccgcgagcggcccgatgatgtcagtcagaggaagagcctacgcttaatcaagtcacaatgtgatctcgaaaggaaaatgcaggatgcctatcgagaacacttacgttgatggcgtcatcatgttcggccgcccccttttcacaaaggggcacggggatgttactcgccgttgtcggaccactgatcatcacctggccgacacgacgttccacggcttcgctgttcagacctgcgaatcaagaaccaaatctcgataa

SEQ ID NO: 11323 - DNA, 647 bp, Oryza sativa
  unsure (1)..(647): unsure at all n locations
gaggggcggacgaggtcagccatggcttgtgatcacgatggcgaccttccggagtggcgacgacgactggagcgacggcgacgcacggctagaccaccggcgatgacgccggcgcacggctgcacggtgctagggctctaccggcaacgagaggcgaaggcgagggtgccggcgggtaccgaagggcttgggggtccttttataggggctagggggcggcggcgaagtcccacggcggccggcgacgagaaggaaagttttagggttcgggaggaaaggggaatccgaatcgagctcaaatccgatgatttccaaagcgatatagacgatgcttccaaaaggaaaaaggtagaggagatctcggggatcctttcccctcaatcaatttcatcggatcgggaaaggggcgacggaattggatgggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagagaggggggttttgggccgactttcggnnnnnnnnnnnnnnnnnnnnnnnnnnnnnnnnnnnnnnnnnnnnnnnnnnnnnnnnnn

SEQ ID NO: 11324 - DNA, 971 bp, Oryza sativa
  unsure (1)..(971): unsure at all n locations
tannnnnnnnnnnnnnnnnnnnnnnnnnnnnnnnnnnnnnnnnnnnnnnnnnnnnnnnnncgggaggagtccgatgtcttggatccaaggctataaataggagcccctagtcctcttctttcgtttgccccctctcccgtggtctcccgtgtcccgtagcctcgccgccaccaccgcctagctcaccggtgccgccggccatctccggcgaggtagcgcagccgtctccgtcgtcgtcgccgcttgccgctgccgcgtttaggtgcgccgtggtgaggggaagcccggccgcccgtcccctttcgtcgccggccaccggagctccatctccggcgaggtccgagccgccgccgccgttcatctcgtcgccggccgtcgtcgttcgtcgtttggttcgagggtgagtaccgttgggttcgtctcgtcgtcctctatgtgttcatgtcctccaaatccgcagccggtcgctctatctccggcgaggtcgtcatcttggttcggccgccattgatgatgtcatcatgacatcatcggtttttctttttcccgtttttctaatagattaaatcttctgaaaatcataactaaataactgtagatccgattcgagtggttcaagttgctaaatttttctaaaatcaagatctacatgttaaaaatattcacatgtactgtttatgcttgtttttgtactgttttgttgatttttattctttcgctttagtttccgacgttccggaggagagcgttttcgttgagcaaggttcggaagtgtttgcggaagctcaaggcaagtcacacagatcccaaataaccctttgagcatgttgaacccgtttaaagctattattttatttcaactatgcattattttttaatgtcatcgggtggtgagcctttccccgttaattaatggccgaagatgatcttattttcctatgggttataatttgggtaccgagctcgaattg

SEQ ID NO: 11325 - DNA, 5278 bp, Oryza sativa
ccgtcctcgtctccgtgcagccgctgccggcttccctcgtcgcctcctcgccggcccggtcgtcgtcgtcatcgtcgtcctctcgtcgtcctcatcgtcgtggcgttcgtccctccgtgcaagcctgcgcgttcgtcgtccgcattccgtcaactgagccgctgcagccccatcatcgtcttcgtcctcggctccgcgtcgtgaagcctcgtgccggccgcgtctcgacttcgtccaaggatcgccaccgaagtcgttccctcgccgttcgcctccgtcgtccccgagccgactccgccgtgctcgttcgttgtcgtcgtgccgcgcctcgtcgcgtggtggtaaggatctctcctctcgctgccccgtcctcatcctttcggtgttgccccgtacccgttgtgtggttgtcgaccccggtacccatgtaccggtgtcggtagtcgttcgcttgtgcgtgtggtgaccgtgttagtgtgcccgctcggtagccgcgtggtttcacgtgtgcagcccgcgtggtgtctagtggagtccgcttgtcggccactcgcctcggttgacacacggggtccgcttccgtcaacccgtggaccgtgtctatgtactcggcctaccgcggtcctttaggttgacatgtggggtccgcatgtcaacagcgcagccttcctgtcttttccaggctagtgcttccacatgttttatagttgcaaagcttaattataataatccgcaaatctccatataacagcattaaacttcggatgatcgtatcttggtcatacgaactctgaatcgacccgttcaagtctcctaatgtttgttataacctaaagaaccctgtgctttctttttatgtattgttattacttctttatagggtttagctttgcttgtgtgcttcgcgtagcttctgtcgttccggaggttctcgaagcgtggttcgcggtcgtcgccgaaggttcagcaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgacattattattgctattgttattattaccttgttcaccctagaataaataaaaccccaactagtgggtactctattcatggttccactagtatgaatttaggtagatgcttcgctgattaattaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgttagtagcacctcggccacataaggaccggtcttcgggcccctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagttgcggcccggtagtcgagatgtcatggcacagggctggtgtcctgctgctaggggctcaattttgcctgcctgtccgggggttccggccgtaggtgggttgggtcggtactcttgtctatggctaggatgggttggaaactatgtcgcgtcttccgtccgtatgccgtggtggtatgtggcacgtggttacacgtgaggaagacgtgtcttgtgggtaaagatgtacacctctgatcagagtataatctattcgaatagccgtgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcatgtgggtccacggccttgattaataatattatatagctctaggatcgtgtttacaaaatactttgggcaactaagtgacttttaaatgctgtttactgcataacttaacccctagattattatccccttgtactcccttgcattaattatgcatctccagtgtggcttgctgagtactgtggttgtactcattcttgctcaatctttccccccttcagtaagagaagctttgcagaagaagtcttaggtggagtcctggcttatacccccagttatgcgcctgtgaagatggagccgtaggcccgctagtccgctgctgtttatttttgattgtcaggcctgaagtgcctttgtaataatgcaaatattatcgatataataaagatgtgccttttgtatcatgtttgtttggtgtaccccggcttttcctgggacggggattaatacactagcgttcgagaaaagacaattttctcggtcgcgacacgtcgtgcgcagagtgtatgtgcttgccttgctcttgccctgatggtcgcgcccctgtaattccttctctgcaagcatagcaaatcgaaacaactggttgacagagttaaattccttataatcaacaatgttctgaatttcctccctcaaactagtgtagaaacgacaaatagcatcctcgaccccctccactataccacagcgtctcacacccttctgtagctcaccatagtaatcctgtacagatttatccccttgttccaaacgcatcagtttcttacgtaaatctctatgataagatggaggaacaaacctatcgcgcatagctaccttaagttcttcccaagtagtaggtagtaccccctcatcagataacccagcccaccacataatagcaaaatccttgaactcactactggctcgtctaactctatgttgctcgggtacaaggtggacattaaacttttgttctactgtcatctcccaatcaaggtattttttagcatcatcatatcccaaaaaagatggtattttaaacttaaccttagcataaggatcatcgggcacacgatcattattattaccttgttggtggcgagtgccacccatacctgtgcggtttgtgcgtagacgacgtcgtagccatgcttgccttgtagccggtgcgtcaatatagccactggaatcatacaccgtgtcttcaggatgagcatcgtcgtcaccactcaccacttcctcattggaaggtgtctccaacacggcgacccgatcagttagagtggatatccgcttgtccaacctctccatgtggtttaggaagccgattttagtgaaggcatcttggacagactttgcaacagcctccgtgatgtccttttgagtattttgttggagagttcgtagttgctcttggctgacacagtcagcaaaatcctggggactcttctcgccttcgttacctgacattgaaacaccaaaacagaaacaaaacggtgaaggttatccctaataatctactacgcaggtgtagtggtgcctctcaacgattctcagcaatatggagttcctaaccatggtcttataaggttcttaccagcaaagcaaaggatacctggaaggcgtagtcagcaattgcagtgatcaagaacctgtgctgttcagaagtaatatgtggagctaggaaggccaaaaatatgtttatgagtggtacacaatccaatgacagatagtaatgctgaataaaaatcccaagtcacttgcccttagttgctggtctactcgtgtcctagacagtagtgataacaaagatggctcaaagaatatgacactagtaaacagcaaagaaggactgacaggcaagcttcagcgagtttcagcaaaaactacaaaaccgaactggcagataagctcaacggagcgcgtcgtgagctcaaagcactagtggaaatcaacttttcttttttttcttttatttttttgatattttttttctttttttagaacacaaaaataggcacacctccaagttaaagctcaattggagtaggtatgtggcctatggatttttctgaaaccactataaacaaggtgcaggaacttgtgagctcgaacagacaattttgcaagccaatttttggaattttggattcgccaaaccagccaaaggcggggataaacggatataaaattttttctcttatccgaaaagttaaatttttcctgattccgagtccgtatgcaaaagttatggctgtttgaagtttcggcttccggctaggttttccagaggggatataacctagtctattttgcggtggaattgggatatggtggcagcggagttgtagggtgttctggagatgcttggttatctggatgggtgtttatgatggcggaaacggctctcaaaggatgaagcctaacacacggtgaaaggtagcggctagggttacaaaggacaaacacatgactagactaaaacacacactagaccagcaacatgaacttaaactaggactcaaactcaacactacggactctgagagagaatcatgcaaaggctaaacacggtctaggttaaggtaactaacaactaatttttttttggcttttctgtagactctaggataattgcgaaaaaaaaaactaatcaagggcaaagaaactgagcgaacctgacggtgaacctagagctctgataccacttgatgtgcactagggttcccgatcttccgaaaggttctgataaacaacgatttgggcggagtcgcgacacaaatcgatccggcttcttgaacgcgcacgttcttgagccccgcaatcgcagcaccacgtctcctcaggttatcacccgtgtcaaaatacggatgacctcgccgagaaggctaatccctgtttgccaatcgaagaacacaaacaagaacaagatagaaaaacaaccaaaattgcagatgaatgattaagctcacgagttggggtcttacaaaccaatctagcggcgaaactgttcttgacagattaatctaagcaaaacccaaaaacctaaagatgacggcgggtactgatatatatagtttagggtcgtgcaaacccctctcgacgcaaccctaatgggttccaatacgatacacgggccaaaggcccaaatacggtgacgcagcaccgggacagattctggacgttaagttgttcggtcaattcccgttgactcagaaagaatttggacgtgggaccaaaaccattggaaaggttat

SEQ ID NO: 11326 - DNA, 2033 bp, Oryza sativa
cccttcattgtccccctatattctcgaattcatacaaagaagaacataggaacgaactcacctctaaatttaattgtcgcgcacgagctcttgttatcggtccttgaatgaccgttggaggattgttgtgtgtatccgaagtagtgatgtccgcatcagtatatacggctgctaattaaaaaaagaaatattcactgctacaacaaaaatgtaaggtactccttattatgcaccgctaatacacaaaaaactagtatatagtactgctcatcgcttcaaagagtatatatactgcggcttaaaaaacagtatatactgttgcatactagaaaaggtggggatatctaaggtacgttatcaaatttgaaagcaaatgcatgccaacgatcttgttcaaatttgcacccaatccggtgtgcagctatgccacatgcatgcagtcatttggaaattaatattattaatttttttcacagctaaattgaatgctaatggatcatccattaataaaagggtgtacatacacctgggtgtatgaaagagccgtcctatatatatatatatatatatatatatatatatatatatattatcacctatcatgcgtctctaatggcgttatataaagaatgcttatcttttcgtcattaatctagtgatgatccttctgtcgtcatacagtctatgacgtccattttcgtcaccatcaagcccagaaatcatgataagatgccatgtggcctgttaaggcccatgtagtcagggccggctcgggggggggggagcgggatggccgctctaggcgcccacccacacaccttgtcaggtcccaaaattaaagattcggtaatcgacatgtttaaactgtatcaagccctggatcagtagattgatacaggtttaacaatctgaatcttcatagcatacatttgatcaaggctccaaaggagatttctttacataaaataatagggtatttacaagattgtggctatctattactgtagaagctataggatgagccaactctaatgtttaaactctatagaattaaaccatctatctaatctatacttgggaactaagttggaatgaaactaatttatatgtttaaactcacggtttcagcaaaaactccaaattgattctcaaagagagggttaaagcaaggctgagtacaacatacttatcaagctattatatcaagtaatgaatgcatgaaatagtaatttctatgtagggtttaggacctaccctaaaccctatacaaaaaggtccattggcattaggtgaattgcatttaggtccataggcccacttggcatacaaagcaattttacaaaaagaaccttacaagatttaaatttctagtaatgaaagaccttacgcctaatgaagtggctaaatagccggggcccacatgtcggtgacttggttgctggggagcagaggcaataggagggcaacggcgaccgatggcgttcgcggcggcgtattggcttgatcatattttggcgtctttctcctgggacctaggcgacgtcggtggcgcaatggctcagccagggatggttcgagtcgatgggaacgacgaagtggggcgatggcggcgctctggacaccgggaacgctgacgagcataccaccaagtgttcgatctatgccaaaatagaaacaaagaaaatggattgattaggtagagaaggaacttcatgttcccgtggttggagtgcggtgaagctcaccagagaatacgtgacatggatgaaactccttcgggtgaaaagagtaagtggaagttcttggagattccgaggtagtttttggtggtttgcatagtggaacactatgagaaatagatgaggttcacagtggcgagttggcttgattaatcactactacagggacccttttagattccgtgcaggcagcaactcgtcgcttttgaaaaatcagctcattttcacgtgcggtccttttaagaggacagcacggaaaaatcgatgtttccgtgcagttctcttaaatggacc

SEQ ID NO: 11327 - DNA, 385 bp, Oryza sativa
  unsure (1)..(385): unsure at all n locations
nnnnnnnnnnnnnnnnnnnnnnnnnnnnnnnnnnntgatatgctgatcgaagatctattttagaaaatacacttgctccttttaattgatcaaatagatcatcgattcttggtaagggatatttgtttttaatagctacttcatttaaagcccggtagtctacacacattcttaaacttccatctttcttctttacgaataatacaagagctccccaagctgaagaacttggtcgaataaagcctttttcttgcagcttagctatctgtttcttcaattcttccaattcattaattggcatcctatagggtctttttgatatannnnnnnnnnnnnnnnnnnnnnnnnnnnnnnnnnnnnnnnnnnnnnnnnnnnnnnnnnnnnn

SEQ ID NO: 11328 - DNA, 1026 bp, Oryza sativa
caagatctatccggaactcaatctctcgcttgggcggcataccgggtagttctttcggaaacacgtctccgaactctctgacgatggggatttctgacagtcctatctgatgaagttctgaacttctgacagaggttgggggtgcaaagaaaacaatcggttgttccggccctcggtacagggtgacagtgcgtctcgcgcaatccactactccttggaattgagccaaccaattcatcccaaggatcacatccaagttcttggtgtctagcagaatcaaatccgagggaaaaggaatcccctgaatttctatagggacggcaggactataatactttgctgtcataacccctccaggggtggtgatgagcagagggttcctaagcctttctatccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacccgaccccgaatgacatccttcccaccgttgttggagcggggaggcgcttggccttgctgacgcctcggctttgggcatttatccgcaaagtgcccgggctcgaagcagttgaagcacagacgctgcggacctgaagcgtccctgcggacttggccaggctgcacagttggcgtaggaggacgaggcgcacgagtcccttgctgactctgctgttgctgcggctgtgggacgcgcaccacgaattgaggtcgaggcgcggagcgaggttgctgctgttgttgctgctgctgcgaggaggatccccctggatagggattggtgtagcggaccctttggttagcaccctgttggttgcggaaatttgccaagcggggcttgtgcgactcagttccttgtgcttggcttccaagcggatgctcttgtccaccagacgtaggaaatccgatagtccccggagactagaccgacggacagctca

SEQ ID NO: 11329 - DNA, 936 bp, Oryza sativa
  unsure (1)..(936): unsure at all n locations
nnnnnnnnnnnnnnnnnnnnnnnnnnnnnnnnnnnnnnnnnnnnnnnnnnnnnnncagttcggtctgaatcatcgtaggccttgggttaaggcaggttcgtgtgggttcacggccttgattagtaatactgtgtagctttaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcagtctttccccccttcagtaagagaagctttggagaagaagtcttaggtggagtcctggcttataccccagttgagcgcctgtgaagatggagccgtaggcccgctagtccgctgctgtttattttttattgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacagcaagggtagagagaaccttcaaagattggtcttttaaaatttaactctccacaagtgttgttactatctattgtacattactacaatcccatcataacattgttatgaaagtgtggtaaattttataagttttgcagtaacaaagcatcttactgcaattcttgaatagtgttactgcatacacttgtggtaacgtgtatctgccatgcagtaacacttacacttttgtgcaggaacaaatatatggttagcatgtagacttttaactcatatatttttttttcgatttctagttaactacaatttcactacgatgttactatcaaaagtgcagtaacatcctatatgt

SEQ ID NO: 11330 - DNA, 4809 bp, Oryza sativa
  unsure (1)..(4809): unsure at all n locations
nnnnnnnnnnnnnnnnnnnnnnnnnnnnnnnnnnnnnnnnnnnnnnnnnnnnnnnntgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacagcaagggtagagagaaccttcaaagattggtcttttaaaatttaactctccacaagtgttgttactatctattgtacattactacaatcccatcataacattgttatgaaagtgtggtaaattttataagttttgcagtaacaaagcatcttactgcaattcttgaatagtgttactgcatacacttgtggtaacgtgtatctgccatgcagtaacacttacacttttgtgcagtaacaaatatatggttagcatgtagacttttaactcatatatttttttttcgatttctagtttactacaatttcactacgatgttactatcaaaagtgcagtaacatcctatatgttttgcagtaacgtgacgtggtactatacttatacgataatgttactactaaaacatagtaacttgttatgagttttgtaataacatatatatttgtcttctaattagcttcttacaactatggaactttgtgtcctgtagagttgtaacagtttatgtgcttttacagtaatcgagtgtgttactactatttcttctcgaagattggtattttgaaatttatctctccataagtagtaatactaaatcattattgttactactttttattgtgtgttactaccattccatcatggcgttactgtatgtgtgcagtaacaactataacttttaaagtaacactgcatgttactgcaatttcttaatagcattactgcaataagaggtggtaacaaccaaacacaggtacaggacctatcacccactttgaactagtaaaatgtaaatgcaagtgatatcttttgaattcacatctttaaacaataatatctctcacaccacatattatatttttgaaccgtttgcaccgtaatgctttaaaaaaaaagctctacaaaactagatccgtcatgactatattttaactatattttattagtattactgcaagtaaggtacagtgttactgcatagtggtcgtcatgttactgcaccgttcgtacgagacaaggacaacaaataggtggatgtgggaggaagttagcacacgggtttgaccgacatggcagcgatttgaccgtcctttgaccatgctttgactggggtagcaggtgggttttgagcccaataaaaggagggggtagtgggttgggctcttaagggcgacggggggtatagaatagtctcaccatatatatatatatataatgattctatactcccaggagtaggtactcccggttccatccaccgtccatcagcgaacaccaccgaccaagtcagcaagcggatccagataccgagcccgttttgatttttagttacgaaaaaaatcctcataatctgaattattccgtaataaccggaacccttttgaatagctcgtattaaaatctcatgggtggttgtaaacagaatcgatagatcgatccgcaggttatctcgatcagcgattcgaaggcgacggcggcgcgacccatcggctattcgaaggtcgtggcatctgctgatgtctacgccggcgtcttccattaccaatgccttcggtatgactatccggaggcgactggctggccgaagagctatgaccagacaacgacgccgttgatcttcgggcaagtcagtgtggccgtgcggcgacggcatcgatgcaggcccatgctacgatcaagacgacgttgagcgtcgtccggaactggaacatcgactatactgcaggcaagtccttccttcttccgattttcttgatttgctttttctacgttgcaaatcgataatgcatgcatgcagatcgaatttgtttggtgcatgcaaatgcgagatgcatgtatcgtggacgtagatggtgctgatgacagaacagcccagcatgtgtggccgtgcggcgacagcattgtcgtcggcattgaaccgtgattcctagctaatggtgttaatccaggaagacacattcttgtccacctctctccggcgtgcggtcagcgtgatcccatcgatgttaaccgagatctgtctgtggggatgcagagattcttcgatgagccacatcgaggggtgatcccgttatgttttgttcttagtttccgaaagtctgcgttgatctttttctttggtctggtaatgtccattcagaattcagtgcccttctagggtatttcattaatttaggtttattcataatgcaacagccgatactttgccagtgattcaggcatacatctgaatttgcacgtgaaaagcatattaattattctattcaactgaaaagcatatgcatccagcttccatggatagcaaatatacgacttatctaagaaatactggtacatacttatttatatactgagtgaaaaaaagtagtatacatagtatataccgatcaaacaagaaggcagtataacctcctttagcgaggacgatgcagtataccgaccaaacatgacaattagtacatgcagtatactgacagaacaagtagtgcatacaatatatactcaaataataacaaatgcatatactgataaaaaaaagaagcagtatatactccttcaatgaggaatgtagtatatatacactgaccaaagagcagttcataccgattgtagaagaaataagtatataccactccgagtagctgttcataccgattggagaagaaataagtatataccactccgagaaaagtcagtatatatactcgttccaaaaaaaaaatcagtatatactcattccgtgaaagaacagtatatactcattcgctcgttgcagtagtatatactgcgcgtaccaataaaaagacataatcagtatatatatatactcgttagttctggagtaagtatatgatgtgcactagggttcccgatcttccaaaaggttctgataaacaacgatttgggcggagtcgccacacaaatcgatccggcttcttgaacgcgcacgctcttgagccccgcaattgcagcaccacgtctcctctggttatcacccgtgtcgaaacgcgaatgaccacaccgagaaggctaatccctgtttgccaatcgaagaacacaaagaagaacgagatagaaaaacaaccaaaattgcagatgaatgattaagctcacgagttggggtcttacaaaccgaactagcggcgaaactgttctcgacagattaatctaagcaaaacccaaaaacctaaacatgatggcgggtactgatatatagagtttagggtcgtgcaaacccctctcgatgcaaccctaatgggttccaacacgatacacgggccaaaggcccaaatacggtgacgcagcactgggacagattttggacgtcaaattgttcggtcaattcctgttgactcggaaagaatttggatgtgggagcaaaaccatttgaaaggttaccttcttagctttccatccatataaagaacgccccaatctgagcacgtatgcgacctgggcgcccgttttagtgcagactggtcctggactccgaattgcacccgacgtcgacttggtttgggcctccaccttgacttggacgtccccgatggtcctccatgactctaagtccttctccaagtgtctctttgtcccctccattgttcctaagcacaatataatcattaggttgcaatctattctcgaattcatacaaagaagaacataggaacgaactcacctctaaatttaattgtcgcgcacgagctcttgttatcggtccttgaatgaccattggaggattgttgtgtgtatccgaggtagtgatgtccgcatcatcctccccctcttgaattgatgtcgtcctcgactcaagctcatactcttctcccaagtatggcttcaaatctgaaatgttaaacgtgggactaaccccaaactcgggaggcaactcaagtttatatgcattatcattaatcttctcaacaattttaaaagggccatcagcacgaggcatcaacttagactttctcaattccggaaatctatcatttctcaagtgcaaccaaactaaatcacccggttcaagcttaacctcttgcctacttttactaccagcaattctatacttttcagtcatcttttcaatgttgaacttggttgactcatgcattttcaaaataaattcagcgcgtgccttagcatcattatgaaccctctcactagtaggtaaaggcaacatatcaattggagcacgagggttgaaaccatacactacctgaaaagaacttaccttggtagtagaatgtgttgcccgattgtatgcaaactccatatgaggcaaacattcttcccacatcttcaaatttttcttcaaaatagccctcaacatggtacctaaagtgcggttgactacctccgtttgtccatctgtttgtgggtgacatgttgtagaaaacaatagctttgtacccaacttgttccatagcgtgcgccaaaaatgacttaagaattttgcatcacgatctgaaacaatagaaggcataccatgcaagcgaacaatctcatggaaaaatagatcagcaatatgaacagcatcatcacttttatgacatggtatgaaatgtgccatcttagaaaaatgatccaccactacaaaaatactatccctccc

SEQ ID NO: 11331 - DNA, 398 bp, Oryza sativa
gagctggtagtaatatacatgaagacaaccaaagtttggggttcacaaatcatgagaaggaaataaaaatacaagtgctcctactcttcgaagagggggaggacagactcccccagatcaccgacttcctccatcacccccttacgtgcgtcgcttgccgccccctgatccaggatctcgcggagatctagttcaggacgcgacaaccgcacggacgcgaggacgtgacacgccccggtataaataccgttggacgtcttctccgcaactcaagccgcctgcttcgcagggatttctcccatcgccgtcgccagctccgctagagaagaggtgagggagaactcgtcggggttcttggggatcgtcgacttgaccccacactccgcggcaagctggtg

SEQ ID NO: 11332 - DNA, 5315 bp, Oryza sativa
ggctgcaagcttgacttggtgcgaggaggctggtttagcgatgtctgccctgttaaaccaaaggaaagggcttctttggcatatacccatggacaattcagggcatagtgtccttgctctctacaatcatgacaaaaggggacatgctcttttggcattggaggctcattgacctgggtggcaaatgctcgatcaaacacacactgattttggtcttgacttccaactaatggtaactgtgaaccaagcagcatgctcggaatggaccaagggtgtgcccttgttaactctcttgaggccagtggtggattgagttgaaaacttgagttacttgaggcatacccgctgacattctttcctttttctctgttaaacatctgttatagggattgaggtgagagtggaaacaagccaggaaagaatagaccagaactaaagacaggaccttaaaggaactaactcttctcgttgatgtgctgtttgtttcacttcttctgcaagttgattaagcaaacaacctagcatggttacatcacaccccacagatgcaaaccacgcgctacacacacaagcaaggaaacacacaactaacgactctaccctagagggtggcttaggttctgcgacgggttctccaagatcttcactgcttcctccacttcgctagcagatcctgcagccttccggagcttcggcagacaattggcgacatcttcttcttcgcaaaactaaccatccagtactagttgaaatttgaagaaggaagaaagagtaaatattttgcaaatagcacaggggaaaggaggaaaaagggactttcggaaatagtttcatttataaaatatgtccataggttttatccacttggcttatcctacagtcgagatggctctgataccagcttgacgcgaccgagaaaattgccttttcccgaacgctagtgtattagtccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactgcgtataagctaggactccacctaggacttcatctccaaagcttctcttacagaagggggggaaagattgagcaagaatgagtacaaccacagtactcagcaagccacaccggcagatgcatgattaatacaagggggtacaaggggtaataatataagggttaggttttgcagtaaacagcatttaaaagtcacttagttgcccaaagccaattttaaaaagacgatcctagagctacacagtattattaatcaaggccgtgcacccacacgaacctgccttaacctaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatattcctcacgtgtaaccacgtgccacataccaccacggtatacggacggaagacgtgacatagttcccaacccattctagccataaacaagagtaccgacccaaccccacctacggtcggaacccctcggacaggtaggcaggactgagcccccagcaacagggacacgggccctgtgccatgacatctcgactaccgggccgcagctcgtgtagccttcatttgtcctagagatgtccatcgacccccgacttcgtccatctccatccgtgtacttctgtttataaccagactgagccacaaactaagccttacccactagacatgtggaagtacggtagtgctttgcacaaaggcccgagcttaatccttatagtggccggggtgctacttcccacaactagcatgcacccaaaccccaccgaaaaacaggttttaggggctttgaaagaggaagagaggggtatgtccaattccaccataagccaaccattccatagtatccaagtgatatgagaattccccaagtctaaagttataaaaccacctaatgttgcctaattaaacagcgaagcatctacctaaattcatactagtggaaccatgaatagagtgtccactagttggggttttgtttattctagggtaaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaagagacttgaacgggtcgattcagagttcgtatgaccaagatatgatcatccgaagtttaatgctgttacatggagatttgcggattattgtaattaagctttgcaactataaaacatgtggaagcgctagcctggaaaagacaggaaggctgcgctgttgacatgcggaccccacatgtcaacctaaaggaccacggtagaccgagtacacagagacggtccacgggtcgacggaagcggaccccgtgtgtcaaccgaggcgaggggccaacaaacggactccactagacaccacacgggctgcacacgtggaaaccacgcggctaccgagcgggcacactaacacggtcaccacacgcacaagcgaacgactaccaacaccggtacacgggtaccggggtcgacaaccgcacaacgagcacgggcgacaacgaaaggacgaggacggggcagcaagaggggagaccttaccaccacgcgacgaggcgtgggaacgacaacgacgaacgggcgcggcggagacagacggcgagggaacgacttcggcggcgatccttggacgaaggtgagacgcggccggcacgaggcttgacgacgcggaggcgaggacgaagacgacgatggggctgcagcggcacacttgacggacgcggacgacggacaagaacggcttgacggagggacgaacgccacaacgagcgaaaccgggaacgacgagaggacgacgacgacgacgaccggagccggcgaggaggcgacgagggcagccggcagcggctgcacggagacaaggacggcgtggaacacgccgcaacgatgcccacgacggaggcggcgccgcgagacgacgaaccgggcgaggaggaacgatgacgatgacgacgaacactggcggggttcggtcgaaggggaggcgaggccgagggcggcgtcgcggctgcgatgcggaaggtggtggaggtgcggccaaccggtgcaccggtgaggagggacgggcggccgaacaactccggcgaggcggatggagaggttcgcggcgatgtgcggcggcttccgggcgaaaccgaggggtggacgaggtggagggctacgtcaccgtgccgagagaggggacggcagcgccggctgacgcacgggcatggcgaaaggggttgccggaggagacgttgacgaggaggaaggtgaggccggcgcgggcgacggtgttccggcgaaattcgggcgaggaggaggtgatgccggggatgagagcggcatcgcggagccgagggaggtggtggcgacgtcgaccggtgctcaggcagggagacagaggcggctggaggcggccggcgcggaggaaagggaagggcgacggcgggaacgcagctccgggggtctccgcgggaaacggagggcaagccggggaaggggaggccactgcgatgctggaggaggcgacggcgcgaccggacggcgctccggcgaggagggagaggcggctggaggcggccggtggcacgggagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggccatggaaagcggccggagaaaacgcgggcgttcccggcgattgggggcacgatccaagggggaaattggggggaattgaagaggaatcaatgggatttaaaaccccccaattaattttggaatccatggtttgatttgcgcggatttggaggaggaacggctctaggttttcccggagagggagaggaggctgagcgggaggaggaagaagacgacggccggcctggcgcgtgggcctcacgcgggcgcgcggcgtcagcgcgcgtgcggcgcgcatgcgcacgcggctggctcaggcagggggggcgccgctcgggttgggcccggaggcggcccaggtgggagggggcggaacggcttgggccgagaggcggcccgggaggagaggagggcgagggagcccgggagagagagggaggagggagtgggccgggaggggaggaggcccaagaggaggagggagagaaggagagggagagaaagagagggaggagagggagactttgggctgggcttggcccaaaggaggaagaggatttatttttaggtttttctttttaataaactttgattattgtttttgttgcttaataattattttcggtgctctgaaaattcaagtaaaatttgagggctcctttttgaccaaggagaatttaacaaaaattctccgggccacattcgaatttttcttgtacgtattttagtgtttgccaatttctttctgaattttaattaattctattattccttttcgaaaatgatttttatttcgggatgaatttatcaggacgtgacaaatccaccccccttacaagaatctcgtccccgagattcgaggaggctagcatgaagataggttgggcggtcttctcttcttgtctgacttcttccgtcgcatcttttataacaaacttgcctagaaaaacttctccactctaggctgcttgtctcgatcccttgttgcagatggaatcttctcctcacctgacttgtccctggttgaacctttagctgacttcgactg

SEQ ID NO: 11333 - DNA, 676 bp, Oryza sativa
gagagggagactttgggctgggcttggcccaaaggaggaagaggatttatttttaggtttttctttttaataaactttgataattgttttgttgcttaataattatttccggtgctctgaaaattcaagtaaaatttgagatctcctttttgaccaaggagaatttaacaaaaattctccgggccacattcgaatttttcttgtacgtattttagtgtttgccaatttctttccgaattttaattaattctattattccttttagaaaatgatttttatttcgggatgaatttatcaggacgtgacaaattcccacatcataatccttgatgagttctaaccatctcctttgccgaagattcagatccgattgggtgaagatgtatttcaagctcttatgatcagtatatatttcacagcgattcccaatgagatagtgccgccagatttttagagcatgaaccaccgcagctaactccaaatcatgggtagggtagttgccttcatgagcccgtagctggcgtgaggcataggccaccacatgaccattctgcatgagcacgcaccccaatccttggcgcgaagcgtcacaatacaccatgaaatccttgcgagtatccggcaagattaacactggtgaggaaaccagcttttctttgagggttttgaacgcctt

SEQ ID NO: 11334 - DNA, 1643 bp, Oryza sativa
aaagacaggctccgacacagttataccacacaccggcataaccatgccccacacaacccaacaagaagacaaacgagaaagaacacacgcgcaagcctactaactgctcgtctaccgctgcgacgggccaggacggaaggtgagcaacagcgcatcctccgtgctaccaacgctggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacacggcgacgcttggggcggcagacctctccctgggcgatcttgagctgatgcagctgcgcctccactgcgtctaggtccttcttgagctgcagattctcttgacacagctccaggatcttcatgttgttctcgaccatcccacggcgcaccatctgatggaagtcgatacgagccgcgtcgtacgcctccaccatgcacgccaggtgcacgagggtagcgtcatcctccgagctagcatcccggaaggtggcgtagtcgtgggctcctccgcggcgaggggggtagcggtaggcgaagtgctgcaactcgtccgggtatcgctggtaaagagtgccgatggcgagaagagcggcgctctggcaagcgcggggaaagaatctccacccgcggtgactgccagcgaagtccgctcgggagagccagagaggatcactgcagtgacctcccaaccagcgtggggctttgcatcgtcaccctcctgctccggaagcggcctggcctggtagtccactccatgtggataccccaggaccacgcacatgccccgcagctccaagacgaagccagtcatgtccaaaccacgacggctgacgctaccggccatctacaaacaaaaacagaaagaaaaaaccacattttaaaggtcagattttggcgataaatgaagcagcaagacagagagagactagacagttttcacaaataacaaaggatttttatttttgaaaatattgctaaggcttgggatctacggctcgtcctagggtcaagggggctctgataccaacttgtcacgaccggaaataacccaacgggcgttccttatgtgcgtgcattaatccttgtcccaggaggcaaggtacaccaaaagttgatacaattcagagtttaacaagcggaagcgtaaatagttaatttattacatgggcagcgaaggcccagcacacgcaaagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttataatataaagggttagggttgcagtaaacagcatttaaagatatttagttgcccaaagctatttcttaaacacgattctagaactatacaatattatttatcaaggccctgaacccacaccaacctgccttaacccaggcctacgatgatttataccgaactgcaacccgaccct

SEQ ID NO: 11335 - DNA, 1485 bp, Oryza sativa
gcacggtcgggccggcccggcacgatgggccggcaggccaggcccggtacataaagtatagggactaaaaatagacatataaatgtaactgtctaaagaatagggaccttaaatagacttattttagctatttatataccccagcccaaagaagagggaggtaaaatagactttttgtaactgtacatatgtcacagcccaataggagggaggaaatttagccttattctgaggaaaagcacgacggcccatcgtgccttcgggccggcccggcacggcccgaggcgtgatgggtcgtgcctgggccgtgagtccggcacgtgggctggcacggcacggcccggtgcgtcggtcgggccgtgccggcccgacaagctcggcccaggcacggccgggcttgggccgtgccgtgccgggcggcccacatggccaactatagctacagccggggctatgttgcatgtacagtgcaaacagtaaaagaaattgtgttgggcaggggtggattcaacgtgggggtgggggccttgagttcccccaccctctctggacctatggacaacccccaccctatgccctcttcaaaaatttcgccatggatgatagagtaggaggtgcgctaggtatctggatagctagaggttgaaaaagcgtgaaattgggccgatgaatgcatttgggccaggctcacttagaaaaggaatccccttaaaaaggaataaatccactttgactccctgaaatttaacccaaatttaatgcatgaccctcaaccgcaaaaccagatatcttgacccctaaactattaaaacctgtgcaatttaactcccttggcggttttgctgacgtggtgcctacgtggcaatgttgactggtatgtggcattgacgtggcgcttaggtggtatttgaattaaaaacttatatgtgggacccatttgtcattaaaaaaattttgtggggcccacatatcatcctctctttctttctctttctctccccttcggtcgtccgcacggagcacgggctggagcggcggcgggcgggaccagagtggtggtggtcagcgggagttgaagcgacagcggtgggttggagctgaagcgggtggaggcagaggagaagaaggcggcattggactacaaggtcgcacctcctcgcggtggcagaggaggaggagaaggaggcggtcccacgccatctgctcggatgtccccctggtaccctcgggccacactagtgcccagctcttggcccgccgaagctgtcaaccgccgcccccctcgatctcgttggcatcggcatcggcgctgccatcttgtcccgcctccttgccgtccctcgagcgctagctgccgctccagctccatcccaccaccgttgccgctctagctagctcccgcgtcagagagagagagagaggaaggagggagggtcgagatatccggtattgtggttaagggatacgaattagactcggtcacta

SEQ ID NO: 11336 - DNA, 1073 bp, Oryza sativa
cggcggtcggcggcagttagcagacgaagcgcgcggccccgcgagcagcgagcagcagagcaggtgcagcagcaggccagcggcggggacgaaggctgcaggccggtgctggagacgccacgggagcacgcgagcaagaggcaggaccaggcgagcaacaggcaggcagcagctggccaacggctgcaaaataactaaacaaggtatgtaatgcttagaattttatgcaaatatgcaatgcaactgtgattactgattacttaattggaaatttggaatgattcaatccattaacaatttagcacagtttctttctttctttttttttgtctagactagaatctcagcatgtcgaaaagaacattgttcaactattattcaagtggcagcagcagtactcctactgcatcagaggatgatgagaacacaagacaacaaaaattggcaagggtagagtttacttgcttagatattgttagtgatccaggaacgtgcaaaccaattgatgagtatccatttgagattagagatcaagtgaagagggcatttgttttaaggggtccaactcaaccagttggttatacatttccttgcaaatggcaaagtggtgaatggagatctttccaacaacgttggttggagatctatgattggttagagtatagtgaatcaaaggatgcagcattttgcttgtactgttatgttttctttgagccaggaaaacctgaaaaatttgggagtaatgtctttcaaaggttgagcgcccccccacccccccaccccaatctttcattcctggatccgcccctggtgttgggtttggtgatgctactgctgcagctgcatagccgcagtaatatctcccgatcagcccctagcttataagtctaaacaaaagaggatacaaagtgtcttataaaatggaacagagggaacacctggtggtatacagtgatgcctagtagttaagtagcaaggatgacagtttcagtttccgaataaagtggagttcaaaattcaattacctaagcccattgggccatcttttccccgactcattcctgcatgtgttt

SEQ ID NO: 11337 - DNA, 9673 bp, Oryza sativa
gatggtgaatcagtgaacgggccatttttatcctagcaagaataagttgggttaggctagaatgttagatcacttccatcctgaagaaatagaaatttgaagcaacaagaacctcaactcctcaagtataaacttgtttacaagctttgcagatttgtgccaactagctgaacttcccgagcgattagatcacacatttttcttgcatttagaaacatagttgtatttgctacacaagatgtaatttgtagctgatttttttgctgttatcaatctttgaacagtaactttatttataactctgaaatcctggggaggtccatttggattttggttgatttctcctattttaaggaacccttagattgctgtaatgctgtggctgtgaggaatcaaatccaaaatcttattctccgttcatttagttttagccttttagatttttattttctccatggtgccatccttaccagtcttatccatctatcctttgtttgatgatttatgtgcttcttcttcagcgagcaagattgatcccaaggtgcgggtgcagattatcttccaaacatgtttggggctctactgggactccatggcacatgttaagtgctctggatcgcttgctattttctgctcctcaatcgtgctcattggctcacacatggacggcttcagttatgcacaaccgtcttgtacgtggctgtttcagcagtttttcagcagcagcagcatcggctattcgtgtacctgttgcaagctatgggacttctgcagcacaaagcacatcaaaggaccagcatggcagcaacatcaacagtgcgctaaaagttttgaatcttgtaccaagaaaggctgactatgacaaagtgggaggtccatgccatcaccaactaatccatgactgcatgaatgacatcttgggggttcaatcaaatcatactatacacaagggaaatggtgtcacttttaactcatgcagcaatcctgcacaggctaaatttgatagctttgtttcaaataatggctcggctttgcgttccaggactagattcataaaggaggacatgtttatgctgataatggagctgcacaggaaaggagaaaccagtacagatcaatctattttggcagctgccatgagttcctgtgctgataggcaaatgttcacccaaggcacacagcttcatggtctattggttaaagttggctgtgattcaactgtctttattggcagctcacttatcaccttatattcgaggtgtagccagttggaaagttcgtacttggttttccagaccatgccaaccaaaaacacagtgtcatggacagcaatgatttctggttttgcgctacataatcgggttgaaccatgtctccatttgtttgcgtcaatgaggctttcaagttgcaagccaaatgacatcacatttgccactctttttagtgtgtgcactaaccacgcacttctagcacttggtaaaagtgttcatgctttacaaatgagaatgggtttccattcatatgtgcatgtttccaatgccctgctgtccatgtatgcaaagtgtgggtgcatagatgaagcccagtccatatttggcttcattgcctgtaaagaccttgtttcgtggaatgccatgatctttggatgttcgcagtatggccttgctaagcattgccttgacttgctgaaagaaatggagaggcaacacatagtaccagatgctctctccttccttggtgtcctttcttcatgccggcatgcacgccttgtggaggaaggccgacactgcttcaagacaatgattgaacatggaataaaaccagggctcgatcactactcatgtatggtcgaccttcttgggcgcgcaggattgcttgaagaagcgtgggatttgatccaaacaatgtctatccctccaaatgccgtcatatggggctctctgctgggttcctgtagggtgcatgggaacatttcgatcggcatccaggctgcagagcaccgtcttaaacttgagccaggttgtgctgcaactcatatacaactagcaaatctgtatgccacaattggttgctggagtgatgtggccagagtgaggatggcaatgaaggcgagaggcctaaagacgaacattgggtgtagctggatagaagtcggtgataaggtttattccttcacggcagagaacagatcaaagagccaccaagtaaacaatgtcctggctattcttgattgcttgcaagctcacatggaatgcaagtatgatatgcttacagaaagcctggagtagtggagtgtgatggctgtgaacatgtcaagacgactataaacactgtatatattaagaggaatcctaaagaagatccattgatgccattataacacctaaacattatgtgtatggactgattggtataaagatctgtatggattgacaagattcacgaccaacaagacatacaggtactgtattttccaagtctcttccagttttgttcctcatttgtctaagaagtgtggggaataagtattcttgcattctgccaccacccaacgatctgcaatttatgtcccccatccatgttacattttcttgttagtttagttctccaaaacacaggtaattagaagaacaatattcagattttttttttgttttttttctttaaattctttctggccaaggttttctgacttaattgatgtaactgctacgagacttcctatgccttcccataaaaaaaagtacagttcattcatcctatctattcattgtgtagcagcctgttgtggcggatggtgatggaaggcctgctttccagcttgaaggaaagaactgaaggattgaaggttaagcggcataaacttgtcatagcacatctcatgtgtctgataacataatgcgttgatgtgtcatatgtgcaatcagcgatcttgtactgcttaattacaatggttagaaatgtagctcttgacaaagtaatgattcaggagttctgataattgagaaaacaagacagcatcgtctaaatgtcagccgatggcttctctgactgatgagtatcaacaattttcatggaaacgaataggattacaggagtgtcaacgaatatgatatttgcggggaaattgaagaaagtttttaacaacatgccttcccagtcttgagttagagaattattgcatggcccattttctttgggggtcaaattaggtaggtggtgaatttgacaatcagcatgccgttagtgtcgaagacaagaaatgattctttgtattggtgctgaggaacaaataaatggaaggaattctactcaaaatctcaacaatctaagttgaaaggtaagatctccaaattaaacgctggggataaaaaaagcaaagttgaaagaggggtgcaaatgaaactgaaggcgcagtttcatcttctttagatgagatgctatcatccaacctgctaacggaagtgatttagatgaatattaagtatgggtatataaaacaagaaaactattagtatatgattaattgagtttttattatttcaaacttagaaaataaattaaaaaatggttttatctgatatttcaaagcaacttcgtatgagatgtaccatttaacagtttaaaaaacgtgcttacaaaaatcgagataaaatctttgaaacgaacttggccacgtgtaacaaagatttagcatgacagaatggcacaaattgaaaaaggtaggattgcaacatcgatgcgacactaacatgtcaagtgcgtcttctttttgctacctaccgtgctaaagccaaaatgtagtacaaagccctctgcatctaatgaccattaccatgcaagctaaacccatcaccatggcaacggcgtcgatgctcctccggagcctcctctgcctcgccgtgctcgccgcggccgcggccgccgctcagccgcggttgcagtgcctggagaacccgccggagctgacggccgccggcgacggcgaggccggcgtggtcgtccaaaacctgggaggattcgcggcctacgtcaccggcgccgcccactccggccgggccatcgtcctcgcctccgacgtctttggttagtagtctgtgtgtgtgcatgtatgcctgatttgcttactgatcattcactgccatcctttggtgattatcgattgattagccgttaattgttgctgttaatttggtttcttcaggatttgaagcaccattgctgaggtacaaaatcttcttttcatttcctttagcttcttgttcgttgtcatcttcgacagtaattttcttcatttcttcactctctggattataggcgcagattgtttattttattaacataacaaattaatattttgaaaaatgaactttgcaaatatctaataatgcagtagaataaataatattttttaaagcatggaccaaataatctgtagcaattatccgggggaaaatctaaagagaacagggcatgacaaatacttgacacttgaacaactctggaaagagactgatttaaaaaaaagaaaaagacagacatggcttaattgtgtaccatacctgtttttcttgtgacaatgggttcaggtcatttttagtgaactatctcctatctttctgcagtgacttttgtgagaaggataacaggtttagactttagacaccaaaaggtgcaaaagcaaataatcgtccattcgccctcaccatccatgagcttgaacaaagaatattcaacattgctatgtacatgtttcttccgtttcaaatactccctccgtttctaaatatttgacaccgttgactttttagcacatgcttaaccgtttgtcttattcaaaaaaacttttatgaaatatgtaaaactatatgtatacatgtaagtatatttaacaatgaatcaaatgataagacaataattaataattacttaatttttttgaataagacgaacgattaaacatatttaaaaaatttaacggcgtcaaataaacggagggagtagttagtatcttttttttttttggagtaaccatcaattcatacggagaatcagaagcgtatactcatttttgctattttccatattctgaccttctaatgatataaatatgttaagcggttgaaatacatcatttactatcaatgtgcaatttcattattttaactactctacttagacaacatatatgctaaaactttcatcttctgtatccctacaaagttgaagataaatctactactccttccattacaaattatttgtagttctagttttatcctaagtcaacaatttctaactttaacaatcattttttttaaaaaaaatgtatattttaatgacataagttttaatatgttttttgattcacaataagaaatacttccaaatatgcaatccacatgtatttaaattatacaaattgctagttattaataggctaaaatagaaatatttgacttgggacaaagttataacaataattaatttgaaacaaaaggagtagtactatcattgtatactgtattactgtgcataactatgttcattacatgctttctaaaacatcatttctttaggggcaaacgctgtcgtaactcaatagtcaatagtaatatctcattgctgtccttgtaaagctgatttatgaatggataaccaagcaacgatccaatttcagaaattcagtttttctgtaaaaatatcgtggattccaatggtataacagcaatgatttcttcatgtggattgtactaaggtttctgtttttgattccaattttaagtgcttcctttagcttgaaagtattgtaaaacgtcccaactggattcctttcaatacaccttacatttttactcccattctagattgcaaagacaacttaaaatcaaatttgtggttaataatgctgacaattacaggaaaatagctgacaaagttggtgaagcgggatattacgtcgtggtgccagatttcttccaagggcgaccttacaatggagacccaagtataaacattacacaatggatcatggctcactctccggtaattgttttcaccaattacatagcttattcgacgacgattatcgaggagtcaattgatattgatcagtatattcaattgaaatttcaggtgaaggcagctgaagattctaaaccgatctttgctgctctaaaaagagaagggaaatctgttgttggagttggaggttattgttggggcggtaagcaaaatcgatcagcaaaaagaaaatgtctttacatatcctacatcagtacattagtaatacatacactctaaaaaactttgtaaattcctagttaatttccatatctagacttaattcatactattatagtctaaacaacaaaacttcaattgacaggaaagttagctgtcgaggttgcgaaaaccaatgaggttggagcgattgtcatctcccatccttcatcggtgactgctgatgatatgaaaggtgaacttatctgttttggtgctattgttgcgcagtatatagatgaatatatagttaactgattcatgtacgctgtatcctagtagtccctgtttttcttattccaaaatgaccttgacacagatgtcaaatgccccattgaaatccttggagctgagaatgacgctgtaacaccaccaagattagtgtaccagtttgtgaatgccttgcgccaaagacctgaggtgagttcctgttgattttcattggcacttgatgccaaatgcatcagcatagtcccacggtagacacacacgagaaaaatctcccactgatgatgagaaattgaaagatcatgctggctctatttttctttttgaggcaatactggatctagctaattagtaacattaatgaaaagtccaaacactagcacaatgtcaataaacaagtttacaattgtttcttaaacacaaccactcaatgatctttaagaaaagaaacaagttatgaagaggctcttatggattgcatctttgttgcaggttgattactttgccaggatctttccaggagtggctcatggctttgcttgcagatataacgccagcaacccgtttgctgtcagaactgctgaacaatctcttgccttaatgcttgactggtttgagaaacacttgaaatgacattagctaatcatgcatgcaatgcaaggccagtgcaattgtttatttccatcaaaatacattgctagtgtccatgtatatcctggtgttaagtgaaacttatataaataagcactagtgtaaagtgaaagtatgtgttgaatatggtgcgaagtgaaacaaagtgtactttatgaagtgcaaaatgcaaactctttttgttccgaagcgaccattagcatggcatattaaaacatctttttgtaggagaacaaaaataatgtgtgcctctgttgccattttaactagtcgatatgttcaatcaaatgttgtatgctactcatcttaagcacagcatatattgggtacctcttgactgtttcttatggccacaaattagacagatgaaagtcgtgcttccaagaaattgctagcccttaaataggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatatctggtctcaccggaagccagtggcgaggttgctgtagatctggccagagctgtgtatcctgcctccgccggatcgtggggatggcatcttcacatgagcatatctccacctcatcctatatatgtgcgccgccacatccagtgccaccccttggttgggttccatcgaggaggtcaagggagattcatgttgccttaagcttttgacaagggtcgaggggcagctcttccagttcatgtaggtgcagaaaaactatcacaacttccaagcatccaaggttggcgtgtgaagcttctgtctctaggtgcagcttctggtcgtcgttggcattcatgattgatcgcactctgagaaaattaaaatatattttagaaacaaaatgttgaggaaaaccatttgccatagggataacaaattattgcttacatgaatccctgagcatcataaagacccttcaaaatgctggattcttcatgcacttgggcagagctatggtatattttaccctttgaattcctggatgaatttggtcctgtcccggaggttataactaatcttgttgctagtcattaggatgcttggtattcaaatcttcagaaaattggctgaaaatattggatgtttaaatcaaacctttactgtcatagtcttgcagcgtgaataaattcatcatgttgctggctttaaaagaactcctctggtgagtgcctttcagtactttgtatttcagaaaatgctcgtgtatttgccaatgatatagacttactcctctagcattccacttataatcagtctatatactgtcatatctctagcttgccgaattctctatgcacgttcactagcctaatccacagagaatttaatttgttaagtagagtagaattaccattaaaaacaaaactacattaaatgacaaagcgttaccatgctaacaatagtatcggtagagtatgatagaaaattattcatctaccagatcatctctcactggcatccaatcaaaacttggcaatgaggttagaaattttgcatcgtacggcgacattgtagcaataagggcatatcactggcatccagtcaaaacttggcaatgaggttagaaattttgcgcgacattgtagcaataagggcatatcactggcatccagtcaaaacttggcaatgaggttagaaattttgcgtcttacggcgacattgctagcaataagggcatatcaaaacattaatgtatctcctctgctaccatatcttaatgtctagttgggtgtttcttataagattaattttccttttaagaaattaagcttctctcagattaagcaatgagttcaacagagaaaaaaaaatctaatgttagaaatttcaaaaagccaagcgctagtgtctagcgctgcctccaccgagagacccgactgtgtgcctataggtgtcacgtcctgataaattcatcccgaaataaaaatcattttctaaaaggaataatagaattaattaaaattcgaaaagaaattggcaaacattaaaatacgtacaagaaaaattcgaatgtggctcggagaatttttgttaaattcttcttggtctaaaaaggagccctcaaattttacttgaattttcagagcaccggaaataattattaaacaacaaaaacaattatcaaagtttaataaaaagaaaatctaaaaataatcctccttttcttttgggccaattttggcccaaagtcctccctctctcccctcggcccgcggccgaagtctccctttcctccctctcttcctctccctctcctcctctccctccttctattgggcctcctctcctcccctccggcccactccctactccatctctctctcgggccg

SEQ ID NO: 11338 - DNA, 5960 bp, Oryza sativa
ccgttccgccccctcccgagcccggctcccgcccccatcctataaaatggaaccccctctttgcgttctattgttttagccctttctcgagctcccccgtggccgcagcacccctccccgcagtcgccctctctctcccgtgccgctggacgcctccagccgcccctaccgccttgcctgagcgccgcccggtcgcgccgtcgcctcctccagcgtcgccgccaccttctccaccccggcctgccctccgtttcgcgcggtgaccgccggaggcgcgttcccgccgtcgcccttctctttcctccgcgccggccgcctccagccgcctctccctcctcgccggagcgccgtccggccgcgccgtcttctcctcggcctcgcagccacctccttccgttcggtcagcccctccgtttcgcgggggaagcaccggagacgcgtcctcgccggcaaaacagtggtgttgccgccactgttccacctccggccgccactgtcgcgtttcccgtgcgccggccgacgtcgccaccacctccctcggctccgcgacgccgccctcatccccggcatcacctcctcctcacccgaatttcgccggaacaccgtcgcccgcgccggcttctccttcctcctcagcggcatctcctccggctgcccttttcgccatgcccgtgcgtcagccggcgctgccgtcccctccctcggcacggtgacgtagccctccacctcgtccacccctcggtttcgcccggaagccgccgcacatcgccgcgaacctctccatctgcctcgccggagttgttcggccgcccgtccctcctcgcccgtgcaccggtcggccacacctccaccacctccggcatcgcagcggcaaagccatcctcggcattgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgtcccacgtcgtcctcgtctccgtgcagccactgccggctgccctcatcgcctcctcgccggccccggtcgtcgtcgtcgtcgtcctctcgtcgttcccggtcgttgtggcgttcgtccctccgtcgagccgttctcgtccgtcgtccgcgttcgtcaagcgagccgccgcagccccatcatcgtcttcgtcctcggctccgcgtcgtcaagcctcgtgccggccgtgtctcgccttcgttcaaggatcgccgccgaagtcgttccctcgccgtccgtctccgccgcgcccgttcgtcgttgtcgttcccacgcctcgtcgcgtggtggtaaggttccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcctccgttgacccgtggaccgtctctgtgtacccggtctaccgcggtcctttaggttgacatgtggggtccgcatgtcaacggcgcagccttcctgtcttttccaggctagcgtttacacatgttttatagttgcaaagcttaattataataatccgcaaatctccatacaacagcattaaacttcggatgatcatatcttggtcatacgagctccgaatcgacccgttcaagtctcttaatgtttgttataacctaaagaaccatgtgctttctttttatgtattgttattgcttctttataggcttgtagctttgcttgtgtgcttcgcgtagcttctgtcgttccggaggttccagaagcgtggttcgtggtcgtcgccgaaggttcggaaggccgttctctctgagaaaggcaagtcacatcatccttgaacatgttgaatcccagtttataaaattattttgatttaaattattgcattatcgctttatttaaattcccgcgtgatcactgttttatttagccatgcctatttacctttgttataaccttaatattattgttattgatattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgaaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttataattcttaaaatttggtcaacaactaaaatgtggaatggttggcctaggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctttgggcaactaagtgacttttaaatgctgtttactgcaaaacttaacccgtatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatatgcggaagtgatatataaagatgtgccttttgtatcatgtttgtttggtgtaccccggcttttcctgggacggggattaatacactagcgttcgggaaaaggcaattttcccggtcgcgacaatagggcatcttttcggcagggggtcgcctgccgtggggatcttttcactgctccatttctttttcttttttttcagctggccggcagggggtcgcctgccgtgcctcagtaggggatcttttcactgcattttttttttgcagctgaaacggtagggcggatacacgccctaccgctgcccattgcagtcggggtgggtgtccctggggtggcgatggaatagaatcaaatcgagctaataaacaggtcgtgttgtctcagaatgggcgatatggtacaaaactcattaccggatggattcagtcggagccaaagaacagcgcgcagagcaacctagggctaggagtagaggtgcgtggcatacctgctctccactccacgtcgagggcgccgtcgaactggccgtgctggtgaagtttcccgccgcccggccgtcgccgtcgccgtcgccgctgacggccggatccagattctccggcagcatcaccagctggctgctcgccgccggtcttggggaagcggcggcgtcgcggagagtggagagaggtcgggagcgagcgagaagccgagaaggggaggaggaggatgacccatcgacacccatcgactcaggcaaatgcaggatgctgggccatgagtccacgatgagtccatccttctgacgacgcacgtggggccatccttctgacgacgcacgtggggctcgagcggaagctttcccaggcccagtttgctactgggctgatttatcttgtttcgttttttgagtttcactcgcatccttcaaccacaaagaggtactatattgcatccgtcaactatcaaaacaagtggaaatcgagtgtcatagttatttaaatgacggtttcgactgatttggtgtctacctaaaatacccttatggacatataaggttaacggttgatttatatcaagtttcaaaaaaaaatatgaaaacttttatttggcctccttacacagtataaaagtttgtatataagttttaatttttttcatttctattttttaaaaatataacttatttgttatatgctatataaaatattttttgtgttgttgtttttaatataaattatctttcatatgcaacataagatattttttgctattatctttcgtgtaagctatttctctatgatatacacacaaaaatattttctctgatatacacacaaaaatatatttttaaaaaataaaaaaactaaaacttatgtacatacttctttgttgtgtaaagaggccatataaaaaatttcatattttttgaaactttctaatgagataaattgattgttaaccatgtatgtctctaaggtattttgggtattttttaaaaaagaggcccatcataattgataaagtcatcagtatatagtagaaagagataatgacagtggtaaatcgttgaactgggataaactcagtagcatagaatagattatctcaactttatatacacatataaaaagtttatacgtatgtatgtaaagtatatacgtacgtacatataatataaatttttcatatgtatatacttttgatgtataaaaaatatatacacgtataccaagtttgtatctaatttaaacattcaaatctttcaactcgaaaattttaaaaaaataattatgtatagattttaaaactttagattctaagttttaactttcaaattcaagttgaaaacttccaagtcacctatttatttcattcctggttaaggacgtaggattggaacgtcgatgcgacactaaacatgtcataggtgcgtctccttttgctacctactaccgtctaaatccatgtacaaaagctgcttcagcaactatgatcagtagagctaattaattaccatggcgccgtcttcgttgctgctctgctggagcatcctctgcctcgccgtggccggcggcggcggcggcggcgctgccacctctgccgattcgctgcgcttgccgtgcctcgacaacccgccggagctgacggccgacggcgacggtgaggccggcgtggtcatcgatgacctggcaggcttcccggcctatgtcaccggcgacgtccactccggccgggccatcatcctggcctccgacatctatggttagtagtgattatcaactgattatcgagtgatcagctgttgtcgctgttaatttggtttcttcaggattcgaagcaccattgctgaggtacagtattcgtcaatttctttagagagaatcctttatatgccactgaaaattggtctgaacccttatatgccattgaaaattggctcttcccttatatgccattgatacaaatttgcacaccctctcatgtcactcccgttagttgaccgtgtgttgaccgttaattctcaaggaaaaaagacgtatc

SEQ ID NO: 11339 - DNA, 2002 bp, Oryza sativa
caaatatgtcttttttacttgagagttaacggtcaactgacggtagtggcatgagagggtgcacaaatttggaccaatggcatataagggaagagccaattttcagtggcatataagggatcagaccaattttcagtggcatataagggattatctcatttcgttaacctcctcctcctctctttgtcgtcgttgtctgtcatctttctccgcaattttcttcattttctccacaaatttagtgaaagaaattaacacctgaacaactctagaaagagactgaattcgagggaaaataaacagagtaaacatgacaaataattgtatgacttaaaaggtgatattgtcatttttactcaattatccctatctttctgcagtgacatgcgtgaataatagttctcatcacccatgaggccatcatcagtgtttcaacaaataatattagacaatgctcatctttcatttcaaatagtttaatttcctgatctttttgggactaatcatggttttaaactattccctcccttcatattataggccactttgggtttgacctaagtcaaatatcgtcaagtttgataagtttataaaaaatatagaaacatctacaacatcaaattaatttcattcaacaactatcgttcaatatattaatttttctataaatttggtcgaacttagagaggtttgacctataacaaacctaaaataatttataatttgaaatggatggagtagttaccaatgcatggagaatcagaagaatatatactcattttgcaatttttccatattctatcctcccgctaatgatataaatatgtcaagcgggtttaaatatatatatcattttaatggaaaaattcatgtccacacatcgtgcatatatatcaagtgacaaatacagtgaaaattattgaaaatactgtacatgccaataatattatacctatgtgtaaagtctatgcattatactgaaataaataaaaattctgacagttttacaagtaaaaagccatcagattttgtccttagccatcagattttgtccttaggacaaacgtagtcggaactcttttttttgggcaaaaaatgtgtaaagtctatgcattatactgaaataaataaaaattctgacagctttacaagtaaaaagccatcagattttgtccttaggacaaacgcagtcggaactcttttttttttgggcaaaaaagtgtaaagtctatgcattatactgaaataaataaaaattctgccagttttacaagtaaaaagccatcagattttgtccttaggacaaacgtagttggaactcaatgaaggactgagaatgatccaatttcagtgttccactttctgtagaaatatcttgaattccaacaatacaacgacaaacccgtgatttcttcatgtggattttactaaaatttatgttttacgttccagttttaagtgcttccttgagcttcaaatagtacgacatcccagctaaatttatctcatacaaattctacttttattcccattctagattccaaaaacaatttacaagctgatgtgtggttactgatgctgacaatgacaattacagggacaatgctgacaaagttggtgaagctgggtattacgttgtggtacctgatttcttccatggacaaccttacaatggagacccaagtataaacgttacaaaatggatcacgcttcactctccggtaatttgtttcaccgtttacatagggggtgtttggatcctagagatattttttagcccaccccttttagccccaaaatagcttaaggggatccaaacaggaggaagtttacatcttgtagacacgtggtgtgactgttgtttctttttttcctctatttataactttttagggctatggtcttgtaattttttaatgctatatcaatatgaaatctcacatggttcgtttcaaaacgccaagtaataatgatcatagttgcattaaaaaaaccttttcta

SEQ ID NO: 11340 - DNA, 9447 bp, Oryza sativa
agggaaggcgaatctgttattggaattggaggttattgttggggtggtaagcgaaactaaccagcaaaagaaaaatgtctttacatatcatacaccagtacattaggattgcactataatttttttcgtaaattcctagttaattagattgcacagctagatttagttcatattatagtctcagcacaagttcaactggcagcaaagtttgctgtggaggtggccaaaaccaatgaagttgaagcgattgtcatctctcatccttcagaggtgattgctgatgatatgaaaggtgaacttaacttgttttgatttgatgcttaattggttgcactacatatacatgaattatctagtcattttatgtaagttgtatccaagaagcctctgttttgtttactaaattcacattgaacgcaggtgtcaaatgccccattgaaatccttggaggtcagaatgaccctataacaccaccaagtttggtggaccagtttgtgaatgtgttgcgtcaaacaactgaggtgagtttttttttttttgagaacaactgaggtgagttgctgttgggtttcattggcacttgatgccaaatgatctttaaattttgtaaaaaaaaattacaaaatagaaagcacaagaataactgaaacagagtttattcaccccccctccccaagaaaaaaaaagaaacagtaaacagagaagagataaatctcccagtgatgatgagatattaaaagatcatgccggcactaattggaagtcaacatttggaaagttgtttttgagaagaacatttgggaaatttacaataactaaagtctaaacactagtacattgcaattaaagttccatacatgtacatggccataaattcggaaaatatcctatatcttcttgacttgttctatatttgcaagaagaccctaattttttcttcaacacaaccactcaataatgtttaagaaaagaagcaaattaaaaagtgcctctaatggattgcatctttgttgcaggttgattactttgccaggatctttccaggcgtgtctcatggctttgcttgcagatataacgccagcaaccagtttgctgtcaatactgctgaacaggctcttgccttaatgcttgactggtttgagaaatacttgaaatgacaatatagatattctattaaaaaaatgacaatatagatagttatttgtgaaaatgcagaaaatcgcacttattcattttcatctaaataaattgccggtgtccatgtataagtataaccagccatgtcaatgtgattaattggctatgattttctctgaattgagcttgtcgatgtattaactgctgaattgatcttcaaattcagcggtgggaattcaacccaacgcacatgcatgtattctcaagttcaaagttaaaactaatcttcaaatttgaacgttggaacaaatgcaagctgaaagaggggacttctgcagttggagcttagaaagttggaggtgaaggcgttgttttattttatttattttagatatctgaggttttcattaagcaaataaaagcatctatatgttcgacaccaaaatgtacaatcaaccaaaaaacacactcagacacacactacaaaaagaaatcagagtagcaaaagaccttacacaactatatcttgacttaaagaaactcaagtaagactaacatatataataaacacgccatcccaatggcgtaataatttcactttggtttttgagataaaaagtaaaagctatacttttttttcttacagaactcttacaaatgctgatgtgacataccgtgattaatctagattcaaagcgccgttactgaggtataacttttgtttttccgccgtcatcctcctctctttccagtttcccttttctctagaaaattaaactgagtaaattgctgtcaataaccgtagggaaaagaaattgacgcatgaacatgctatggaagctaggatactgattaaatttctagaaaataatagagtggcacacttttttttcaattaaatggaagatgcacaagcgcacaaacctccacaaggtttcgttcaattcattttgacaaagcctgtaatttttgttcgtgtacagtggtggggacttaggataaatactgtgtgaccttgagaagctaaagctatataaaaaaaatagaacaggtttttttcccgatgattaaaaaacatgcttgatgtttgtcagtttctttttatatcaaacattaacttttggacattgtcatggttcgaggtaaactatggtatcctttgctaattcaatgctggtattaacctttttcttactgatcgaaagtgagaattcgtttctgtaacgcatgaattcatttcatttttcaattgagcaccatcaccaaaatgtttaaatggtctaaaatttttgggcaataagaaaataatattacatttggttactcattatttatgatattattttctttatcattttccccaatatttatgcgatttcaacacatatgattcgataccgccattttgtatggagcgagcgtgacaagataacaatctacatgaggtcatgagtcattgtcactattcactggaatacatgtgtaaggtgccacaattttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgatagatttcttgagcttgggacacgtagaattgatccgaatgtggttcaactcactacgctccaaacatcaaattggaccacgctgaaacgacaactagaaataattcgaaaggacagcatgacaaataattggagatgacaatgacaaatagttagggagtactcccccatttcatattataagttgtttgacttttttcttggttaaaattctttaaatttgattaagtttatagtaaaaattagcagcatgtacattgctacaatatttgttttgtattgaaaatgttactatttttttctacgaactcggtcaaagttaaaagaagtttgattaaaaaaaatcaaaccaattataatataaagtgtaatagtttatattatacgtaatacaaagtgtaatagtttcactttgttttttttacaagaaaaaaggggcgcaggattgcagcgtgcagctgactctaccggttaaaggcatgtacaaaagcccaagcatcatctctcactcatcagtatgcaaattaaccatatggcaactgcttcgttgagcctcctgatcctctgcctcgccgcgctcgccgcggcggccggcgccgccgccgcggctgctccgccgcgcttgcagtgctttgagcacccgccggacatgaaggccgccggcggcggcgaggccggcgtggtagtccacgacctggcgggctacgaggcctacgtcaccggcgccgcccactccgaccgggccgtcgtcctcgcctccgacgtctacggttagtacgcacatatgattgcctgagctagctaattaattaagcactgatcagttatcactacttccatttcttcattccataatgatgattatggactgatgaaccgctaatttaattttaattgctgctgcatgtgtgattgttaatttggttcaactcctcaggtttccaagcgccgttactgaggtaaattttctttgtcatcctcctctttttctagttttcttttctagcacaaatcatattatttttttattaaaatataatcgtgtgagatcttgctgtaaatatttaattataacaaatacaacggtacgatcagatcgtttatatgataaataatttatgaaaaaaatagtttaaagatacgagaaggaggctaaaataaaatatatggaaatgagatataaagtgtgtagctttgcatgcgtatggatagacacctcttgcactagccaaaaatgcaacaatgtagtaggggagagcatctaatttttcaccataaaatcgagtgtcccatttgtagccacatcgcaatcgcacagaaagaaaattgacacatgaaccgctatagaaagagactgatttaatttctatatagaaagtaatggcgtggaaaatgttcattttttatggtaaactgtttttatttcaattaaatggaagatgcaccaacacgcttgcacaagtttctcattccaattaaattctttttgacaaatcctacttttttttttcttgtacaagtcagaagcaaacacactcacgcacatacagagacacacctatgttggtgagtcctatgagtatctccaacatactatccaaattatacgaattagactttttaaacactcatatagccaactcttcatctaatttgtcaagtcaaattcattactcacttcaacatcctctaagtctgtgacaatgggtcccatatgttgaccttcccacccttcttcacccatcctctctattcttctcttcttcttctctccactccctccacaccgctgccgctccccctttctccacgctgcggccacttcctcggccgagagcagcagccagcagaaccgggaggagctgggagcctaggagcagctgccggcgatggcagagaggatgaaggggaagggaagggtgcctcgagatggccaccctccgtgtcaccaccgcggcattccctggtgcatcagctgctcgtccctagcttcctccacgtcgccgctctgtggggtgacacgtgacggagggagggtgggacggtgatggcgataagggcataaagcaacggtgacgaggatgaacgaaggcggagacggtgcgggggaggaggcagtggaggccgtgggtgcggatgccgcggagcaactgctagtccgttaccatggccacaatggcggctggtctagctggcagagggatgaattaaggagcgatggaggtgggcgctggtctaggcggcgacggggtcagggttggtggtggtctcgggggcagcaacagatggtggtggtggtggtggtggtcatcacctgcggcagcaggaatcggtgtggggcggggcagggcagcagtgggaaccggcggggacggtacttggaagaagtccggtgaggcggcggacctcgtgcgcggctacgacctctttggctggtcagtaggatacttggccacggctgcagtcggctcctaggacgacagtgttgctctggttgatggaggtagagagagaacgtgggaggaggaaaatagacgatagtattgagtgccatatttggccagctagattttttttagataagccatctagacggagagtcttttggagcacttttttttttttgctatgttggctaaaatttagcttgaagagttggatggagagtctcttggagatgctctaaggctgaattcagtgttgaaggttaggaacccttcacctccggcatataaaatggagcggcgaattagcatgtaattaattaagtagtagctaaaaaaacttaaagaatttattaatatgatttttaaagtaactttttatgtattttttttttgaaaaaaacaaatcgtttgacagtttggacaatatgcgcgtgaaaaacgagggattagcaattgggaaaatgttgttctgaacacaccctaagtccctaacacatgtatgtgtgtgtgtttttgctcttatgtgttttctctataacttcggaaaacagaacacatttgcgtgataataatgatgctgacaattacaggcaaatagctgataaagttggtgatgccggatattaattacgtcgtggtacctgatttgtttcatggagatccagcaaccacatctgtgaactttaccgaatggctcgagtctcactctccggtacaattcttctcgatcaccatcttaaaccatcgtttggataggccaaaatttcgaagtcataccccatacaaatggatggggcaactggtccattgaaacgaggctgaagtgatttgtcttacagtactcctgctccgaggaatactccatccgttcaaaaaaaaaaacgtaggatcggatttgtagtactggaaaatattaaatccgatcccaggttagttttttatgtaacgaagggagtaagtagttttggaacacgtgcagtcaatatgagctaattttaatcataaaaaaataaaatcgtttaaaatttaggttcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaagaaggcagcgctcaggaaagctctagacatcctgggtggttagagcagcacgggagaaaaatccaacgctcgggatgttcaacagaacggaaacggcaacagaatacttctcgggtgctggttcttttgcaacacccgggatgtttcagtactacagctcaacattcttcccgtgtgctaaccacacccaggaagtttcagtcctacagttcaccatcacacgggtagtagaaataataagcaatgaaatagaatcggtacaagcactcaaatattcagcaatgtaatacaatcagtgcaagtactaagcataaactgatctgtacaaatgttaataccagatatttgttttagttgcacacatacatattcaaacagccacaaccaatctatggaatacacacaaaagtaatgtttgctccttcacataggtagatttttttcgaacatcataagtaccagttcttgaataatatctgggagtccattggataggtaagaccaaaataacatgaactacatccaaaaatcattgttccagatcttgatgtttggatggatttctgtagcaatgaatcatggctggcaattggacgcacttgatctagatgatggctgaaaaattatagtgtgtcagaaggtgctgataaatattgtatagaatatattgccagataaatattgctatagcatattatgaaagtttaagagtgcacattgttagagattcatgcctagatggattaaaatcacaagcccaaagacaattaacagtacaaatgtcaagcatgccatttgtctaaccaagtggttcctacttgtcctgtacaaagagcccagttagcacaaaccaggaagaagatacataaagaactagattgaactatagctagcaactagatacatgcatcaaatgtagttagtcttacttcttaggtacctatatatgcattttacctatttagattaaactatgtgttatatcttaggcaactgtttacatattgaatgcattcagattatatgctttttcgaagatggaactatctggtaaaaaggtcattaatgttggtataagattgctcgcctaaatagacagtggggcatgttggtataagattgctcgcctaaatagacagtggggcatgttggggccgctggtcgtggaggcaaaacattagctttcatcgcagattgaagcgcctgaaatttatttacacatgacaatgcaaatagttaaatttatacatgttgatgaattttaaaattaataagtacatagaggaggcaaaactacaagttaccagctgtatcgcagatgttaagtaacatgtttcatgttggcaagccttaccatcaatgggttatttcatcaaatcaggacttgcaccatgcttttccttaacaactccaaaataagcttcctggatgataagttgggtgtttattcaaatgggaagagattaaaaagttgctgatcaaattttgtgcaagctagagtgcaactacttacaagcttacccttgacacggtcagtacaatagtcctctccatcttttccattcttccttgcttctgcataagcctcaaatatacccactggcctcttctccttcttctccttcatgaaacaaaataacaattggattattttaatctgtaaaatacatttcaagattttatgccaatatgtgaaaggtgatttaagttaccatgttcttttggaatcggtcaagtgaagcgctgccttgacggtgtgctggcccatccatcatttccctgtataccctaccttcacatgactcttttatccactcttcattacaccaatgcagttccgcacacaatttccatccttccggagtcttttgagcccaccaatacacaaattcagtgacaaaaaattcctcggattagtcaacgagtaaaaagaattcatactacaatgtccacttctgttgttctacgttcagcaaattaaaggcacaaacagtgcactttaatgaaaactagaatatctctctagtgttaagctgaaaaactaaaacaatggcaatacatcgctagtaatcagaagtacaagtcctaacaagtaaaaatctacacggccaagataactaaaatgagaagcataaaaggaagtaaatattagccatatcacaatgcattaaacatgtcaagtttttttaccttgcttatgatctggatgaccaaatcactctctgaacaaaaaaaagtgaacggatatggctgggtgggaacaacctgcaaatcatcaaaatcaagcacattatatgacagaaactgaatcttcattacatcgaacaaaactagagggaactaaactgaggaaaatcagaataaaacataaataccagtgaagccgaggagggtagaggaaggcctggagatggagtatggctcaacctggtggatgatggctgaggtggggatgagctgagtgggggaagaggaggtccaaaggggtgacggcggaggcggcgatggacggtggaggcggcgatggacggcggagacggtgggggaagaggaggattaggcagggaggtgggtggaggagttggtcggcgttggggtctggcgtgggggagttgcgtggaggagttggcctgcggcggtggagcggcggcggcttcgtgcgcaggacggtgacgccgcggagtcacgcgctggcggcgtagttagggatttctcagattggggatttctcgggagagagatggagtccgaaaaaaaaatcgggaaacaaggaataaaaaaaaaatcggcgctctggggggatggagaaaattgcatatctaccatcccataagaatggcttcgctagaataccattatgaaaacaggcttcgctggaataccatcctcaaccagagtgtcttcgccaaaataccatcctggacggaaatgcccctggctcttcttct

SEQ ID NO: 11341 - DNA, 2146 bp, Oryza sativa
cccgggaaagtttaccatcctgctagtggtttttgggtatatgaaaaataatatattcaaatttgtagtgacaaaatctttcatatgatattacctactaaggggtgattttgatcttatacttgcatagcaaaaccttcagtccttgacctggctgagatgcttatggagggtaatggatggtttctgtaggaagctgagggtttccccctctgttttttagaaaattaagatgcatatcaataagtcaaaaggttgaaattgagtcaataagttgatattgatcagcatattcaattgaccattcatggcaggtgaaagaagctgaaaaggctaaatcaatatttgcttttctaagaaacgaaggaaaatcagtcgttggagttggaggatattgttggggtggtgagtcatattgatcaaacacaagaaaatgtatttatgtgtttatactttatatctatatatatcctaatctatgaatattatctaaaaaaatcttaatctatgaatacactcttgaaacttcctatccacattatactatgtttgatagaaattaaagtctctaaaaacatgtttatctggcaggaaagtttgctgtgacggtagcaaaaaccaatgaggtagaagcggttgtcatctctcatccttacgctgtgactgctgatgatatgaaaggtgaagttgaactttttggcgctatgcaatatttatcatttgatctaatctgtattatttactcatattaattattcccgttgataaacagaggttaaatggcccatcgagatccttggaggtcagaatgacacagttacaccaccaagattagtctaccagtatgtgcatgccttgcgtcaaagaaacgatgtgagttcttgtttgatttcgttgagcatgtttttgtctcgttacctttttttctcggataaaatcttcattttccactaaaagttgacacgatttctaatttgtccatcatcctctcaatcacatataggttaaatccacgtgttgatgactcatcgtgaataaataagggatttttttaaataaatcggcacatgcagcaaatttcattgaatagagaaggaaaaaaaaacttatgtatgttataataagggattgaaagctctgaacaactgaaactgaaatatttggcaagttaacgaggcgatcaatgtacaaggcacttgtaaatcaattaaaaaactgtggctttgacccaatttcttcttctagcatatacggtacagagtaacacaatgatattgttgttgttgcagattgatttctacgccaagatttttccaggagtttcccatggatttgccggtcgatataacaccagcgacccgtttgctgtcgaaaccgggaaacaagctctcgccttaatgctggactggtttcagaaacacttgaagtgatgaaacttaataaatactacatgaaagaacatgcaaatgtttcttcagaataaattaccggtgtccatgtacaaatttgcataaacagccatgcatgcaggctgaatacaatgagtgtctgcaatctggtggcttggacccagaatttggttgctaatttctttatacccactcaatgcctgttgggctttactgtttttccaatgatggaataaaaaaataccggccattgtttaaagagctacaaccatttattaaaaaaaaatcactcaataatgagtaccatcactttcttctcttaatttcaccattatagtagaggtagaatcctaatttggctccgccgctctacaacgcaatagactaatattgatagctagatttagtgccaattacacaagtcaacacgctcaattcctttagcacgactagtacttgtttactcctatactatagtctagctatctattatttatttattttatttattatcatattattattattattattatttattatattataaatatatcaaatccgatgatccaaaatcatctaatccaacatccaggatttacaaagccgattggtttgcgtggtttcttgatgtttcgacaaggctcagaattaattttcggttgaaattttgaatgctttcgcatagattcaaatgttacacagtaaatttggtcaaaattaggtcggaattcgtc

SEQ ID NO: 11342 - DNA, 25291 bp, Oryza sativa
atttcatgatattcattgcagctgataaatgcctcattatttttggagctaatttcttaatatcgtgttgattcatctttgttcctttagttttttcatggattgccatcggaaccttgtagcttataccctgtcatcggaaccttgtaggactatatacctttgtacatattgatcttccatatgcattggtttgttgagtataaacacaatctagatgaatatgtttcctgacaattgtttttcatttagaaaggaccaaatatgctaaaactattcactaaaatggtcaaacagaagaattccactgtcacactgcactttcaaaagtttttactcatactggatttgattctctttgtgttccttcagtattttgcaagattggcgacgccaaccgcgccgtgacctccccaaatcacgcagctgtcgctctcctcccacatcgccgttccctacgccggtcaggatctcccccgtcgtcgccacgcacaaccacctgaggcgctccctccgatatcggaataccctgcgcctcccctctctttccatcagtcacccaccgaagatcttctgccaacaaagtgctgccgtccgccgctatctttcaccaacgctgcgcggcgttcagcctctgcaaacgattgccaagaaggccttgccgccttccctccgattgagtgctcaatctgcatcgacacggtggtctacggaaaggctgtggtgcggtcacgagttccaactcggtgagcagctttctagccctccttgcaattttttagtccttacaaatcttaggctgacattgccgtgatacatttattcaaacctgatcgtttagtttattttgttctccttttgcattggatcaatgtgattacccttcataatttgggagcggctgcgttatacgggagcatgataacagatgctatgaatcatcctaatattaaattatcgatggctattatgcatctgtttaaaagtgactgaaatagagataaaatagtgaataaaaatgaatatatactttctgtttaattttcctccctcccactatagcatacatcagtgagaattcctaatgcttaccaattgctgcatcttgattgcaagctccaggaaaaaatattcgtcatgattattgtgtcagggggagaagtctcggtttattatgtgttttgtatgagcccagtgcaaggggatctacattgttctggattttgttttggtttcaattttgctggtcctactacgtgtgcatatatagacagaaagccttgacgggacataccaaattcaaaaactcagaaggaatcaccttgcgcttgtgcctaattgctccaaagtataaggttggcacaaatagtggcccgatttttagttcactgatttttatgctttcccaatgttgcggttaggctattactgtgtttgaggaaattccttcatatagttttatatgttccgtatattttgaaatttatgcccatagagcaccctaattttgttgacgtgatcagacaataaaaaaggcaccatgacagctatggtggataatgtcatttagtaacacagggcaatgtgttgtaaataataatgggaatggtttgtatcatttgtttcttctatgctcaagatcctggactgttatgcatgtatcatttgttgcccctcgagtcagattatttgacgtggatactttagtactttggatcaaagaattagggtatttatattgtacatagctaacaattgcatatactacctccgttttttaatagatgacgccgttgactttttctcacatgttcgaccattcgtcttattcaaaaaatttacgtaattataatttactttgttatgagttgttttatcactcatagtaccataagtgtgatttatatcttatacatttgcataaattttttgaataagataaatggtcaaacatgtgagaaatagtcaacggcgtcatctattaaaaaacggagggagtattattttcccgttgcaatgtatgggcacctaaccagggtcaggacattttctcatgtttgtagtcatgatcaaatcgctcataaaacatatgcgtgctgtatttatactccgtgtgtgtaagctgaatgttcaaagaacatgtgcatcttaacgctttatataatattagggtagttatttacctgcagggtatagggtatattctatatatgtccggcatgaattgaattaaagcttaattgcacatatcatagaaattttttttgataataggaaaatttaaaagttattaaagataaatagaattacactgtagcgtttagcacgggcatattactagtaatagttttcaattttcattcattattattgttaatagtgctatgttagtactatactagtcaagaggtggtctaataatcttttgcattcttgttgtgtgtggttcaggttcaggttcaggggcatctctcctcttttctttcccttgccgccattagcccaagcagctatctggattctggagagttgttctctggtactagttctctagcgcacgaacaacatccgcgacgaagcgcatccatggcagtggcaccgacgagagcggaggcactgtccctcttccggtccctcctccgcacggcaaggcagttctctgactacaacatccgcgagtacacgcgccgccgcgccgcggacgccttccgtgagaaccgtgccctcggcgacacggctgccgcggcggcagcattcgcggacgggaagaagcagctggaggtggcaaagcggcaggcggtggtgtactctctgtacgccccaaaggccaagagcatcatggagatgaagttgcagtgatcgacgcgagaggtttcgtgctctcttgcttgctgtcctcttactcaggatttctttctgctctgtttctaaagttatgtgataggttcgaggaaaattggtgcaatcaaagctgagatgttatcatgtttgctggataattgccatgacatggttgctatgagttgaataaatcagtcaattccacgattttggtctcttgtgttcaacataccattacctgttaactgtggttggattggtgccgattgcagcacttcgaccagggctcctcgttgctgctggggtccctcgtcctgttgccggcttgcagccaccagtcaccgttgctggtggtggtgccttgtacctgctgctctccgtcctgatggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcacccgttggctaaatcgctaaacacaaggtcttgctttcatgctcgactggtttgttcagaataaattcctggtccatgtaaaaatttgcattaacaaccttgcaggctgaataagtactgttagccatctgcttagtttttttttcacatcttttcttatttgtggtccacagtacagataattttattttgaattctatttaagattaaatttattcatcaaaaactacgattctaaaacgtggcctgtaaagtggttctcgtaaatattctttcatgcattgcagattgagtatatcattcttcactaatctactagacgcgcgaaaccagcttataacaaacacgtctcatgtgtctgaaatggcgtcctaacgtttactgtaatatacttcaatgattcatcaggtatacaatcagcatcacaaaataatttgtatcgcttaattaattacgatgtttcgaatggtggctgtcggtaacttacagaagcatgcatgacttctgattattgttggtactagtagagaaaacaagacggcatcctcactctaaccgtgtaaaattttttttaattcagtgctaaatgtcaacagatgacatatatgccatcaatgaggaacgttcaatgctctccccaagatttataagtctggtgcagatatagttttcttaccgagggaatatatatacacttcgtcttgaaaatgtatcaaatatcactaaaaacattagaaacaaatacttttagtaatattacacatctacacgtaaagtcacatctttaaattcatgatatataaagagaaaaatacaaaattcagatagacttatagccttaaaactgttaaatatttttgttatgtctaaactataatgactatggggttaaaattttcattataggtgtgtaatactactgaaagtatatgcacaatttttttctagaatttattgtgatatttgttagttggtatacacggagtatgcacatgaatcttatatgtagatgttatgttcccatccatctattatgatatataagcatttgttggttgtttagaaaagattaaggtttataagaaaagactttggtgcatcttattaaataagggagggtaagggtgagagagttcttggcagtagtattcgtgctacaagtgattatattttgatataagttttgcaggaggaaagacctaatcatcatttcattactgtcaaatgactacatattatatgattctggtttaagaaatagcatatgacaaggaggaagcaggtagaggccgatagaaaatgcaaacgttaaaaagtatatatagctgtatatctatagttggtggagatgctagctagaacactactaagaaaaccatttctgcagacgaaacccttctatttttcagacggatgtttattttgaaccgtatatacatcctcttatgaaatgcttattgctttctcgcaagtacaaaacggtacggtgtcaattaatccttggttgatatcaacggagctatggatcgattacaattaatggcgctctgatgtgtgtgaaccactataatgtgtaaattaaattgagaacattttttttctgaattacacagtgcaacacagacactcacaatgcacgcacactcatgcacccctataaacgcacgcaagcaaaccctacccctatgagaatcttcgaagactgggccgataaatcctagaaattgacgaagtcaccataggcgcctcgacagggccagtaaatcctgtcgacgggtacatcacctaccacactgaaagcacaaagtcattaaatcctagaaaatttgctcccacggggagtcaaagccaggaccttaggtactactgaggctcttgtaaccactagactagaagctcttttcctttaattaagaacatttaattcaattcaaagtaatagaaaaacacgtgtacattgtcaaaatgaaaaatataaactatagctctgatgatctcactccaagtccgtcccgtttgcctatatagttagcaacgagctgctctctcagtattactaccgaacgattaaagccacgtaaagaaaacaaaaatccaaggtatctcggtagagccaattcttgcatgagaaccatggcatgggcgttgttactcagcctcgccgtgctcgccgccgctgcggctgctgctccaacgcactcccagtgcctcgacaacccgccggacttgacagccggcggaggtgaggccggcgtggtcgtacatgacctggcaggcttcgaggcctatgtcactggtgccgtccattccaccaaggctgtcctccttgcctccgacgttttcggtgagtgcatgtctaggattatgattcagggtttaaaatttaggtccgtgtttagattcaaacttttttcttcaaactttcaattttttccgtcacattaaatgtttggatacatgtatggagcattaaatgtggacgaaaaaaaccaattacacagtttgcatgtaaatcgtgagacgaatctttcgagcctaattacgtcatgatttgacaatgtgatgctacagtaaacatttactaatgacagattaattatgcttaatagattcgtctcgcagtttacaggaggaatctgtaatttgttttgttattagtctacgtttaatacttcaaatatgtgcccatatacttaaaaaatttttggcacacgaactaaacacagcctaggttttaaattttcaaaattttggaacccccccaaaaaagtaaaaagactaaattatttcgcccaaaaatttcaaatatttttagtttgtatgaatttagtaaagcttattcaatttcggtcaaaaaaatgtttaaatttcaaataattttgttctattcaaaccctatgatgattagggatgaaaatggttcggaaagttaccggattctggacatgttttcggaaacggaaagtgccggtcggaattttttctgaaactttcagaaacgggaacgaattcggatttttttttgaaacggaaacgaatatgataaggttgctatcatcagaaactttctggaaatgaattcaaattttctctcggaatcgggaacagagtatttctcatgtacaactaattagcttcagctatctcctcttaatatttagatttatactatgtattgaggtgcttaattaaatagaaatattttttgttgtctagtactttagatttcttttggctaatgttttttttttagtttttattaggtcatgtcatacttcttatagttatagatgaatatagtttcttttctaaaaaagtaaagtgtacaactagttgtattattactattgataaaaaaaaatagaaatgtcgatttgttgttttagaaaaaaatatttaactacatctattcgtcgtcgatttgagaagttcagtttaagagctttttatattccaataaatatccataccgtatttgctccgattcgtatttgcttcattttcgtatttgattctgttttcgtatccggagtttctgattctgatttcgaaaaataaatatggaaacgaaaacgataaatgttgtttccgtaccattttcatccctagccgtgattcatgagtagcctactgatcagtcactgccatttctctatttgataaacgtttataatattggctcctgcatgcatcgttgttgatcgagttggtttcttcaggatttgaagcgcctttgctgaggtacacttcgtccttattttctttatctctttgtcttgttcttccgtagttgttcttccattgccggtctacatcgttgtcatgatcatgtttcatagttgttctcgtttcctccatattttttttcccgacaacagtaccgaaaggaaatcgacaaatgaacaactaccctggaaagagactgaattttacaaatcaatagcgtggataactggtgatcttctatatatgttcttacttttaaaaaaatgataggatctttagtcaactgccaactctcttcgtctttctatagtgagtttgttacttgtgataaaatcaacataatatcaacaatattgtgtatcatccgtccattttaaatcgttatccgtgccgattgagtagcctcatatatatatccaaacatatatttatcggtttgggttcacgaaccggcacagatggtatggttccaggagcatctcacggggacttggtaattaaggtcgatgttttattctgaatttaaacaaaaaatgaatattgtgcctatccaaattatactttttccagaataaattttaataacattcaattaattacaacaataatacgtcattacatgtatagtcattaattaattataatccattaaacattacatcacatatacgtcattacaagtcgtactttttgtcgttacaagaaaccaacagctattttttgttgaacaacttgacaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccatttgtaatatatatgcgtcgcaaggagatatatacctcttcaacccatgagatataagtacttgttcctgaaggagaaattatgtgcaaaacatcgtaattttatctatcttgcagagagaggacaaaaaatgcaatacttttcacataataaagctctatgtgaataattaattgtgtgcgagacatacaaaataaatatagagcgaagaagagctttgaaaattcccatttcttcttaaaaaaaaactgcaaaatctcaacccgttgagcaacagggttccctgcatgctctacacttctactcaagcttgtccataattataagggggtttggtgaactgttttgaggccatatctttatcagtgccgcttcttgctgtgtggagggcgcgggctggtatatggtgggaaaacccttatcagcgatgtgttttgttcgactaatacccataggacggtataattgcgctgttttgttgcattgaattccactgaatatatcgtgaattatgatccagtagtagatccggaaacaccttaaaagcatatgtgtgataatgatgctgaaaattacaggaaaatagctgacaaagttggtcaagcaggatattatgtcgctgtacctgatttcttccacggagatccttacacattagacctgaaccttacggaatggttcagcaaacattctccggtaattcgtttcaccgtcttatgcaatttgattttatattccatagaacattaattacctagtaatcgtgatcgttcagatgaaaattctcagctcctgcacctatcaggatgcacaaattaagccgcaaattaagcaaaactatatccaaagtacttaacctatactagctagatgctaattatcaagaactcaataagttgattttgaccagtatatatgaattgatcctgcaggtaaaagcagctgaagatgctaaagcaatcttttctgatctaagaaagaaagggatatctgttatttggagttggaggttactgttggggtggtgagtgatattaatcaacataaagaagaagcacattaatttgtgcatttataattatactactacatctatcagtggtgtatcttaaaaataaaaagagcccaagtaaacttatttgctataaaaactctgtttcaatcttctaatatataatttcaatggattcagcaatgagcctgggcagccgcctgaggttgctagggacaaaaaaaatgtttgcagtcacgaataacaacatactccctccataaaaaaaaaccaatctagtattggatgagatgttttctagtccaacgaagacatgagtctgtccagattcatattctaaggatacactctgaaccttcctgatctcctctccacattgaacaaacagagatctgattcatattaaagtctctcaaaggcaagttttaactggcagggaagtttgccgtggaggtagcaaaaaccaacgaggttgaagcgattgtcaccacccatcctggattggtgactgtcgatgacattaaaggttgatattctttctttgttgctgttgctgaaatatgcatgtatcatctgatctagctatagggttgcacaggaatatatagccattgttttcttattccaaagttcgccgtgacatttcacgcagaggtcaaatgccccattgagatcattggagctcagaacgacacactgacaccaccaaaattagtgtaccagtatgttcaggccttgcgtcatagaactgatcgggtgagttcccctgttataatttcgtttacagttgatatagcaaatgcatcagcatatatagctctatttgccttgcaatttgttatcctttttgtttttcagataagataatttaatttgcacatatacatgaagcacaggattcaatagaccggaagagtgagaacacttgaactgaaaaactaattaagtctattttctgaaaggaaatgagactgtagacacacaagagaattttccacggatgatgatatgataaaagatcatgctggctatattttccttttgagggaatgctggctctaattgctggtcaacatctggcaaaagttagagctgatacaatagcataaaaatcaaaagatttactagcatattgtaaacgggaaccgagaaataacaatagtatatgattaattaaatattaactattacaaaattaaaatatatttatttaatttttaaagaaacgtatacacatatatatatatatatataaaattttctaaaaaagacaccgttcactgtttcgtggtttaaaaaatagtcacagtaaacaagtgagttgcataagcgaaacgaggaaaataactcacccaaaatctaatccacaaaagctaggccatcatttggggcactgcatgtggctttaatcctatacctattcctttctctccttttttgcaagaagaacatatttttctttaaaacattcatcaaatatttcaataacaaatctttgcaaagaaatatattattcattagcaaaaaatgaacgttagaaataaccttttgttcattaattattgaagattgattactttgccaaggtcttccaaggagtgaaccatggatttgcttgcagatataacgccagcaacccattcgaggtcaaaaaagccgagcaagctcttgatttaatggtcgattggtttcacaaacacttgaaatgaagacaaggatcagctaatcatgcatgcaaggccacgactataatttcgtcaaaataaatttccgatgtccatacgtttaaaaattgcataatgagccatgcatcagttgatgtataggttatattgttggttgtaattttttaggatatatgtaaaactcaattaaaagcaacgtgtgcgggttagtgaattattatattggctaaaaagttacatggatatataacatattttagcagctttggtaatctctgtaacatttgtatatatatattaccaaccacagactgcaattattcctatgaagtagctcccaagtcaagccatgcatgtaaccaagaaagattaatttttttaataatagattaaataaaacccggcctctacatctatagaaggatgtacacaaatatggtattacatcaccaaacacttaggcttatactctccatcccaaaatataaggcacaaccacttttctctcatgtctcataatgtaaggcgtgcatgcatgcatacattaactagtatctcttggtcctataaaatttatttgttttaaatcttatactatcatcaaacctcccaatcactcccaatcacattgcttgcattcatcaaggtgatccaactaagaaagtgattaaatgttttcttggtctttgtgttatgggtggttatgccttatattttaggatggatcgagggagtaaacaagttcaaaagcaaacaccaccataggagacaaagagacaacaaagacatccagatcaagtctcacaacaaaaaatttcaactaacaattcaatcttcctctacaattccacctagattttgaataaaattccataacagtatcaagaaagattgataagccgtttgatttcatatatcatgttccaacccatcccagctcaatcatcccctctccaatatgctactgttgacaaccagcccagtccaactaatatgtgtgagatgcttgatttagaagcaggctgtaagaatctaggggttcaatttctcagcttctgacttctaggtagattttggattttacaactatagatcttcacatgcactcacatgcattcccagttcctcagtgaacagcgtgagctagctagcagtgttcaatctttcattttcggtatttgtatcgggggtgtcaacatggcgatatttccgaaattttagaaattccagtctaaaattttgaacaaaatagtcatatttgaacaaatattgtcaaaattcacgaaaaattaaaaagtttcagtcgaaataatatcgtatgggggttccaataggaccaaaatttcggaaattttgttacgaaattttgaaccctggagctagcaacaggagcaatccatggttcccacaaataaatgaagcaacacaggtgtgtcctccactatttcagaacaagatatcttaaccccttattatcagtgtcagtttgtataaaactggcataaaagaacatcaccaccaattggtttttatcatgataaaaactaaattactagtgggttttatcatgcaccacaagtgacaattatttaaaatatttgcatccatgctcctggccatcaaattggctatagatcatcaatgcctcctctctctgtctcccatgaaacaccagtgcaatgtttcttgagaataattagggcgtgtttggttaagtgtcaacaatccgggcacatatgcttactgatcgaactcccatgtgcgcatgcgtgcactgttatattgatggatacatcgacgataaaccaagcattaacttttggcgaaccggatgcactaccaaaaagtccagcaatttggccataggcctgcagcttccaagttcttcgctttgactttgcacaataattgatgattgcgtaggtagtaaaattcacaaattttatgagggaagaaatttaaatgacccaataaccatttctctttgtaatcctgcctccgtacctatataagatggacatggagcccttaaataacatggccaaaactcgatcgtcatatcaatacaacaccagacggatacaatatctaaatatgaatagggtaatacttctcatcgagaatgcctcaacctttctaaatttgtgtccctttacttactcattttagatctcgtgataccccttcttactaccgatttatagaatcaacaaggtcaactactataaattaaacatgatgttgaactcataaccgctgggcttgtggactgtcatagactgatgtaaacctatatgcgtggaaggaattcagcctcatagaagtattctcaagttgaaatttaaaatctccaaatttcaaagagatggtccttgtttgattgtccctaagttttcacttaatctttctcaggcctccacgttttgctcaacaaggtcaactactataaattaaacatgatgttgaattcataaccgctgggcttgtggactgtcatagactgatgtaaacctatatgcgtggaaggaattcagcctcatagaaaagggcacgtattctcaagttgaaatttaaaatctccaaatttcaaagagatggtccttgtttgattgtccctaagttttcacttaatctttctcaggcctccacgttttgctcacattgcctcaaattattcggttatgaaaagagtatgaacgaatgcgggaggtcgaactacttgatgaacaagttttattttttcataattgcactattcattttgagaagatcatatatattctttttgatgagcttctttcaaaatagaataaaaaggtcaaaagtacccaaattatctaatcttcgtgtgattttgccttcagaattgaaactgaaatatattttttctgaaagtacttgattaaattagaacaaatttatgagggaggtgaatttgcccattcaccatttctttttatatttttacaagattttttaaactaaaatttcaatttttctaatgaacttaaaatatggttgaaattattcctactaaacattaaaatttaatttcaattattatcatgtttaaaaatttcaatcacttgaacattttcacaccctttgacaattaaaatcaagaagaaaaaaatatccctagtgagatttttaactttgtgttaggaggcagagatgaccttttttataagaaacaaattacaaacgtagagataataatcattttgagagagagaaatgctacctctgtttgaaaaaaataagggtacactttattttgttgggacaaactttgaccaatacttattctttcatggtataaattttagagtaagttttacaaaactacaaataatttgatcaaactatcacaaaactacatatttaaatataggtatcacaaaactacagatttaacaccaaggatattacaaaactacagatttaaaacttcattaaaaaactacatatttagtgatgaaattatcaaagaactacaaattttagagtttatatcgtagaacaattgaggttacaaaagttgtagttttgtgataaatctatgttaaatctgtagtttctgatataatacaatcaatctgtagttttgtgatagtttgatcaaaatacatacagttttgtgaaatttaatctaatttctatgatacaaagttaatgttgctaaaattttttaaaggaaacaaaatgaaaatttaggaatatttaatttaattaacagtgaaaaaaaacattgaacatgggattgattaattaaaaactgatcaatataacgaaaggcacacaaaaaaatttttctcaccttaaattcaattcaaaatgtcaacaggcagcgggaactgggtgtgacattaaacaagaaactgagggcaatgtgctacctaacctaaggctaaaggccataaacaaactacaaatgccccagcaactatcgattcgatgcctcatatgtatcgtcaaaactcgatagttggaaaaccatggcaccagcgttgctctacccgaccatcctcttcctcgcagcggccgccgtcggcgccgccgctccgccgcactcgcagtgtctcgacaacccgccggacctgacgacggccggtggcggcggcgaggccggcgtggtcgtccacgatcttggaggattcgaggcctacgtcaccggcgccgtccattccaggcggaccatcctcttggccaccgacatcttcggttagtgcatgcctgcctgagctgccagcttatctgtctttgaaatattctttgatgatatattgtggattcatttattactaaccattaattaatcttgaattcttgctgttgcatgtgagtggttgcgtggttgttaattgtgggtctctacttcaggattcgaagcgccattgctgaggtacaatcttcttcttcgtttgtataatagggaaattgctgtatgtacgataaacttgttatgattttggtacgatccagtcatgcatcgtacacttgcatgaacattagcattcaattgtcatgcaagttacaacaatagaaaggtgactatggttattttgaagggatcggatatggtttttggtcaactctctctgtcttttttatagtgatctccagttatttgtgacttgcgagaaattaagtcacacataatattcaatattactgattatatatctgcatgatttatcagtataagacttggatggcgacaggccactcctgtatcgagaatcattatgtactactccctctgttccatattataagtcatttgatatttttctcagtgaaactattttaagtttaatcaaatttatagaagaatatactaatatttttaatacaaaacaaattaacatattaccaaaatatatttaatgttaaatttaatgaaactaatttagtattgtaggtgttgctaactttttctataaatttggtcaaaactaaagaactttgagtaagaaaagagtaaaacaactaaaaatatgaaacaaagagagtagtaaatatcgatatatatgccaagatactctaacgtcctattattcctatataatacacatctatctattatattattaaaggaatagaaaaaggagcctctacgttggctcacattaatcggagaaaaagaaaaagtagaatccatataaaaatataatttagaaatagctgaaattcggaattaaaaaataaggaatatagaagttgagtctagagtccatatagaaatacaattaggaaataactgaaattcagaattaaaaataaggaatattagaagtagagtatagagtccatatagaaatacaattaggaaataactgaaattcagaattaaaaataaggaatattaaaagtagagtatagagtccatatagaaatacaattaggaaataactgaaattcagaattaaaaataaggaatattagaagtagagtatagagtccatatagaaatacaattaagaaaaaaatagaaatttggaattaaaaaataaggaatattagaagtagagtatagagtccatataggaatttaaaactaactaaaatttggaataaacataataaaattaaaagtagagtttagagttcgtataaagatacaatttacaaataactaaaattccaaattaagaaaaacatgggaagaagagtttaaaatcaatataggagtacaatttagaagtaactaaaattcgaaattaaaaattaaagaatactaaaagatgagtttagagtccacatagaaatacaattagaaataataaaaatttaaaaataaaaataaataatattggaagaagagcatagagtctatatagaaatacaatttacagaaaattcggaattaaaaaaaagaaaatattaaaagataagtctagagtccatataggaatatatataatttacaaataactaaagtttgatattaaaaataattaataactaacacgtatataaaatataatataaatattacccattagtagttttgtaaagttattgcaaaatttaaaattatgttctcattttaatatatttgaataatataatgaggaaacatatatgctattatatgagagaaaatataatgatactacccgcgcaatctgtgcaggccactgtgctagttttgagagtaatttcttagggttttcaatatgttatccctacatggagatgatcagcagcatagcgacatatatatattggaattgtttcatattctatcctcctacagctaatctctactacttaaaaataagtagaagacatttccgttgtccgtaccgataaaaaccacgcgaaaaaaaggtttccgcatgtaaaagaagcaaaaaaaaaaaagtgtgaaaaaagtttctgcccgattaaaaaaaatcatctgtataaaccgttatccaaaaaaaaaaaacaatgttagtgggaaaaaaagttccgtcgtcgatactggaaaaaggaaaaaacgtgcaaagaaaaggtttccatcttccgtaaaaaagagtaaaaagtagtgcgaaaatttttttgttccgattcttaaaaaaaaaacccttctcccataaaaaaggaaaaaattatagtgcgaaaaaaaaagtttcgttccgattctaaaaacaaagtccgtataaaccggtcatcagaaaaaaaaagattagtgtccgattctaaaaaaacgggttacttttccaaaaattcctaaaaaaaataggttggcagaaaaaaaatgttcctcacaccgttaaaaaaaaagtccgattctagttaaagaaactggttcgacattttcagcttttccaaaaattcctcaaagtatatttgaaaatttaaaagcaaattcaattttccccttttgaataattcttttattcattcaaattatcatatatcaaaatccacctaaacatgtcaaaatttatataaaccgcgtgaggaaaaaacatcaccatttataaaataaccgatttgaaaaaactgtctgactcaacgtgagaaaaacgccaccttttataaaagaatctggtttggcaccatgcaatgcgaaaaaactgtctaaatttagaaagaaaaaacatccaattccgtgaaaaggattcgtaacatttgtattgttcatcgtctaccacgtcggtttggtttttttaaagcgtaggtcgaattctgacatctggaactaagacaagtcttgcttcggttttttttttctgagaacgagatcaaattaatggacgtttgggttagataggatccatcgattttttccatctacacggcttctctttcctcatctattctcttgtattgatagccctgcatgtctgtgtaggcaattatcatactaccatagctactattctttataacatattatatggaaataatattaaaaataaatatgtttttaattgatatttagagaagagtgcacgtggctctattttgtgtagacttaatcatgcgaggcaatataggatttgattgatcctaattttgattgcaagaataagactgaaaagtattaattttagatttttatgcatgttgttagatgaacaatccaattcttttgggtaaagcaaaacattggtaaggttgccagcaccgaggttgggccattgatttaagatgttccagttttctttatgatatgttaaaaatattatcattgacactatgatatgacattcactgctacgggatgggtttttccgtgcggtcaaaaaaaatatccacgtgcggatgaatggcccgcacgcaacacttcgtctgcgaaagtcatgatttttgcgtgcgggtggccctcccacacgcgaaaatcggatttttccgtgcggttgcttatgtcgctcgcacagaaaaataaaaatccagaaaaaaataaaattcacaaattaccgaaccctaaccctagatccgccactccccgccgtcaccgctggccggctccaggcgggggactgtgtcgccgcgagatccgtgcggagtgcagccgccacagccggatgacggatcctggcgtgggaagggcggtgccgctcctggccgccttctcctcgtcgtcggcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgtgcctgcaccgccgtcgtgtggagctgaggccgatgccgaccgccgttgtcgttgccatcgcccgcgcgccaaaaggagacgaggggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagatacgcacgggaaaatcggctcattttcccgtgcggtccgtttaggaggaccgcacgagaaaatcgattttcccatacgggcaacagcccagccccggttcccctatttttccgtgcagttccacttaagaactgcatggaaataaaagggggtaacgtccacgaaaatctatcgtttagtagtgattatcatgaaaagtgtcagggttatggataagatataccctctacccttggatacacgttgtatactgatacggtatacccgcgcctatacggatatttcctatgtacgttaaggaaattcgtcacgagatagatgcggaatccacagatagaaggagtcctactcagacagaactgggtcgttactgtatcgtgtggggtccgatgtctccgagttctacttggagaccaactgacctgcggtataaaaaggaccaccccgggaggacctaagacatcaaatcttaccgccaacacatccaccacagcctacaaagccggagcctacgggagccaagtcgccgggtgatttagttgaaccaactcgactacgatctcgtcggtatcattgagttccactattccctttctaatatgtgattttcattatataatcccatatcactggattagagctattacctatcaaggggcctgaaccaatataatccctgtttcctgtttgcttgatgtcgtactacgtagatcctcatatcagcgtaccccaataccctctatatccggtctacgggtatcccccgtcgacaaaaagcatatattgttattagaatttttcacccgttataacgcacgggcatatttgctagtaatataaatataccaagaggttcaaatataccatttaatagtgtggtaatcatggtttaatatctttaactagtacttagatagcacatataattggacagcaatttaaaatgggcgagtatatgcgccatgataagaattccatattgtgcttacttaaactaaaatatgtttttcatgacacatatactattgtacatcattgtatagtgtgcacatctgcttagggacaattaatatatgtaagattgtgaacccaatgttaattcagaacttattatgtgatcttccattgccaggttgtacgtcaagctatttctccatggcttgcagaaactctgtttatctgccagtactttattttaattttacatttgaaaacaatgtaaaagcagatgtttgattataaggttgctgacaatttcaggaaaatagctgataaagttggtctagccggatattacgtcgttgtgcctgatttgttccatggacaaccctacacatttgaccagaaccgtacagaatggctcagtgctcattctccggtaattcatttcaccatattaattaatttgatctaatattcccctgtaactttaccttgaaatcgtgatatatgattgagacgatagagtaaaagaaaactcgacagctgcaccaaggatatacacaaagccacaaaacaaaactttatcccaaaaatgtaacttatgcgggatgcttataaagataatatgttaaagttctaagaaaagataatatataaacagttataaacgattcaagataataaattaaagttctaaagaaagaatatataattaatattgacaagcattttcaattgatcttgcaggtaaaagcagctgaagatgctaaaccaatctttgctgctctaagcaaggaagggaaatctattgttggagttggaggttactgttggggcggtgagtcacatctatcaatcaatataagaaaatgtagttgtaatatcctgaacttaatggtcaaaatctttgatatggaattccagaatatataattcctaaccccatatattcaacaagcagttatttaattcatattgaagtctctgaaaacaaatttgttttactgacagggaagttcgcagtggaggtagcaaaaactaacgaggttgaagcaattgtcatctcccatcctgcagcggtgactgctgatgacatgaaaggtgaactttctttcttttgttgcgctgttcgttgttacaatagaaaatagctaataattgttttcttattccaagctctccttgattaattaacagaggtcaaatggcccattgagatccttggagctcagaatgacacagttacaccaccaagattagtttaccagtttgttcatgccttgcgtcaaagaactgatcaggtgagttcctgttgattttattgacggttggtcccaaatacatccatgttttttacttctaaactccatctcgctcttcaaatacttgttactggattctatttactctctttgttctaaaataaacaaaccttagataaaataagtctttacctattacaacgaatttaaacaggcaattgttcagatttgttgaataggtaaaagctcatcctatttaatatttgtttattttaggatggaagaagtagtttttgacgttgaccattcatcctatttgcaaaaataattatattacatattaacgatgtgtgttctgccataatacaactacataagttaacttcattaatctttaaaaagttattaatctgaaaaaatgatagtcaatagcgacaagcaaaataatagtttctaaatacaagttgcatgtacaaaacacacaagctagctctcactaactgaaactgaaccagtgtttaatatgctaaaaaaattgcaactgtaaacataaaagagaattaatttttactgatgatgagatgttaaaagaccttgctagctctatttgcatttttttttgagaaagaatgctagctccaatttggaagaataagtgctataacattgcatattacttccttcgttccaaaataaaaaggcaaaatcatacctttttatgttgtagttaacaatcatctccatcttccctaaatttgtttttttcaatcctccaccccaagatctttaatcacattagatgcatgcatcgtattatattgaggtaatccaaatgagaaggtgataatattttttttcttggttttcgtgttagtggtggtttgtaccttatatttttatattttatgattgcgggaataatatattatgttttataactaaataacctcttatatatgagttattgttgcagattgattattttgccaaggtctttcaaggagtgaaccatggcttcgcttgcaggtataacgccagcaaccctttcgaggtcaaaaaagctgagcaagcacttgcgttaatgcttgactggtttcacaaacacttgaaatgaagattgctaattaatcatgctaggaagaccagtgcaattatttcatcgaaataaaactctcgttctcgatataaaagtttgcatatcaagcagccatgcatttgatgtacactattttctttaaattatatggagtgaattaatagtatgttgtcgagttgatgttcgttatttatctataaataattatacggatgtacttgtgccattgatgttcattgctggctataaattacatgtggatgtacaactcaattttcacaagggtactatatatatactttagcaaaaccatcaaatttattacaaaactgtacaattatgccacagcatcagcaacctatatatttaaatcacaatttataacaaatttccatgtcacaaagtttcaatcctagcattgttatcctgatgaaactttcagaatctctagctttgtgatatgaaaaaaaaaagtttatgtagttttgtgatatattgtatcttaaaattttcttttaaaaaataataataataaagatactgtggatttacatgtgcaatttaaaatagctttattgaaatatatataattttacaaaatttactcactttaatttatatcaacttgtaatcagtatatttctaacaattaggccatgaataattgaaagggttgaaaagctaactatatattaccccatttatttcgttgggccttgggccattcatgagtaataacaataacagtagcaaaacatacagcaatgcatggcaataataataccaattaactttctaaaaaaataataataccaattagaagtctgtacgtatgcttacaaacttgtacgtataagttcgaaacaaatttaaaatgcaaatgaaaaaatagactttgatttgcattttcctaatatgaactttaattgcgaatcagcactctcgtcgctctgcatgcgtttccagtcgagatcggccccaggcatgcggccgttctctctcatgtgtgtagctcaaaatagaaagatcatatgccgaaaataaaaatctagccaaaaacagaaagatagatcaatctagtgagagacgatggctgagcggttcccaataatgtttttgccttttgtggtggtgtaatcaacggttgggcgcactctcctcaacccgtggcccgcgggacacgtgtcaaccaagtccactactattcctgcatacgtatgtataaactttatatacgtatgtataaactttgtatatatgtgtatataaagtttatacatatgctatcgagtgggccaacgagatggtatcgacgcctcagacaaccgccggcagtgtgcctagccatggcaccgggtgatggggacgatggcgagacgaatgccaagaatgcataaaacttttactagggaagccaaacctaccccttgcaatctggcatgccgggccgctcataggccaagcagcggcacgtagacaagctagacgtagcggagaagaatattgcacggacggggatacaagtttgtctcgcggcgagttgcccccctccccccccccccgggatgatgagatagtggtgcttgaggccttatgtgcagcgagcttcgagtccaccatggcttcgttggtggtgggtgtgctcgacttcttccttgttgtcgagctcctaatactgacagccaacgccatggctcacatcgccatctatgagtgaaacatgtgggtggacaccaggcaaggctccgtgaagcacttttccaccctccaattag

SEQ ID NO: 11343 - DNA, 11648 bp, Oryza sativa
gggtcacatggctaaagaccaatgggatcactcccttacattgggcacccaatagtctctatggagggacctaggccccttcacatcgcgtggttgataaccccttaaatctttctaccttgcagtagtgctccacttgttgtctccccattccgaccttcggtacacactgcagcgttctaagaccattatcctagtcacaatggtgatcgcggatgccaagaagatactagggagttcgctacccaggaagaaggtcgctcgcctggctcgaaagaatgcatcagtttgacggaatagtgtggccaagaggtttgggcttacactccttgccatgccttctctccatgagctagaggagaccaacaaggatggaaagcgcaaggggcatcgcggggcggacgtggtccatgctcccaagaggtccaagcagggagcaaatctttggctcctccttttgtgggcgtgcctctacaggccaagcgaccaacactgttgttgtcagagacgtcggtgaaagccttcgatcatgacatcatcgaggtcggttcgtcggtctccactatccatgcaccgaaggtggtaacggtagcggttgccatagaggccaacgagacggcctggcaagtggccctcacaggtaagggtctcgtttccttcctgttatcgtgaggctatattgttatctcttacatgcctctctcttcattttccccttcttcattgtaggttttccagggtacaggtcgtagtcgtcttcttcgaaagttgagacaatgccctcgatgccgtggtggactggagaagaggaggtggcgtcgttgccacctcaagtggagatatcaactgatatggtgatatcggaggcggatggcgtccttgatttgactccggagcaagtgattgccctctgtgggggcatatcatggaggcagctccagagggcatccatgcagaggccatcatccactcatgggatccattgcctaccatcatggggcggctcgtgcgtcccagagacttggtggcgctccggttggatgtggaggcaccgatctggtcctccctgcttggggatgacgctcgtgtattggctactatgatgagatcaatggagctaatggagctgcaatgtgtgttggcctagtaggtgcgtccgtctgtccttgtttcttgttgggtttgttttgagtaatcagagtgccttcctccttcgctcaggccatggtggtcgtcaaagcatccatcaagcgtgggggaagtgatgcagcaacacaacacgcggagaggcttcgtctagacgagattatagccttaggtacagcggaggccagtggtgcagcctcataggtggaggcaaaatggtgacggtgcaactggccctcttgcaggtggaggtgtctcggtcataggtggagaaatggttgtgggatgttcataccgaggtggcccgcctgtccccggagaagaggcgttgtcttaggagattagcatggccaagggagagtcggagactcattcgcttgatgcccgcacactagatgagaatgccgtgcatgtgccctagcggttacgtgggctttgggctccgacttcgtggattgtggatcaaaggacctacagtcccaaaggacaatgcccccatcaccgacaagatgacctggtcgatgaggtaggggcttcaccaagaaggtcatcgccacctacgaggcttggtgctcataggccaccacccatatattgtcgttgcttcaacaggagtgtaggcacatcgacccctctgtttgcttggaccccgtggtgttctccatcctaatgtagggcgctccagcacaccatccccgcgtcgtgacatgaacgacctcacccggaggattgggccctcgttgggtcacaacgttgtagtggctgagctcgccgcttacaccgaggggaaaacgaagggtgtgcccaaggtgtagggattagttaattttttttagtaaatttcataaaactacagttacttcgatcaaattatcataaaactacaaatttaaggcactgtatcacaaaactacagatttaacacaagatttgaggccaactatcacaaaactaaagatttaatactagagttatcacaaaactatatattttacaacttaaatccctaccactactgctatgttagagtgataaatgttgtagttttgtacttaacatgttgcaaaacatgtacttttgtgataatattattactaaatgtgtagtttggtgatcttccaccttaaatctgtagttctttgataaagttggtcctaaatctatagttttgtgatacaccttaaatatatagttttgtgatagttttgtcaaagtacatgtagtttagagaaatttgctctcttttttttttctgtgttccctgtttcttttatttctcttcatgtagccttctctctggcttagccttgcctactgtttggcctccagactatcctttttcttaccttctgcaattcgacataatatataggaaaaatttgctagaggacggtcaaattttctggtatttcctaacgaactcctaaaaggcgtgacatggctctaggactcctaaaagacacgtgatttactagtggacaccacagtcattatttcatcattcctgggcttaatggagggggaaaccatgagaaaaagacagttctgcccctctggctagcacgttgtatgtacattagtggctttgcttatgccacgaccttaacttgtgtcttgagccagtaccctttaacacatcgtaggcttcaccatcctcacccctccagggggtggtcatccctccggccgtcggggcctgcactgctttagcattgctgcctgtttgcacctacggttaccaaggtacatatggtttagtgtgtggcgaggtggccacgtcctccagcacaaccttcaactagaacttcgattgaagtctttcgttcaatgatgaggcacacgagccattgctctagtagctttggtgatcgaatctaggtccatcgaggcatccctagtgcatcggacctattctagatttcaagacatatgacgccgtagggaggttaggcaacatgtacggtggaatggcgaccggtcatggctcgcctgccatgggatgggtcagggtaccacgtgtttcatgggctcaggccgactaggattctagatcctagggctcttcaagcagaacactgggcgggggtccttacctactcatcatgagtagcctcatgccgagtcgggtgctgttgtggggtccttccactagggatccttaataatctagccatagcacaactctcccatgaggtcagggtggctcttacagaagtccgcctttaagggcgattcattaactagtccgtccgaaaaaccgctaatctctaaataaatgtggataattaattttaagtccaactgagtaaaactaatattctggtatatatatgtgtgtgtgtgtgtgtgtgtgtgtgtgtgtgtgttttcacatttaattaaaatacttattttagtatgattgttaacttatgtcatgtagcctctttatgaataaccatactaaaggaaatattcaattaaagtagtaactgtatgtcttattaccaaaatatagtaagaatcctataaaaaatttgtttacgtcaaaaaggcttaatatgaaaattctatctttttttaaagtttggtaccatatcaaacttcttttttgtcgacgtttgatgtctcgactacggtatttggacagtatggggatcgtcggtgctagggcatacgcgagaccgaggtaaaagagatggagacagggatttttatacaggttcgggcccctgaattgtcaggtaataaccctacatcctgttggccggagccggagttgctttttattcaccataatcacaccagtacaatatgtggggtagcctatctaattgttgtcgacatggcggtctgaaggtctgactcgtagtcgacaacagggtagccttcctccttaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtggacgtgtgttgattgtcatgggtgtcttccatggtctcctcaccctctcctcctaggggggcttgtatttatacccataggtgtccccttgtccaagtagaactagggaaaccaatatggatacaatccgagtagtccttgtcgtttccatgtagaactctggttgtatttccttatccggaactccctcgaggtcagtttccgtataagacatggtatgtggtggatcctgcctagatttagtcaactactattaggtatgtggtatccataaccctgatagtagcccccgacttcgatgcaaatgaacgaattcatattctcaaccgcgcgtagacattggagtaactgttatcgagctcatgtgaccgttctcggtgagtttagagataacgttggacttcctttgtcagcctcgtgcgggcaccgaaagggtttgtctaagtcaatctctgatgtcgaccgagaaagtatagagcgtacgactaagtctcacgtcttgctgtaatcgagaatttggattgaagtcaagaaattttatctcggcgggtacaccatttcttcattctctattccttgtcgagatccagcaaccgttctcgagcgatcgagaaggcgtagagtctgcgacggagccttgtcaacattggtcgtactcgccttagtcgatcttggtgtagaaccatagagacatggagtcttccacaatatcaaatagaattttcctgaaaccaatactcagaaaagaatatcaaatagaaatagcccccaagcgaatgctcaaagggtgacatgttataatatgtatggtaaattgaaaataaattaaatttactgatcaatgttttgtgtatgagcgtcttctctcttaccgacttcgatcagtcagtagagtcatacactctccctagcccccagccttgtcgtcggagaaccgttctaggaggataaggctcttggacccttgacctgccttggttgaataaacactgatcctagcccccagccgtgaagttggaaaagtcaatttccgattacacggcttggttaatacgcacggcgagaactctaacacgaccagatcttacatggtcctttgtctctgaaggatccgacaaggccttatcggctctgggcgtccccagacgaggatcccttaggttcctcggaggccttgtcaagacggcgtaaagggacagtaggataggtttcaacgctaggtgtcatcgtggtaagggatctctgggtaaaacattgggcgatattgtgtacctgctatcaacttggttgaaatagaggtagtaggagagtcgctacaccgctggtcgaggaccaggcagtagtcgtaactcgaccacttaaagtgaaagtagtgggagagaagctacgtagctggtcgaggaccaggcagtagttgtaattcgaccacttggagtggaagtagtggaaggaacgctacgtagctggtcgaggaccaggcagtagtcgtgactcgaccacttagagtggaagtggtgggaggaacgttatgtagctggtcggggaccaggcagtagtcgtgacttgaccacttaaagtggaagttgtgggagagacgctacatcactggtcgaggaccaggcagtagccgtaactcgaccactgaaagtggaagtagtcggaggaacgctacatcgctggtcgaggaccaggcagtagccgtaactcgaccactgaaagcagaagtggtgggagaaaagctacgtcgctagtcgaggaccaggcagtagtcgtaactcgaccacttgcagtggaaatagtgggagagacgctacatcgctggtcgaggaccaggcagtcgtcgtaactcgactatataaagtggaagtggtgggagaaacgctacgttgctggtcgaggaccaggcagtagtcgtaactcgaccacttgcagtggaaatagtgggagaaacgctacttcgttggtcgaggaccaggcagtagtcgtaactcgaccacttaaagcggaattggtgggagaaacgctacgtcgctggtcgaggaccaggcagtagtcgtaactcgaccacttgcagtggaaatagtgggaaaaacgctacatcactggtcgaggaccaggcagtagtcgtaactcgaccactagaagcaaatgtacgagagatcactacgatcaactggttgaaaaccggtgagtaggtgtccctcgatcatttggagtcgtggtgcgaggaccgctacgctggcgtagtcatacctcgaccatctgaagttaaggtgcgagagattgctacatactgatgcgagaaccagtgagcgagcagaattatctctcgaacaccaatggaagttgcggtgcgagagattgctgcgtactggtgcgagaaccagtgagcgagcggaattatctctcgaacaccaatggaagttgtggtgcgagagattgctgcgtactggtgtgagaaccagtgagcgagcggaattatctctcgaacaccaatggaagttgcggtgcgagagttggtttattgcaagtgtatctcatgtggccagtatgactcacgtacccaacttatagcatatccggatgtccgttcgcaatcatgtcgggtgatcaagccgacgacgttcgcgaggaattatccgttaacaaccttttctcgagtagtccagccatggccggtgctatgagataggtcgtcagtctttgttggtaggttgggtgcgataactccacaacctactcgagtgctcagttgttcctgaaaattattttctagaagacaagacatatagcagataatatcgagtatgtactcaaaaaactgcatagatcttctagtattatcaggatataacgagcagattaaatatcaggcattatgtaaaccgtaaacaagcatgatttatacagaagagaacggagcgagcccccagcattagaccgtagttggcctgacatcggaagcactcgcacaatagatattgtttaaaaaacatgctctaggtaaacataataaattatagatctgacaatatcgtatagattggaaaaataggtacgataaattgtatataaattaccgcgtacctgtgtagatatatgccaaatatatctacgaaattagtagatcaattaaattattcaacctactaattgccttactgtgtatgcttggtgaggaatagtaactccttaattgatccgattgtgtgtatggtactgttccccatgtaagcatgaaccttgtattttggtcctttaattgatctgtttgccacgtcgttggaacggccaaccaggatgctgcctagagattggattctagtgcgagcataagagaactcctccaatccgacttagaatttacacccatgtacatatcaatctggctctagatttcagctccacggcgctcgttttgttggtggagataagccgagttcggtttgaacttagccagccgatgtctcacaccagtcgatgccgcacacatggaggaatcggtgtcggattgctcttggatgccaccgacacagtagcactcctcggcgatgatggttctgatctactcggaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtctcgactacggtatttggacagtatagggatcgtcggtgctagggtatacgcgagactgaggtaaaagagatagagacatggatttttatacaggttcgggcccatgaattatcaggtaataaccctacatcctgttggccggagccggagttgctttttattcaccataatcacaccagtacaatatgtgaggtagtctatctaactgttgtcgacatggcggtctgaaggtctgactcgtagtcgacaacagggtagccttcctcctcaaatccgtgttcggcaagatcagagatagcgctttcgtatctcctgacggtatccggagacaccgtaggggaatagccatgcctatccctgaagtcgatatccggcagcgtgtcttggcgtatgtaggcttgtgtgttgtggcttctggtgggcgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggtctgtttagatcctccaaaatggcaaaagctatgccgttttggagcactttttgccattttagatataaacactagtagcaaaagttggcaatttggcatttggcatttgctagtgtttacacccaaatttggcacctaggattaaaatagggaaattgccaaagtttggacgatctgccggttttcctctgagagggccggtctgaccgccgtatgtcggctggtcagaccgccgctagtgggccggtctgaccggtagagtccgagtcagactgttttcatcgagtctcgggtttccttgcttgggaagtcatgtttcgtgtttccatctgtttctagcccgagttgaacgtggaggagggcatgtaaagggcaagaccaacccctatataagggacaaggccggttcaattgtaagagatcaatcaactatcaatcaatcgaatcgttcttttacttttgcttctagttctagtttagtttgtccatctttgtcgatttgcgccggtccgccgccgctgtgagtgcgacacctctttgtaggtttgtcctgaaaaccttctgtttttcccacgagacgggtagttatctatcgttctatctagatcggctccgctagccggtttagtttatcaaaatccatcttagtttaacttttgctagattgaggtggttggcgactctaagattaccgcaaagcgttaggtgctgtgactgtgcttgtcaactttgtcaaaaaagttgccaacagctagtccatggtagcaaattttgccaaaaagtgctccgggaccacaccctctctctttctctctctctttagtgctaaaatggcaaaactttaagatgcatctaaacactaactagtacttttgcaatgtcaaatcttttgccaccaaaacttttgccatatatttgctattccaaatagatctaaacagaccctaaatgcatttttcttaagagatcatccatgaaaatcgatttttagatgatttcctttatgagaaccacagataaaaatcactggatctttaactgtaaaaatcatgatttttgtaagcctttccttaggaaagccacccgcaaaaacgaatttttgtggacctgccaaaaaaaaggtttttataggtggtcaatgactctgaggtgtaactattttcacatgcactatttcttttggactgcttgagaaaataaatagtgtagcgtcaaaaaaaaatgatgttttatagtgtatatatcggccggatgagaatagagatcagctggactgatatctctgcacgttaataaaaactgcagctaatctcgtccatccattttgatcactacgggttcagatccaagttgacagtacatatatgtaatatcaacaggcctctagttaattaagtaattagtataaaaatgaaaatatgaagatggttatgtggccagtcgccttgcagtacacaactacacattagcaacagctagtggaaatactcaaataatactgctatgcccaggaaacactagtaattactacctccgtccctcatataaagtcatataaaggatattcactatttttaaaatactaatgtttgaccactcgtcttatttaaataatttgtgcaaatataaaaaagaaaagttgggcttaaaatactttagatgataataaagtaagtcataaataaaataaataataattttaaattttttttaataagacgattggtcaaacagtacaagtaaaatgttaaaatcccttatacgagttgacggagggagtaattaaatactgtcgccgttttcacgtcgctaccgttttaatttgtctgcaatataacgaattaatccggctatctgcgatatagccaatatatcatatctatgcgttatcttgttggaacgtacaggatatggccatccatgcgatatggccaaaaactctatgtacggttttgttacatcttaatcttctccgtcgtggccgatagagaccacacgtattacaagctaatcacaaatctagggatagctatattatatatttgtttatgacccatatttttcaccccaaattagtaagataagattcttttttacattgtaaatttaaaacttatacatatactacatattaaattacattatttacatattgttattttttttctaatatacgagtataaaatgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctccggatccagatccagctcctgtcggcggcggcgtaccaccttcgtcaacagaggcggcagcaactccagacatggcgatgagcagtcgtgcggaaggcactccccaaaaacctgatcacccgcctacccggtgcagatctcaggccaatctctcatgcgcgcaagagatcagaagcggggaagcgagagagcaactcaggcacggaggaggagaaactaacaccgggaaacaagcgaagaaaaacggatcagactcgcggcctccttatctatcaggagaaagaacgtggacgcgggttagtggctgcaaaaggatagcgacgtgacgtgacgtgacgcacgcacgccgccctcgccctcgccctcgcccacgcccacgcccacgccccggcccggcccggcccgcgcgcgtgtggcattctgacccccacctcaactggtcaacagggagcctctaataactccctatttaggttgagatatttctcgcttaaatcctgaggtcgtatta

SEQ ID NO: 11344 - DNA, 1543 bp, Oryza sativa
gtgtgatcaggtttcactcagaaccttgactggtactgggctgccgttcgcatcccctctgtatggagcatataagtcaaactcaagcctcttcatgagtatctagagattgcccaaacctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatggaaatgagctcttttcaagggtctcttctctcagtcacacaatagtttgtttcaccatccaaattcacgggatctccgatcacaatggacaggtttctactattatgcaaccttaggtgggtatcaagcccatttccctcgatgcactgtctatcacattacgtggtagccccttggtaaactgatctgccagatttctagccgtttggacatagtccaatgctatcactccggagtttttgtgctttctgacatatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttcctgaatagcacgctgggatcatcaggagtaggagctggcttgcagtcactatatccaaagagactcaaaaccttgtccacatagtgggattgcacaagtgtaatcccacactcatctcctctttgtagtttgatgttaagaataacatcagcctctcccaaatccttcatttcaaaattcttagacagatagtctttgacctcctcaatcacattaaggctggtcccaaagatcagtatgtcatcgacatacaagcacaagatcaccccttctcccccaccatagcgatagtatacacatttgtcagcttcgttcacaacaaagcctgcagatgtaagcgtgatgtcaaacttctcatgccattgcttaggtgcttgcttgaggccatacaaggatttcaatagtttacacaccattccctcctgaccttctagtacatacccgtctggttgatccatat

SEQ ID NO: 11345 - DNA, 713 bp, Oryza sativa
ttataattagaccatttaatgattaatttaatatgtgggtaattaccgaaatgctctttgtaagattaaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacatctacagtcataattgctttccttccaagagtcccctttccccgtagcctcccttcatgtcgtgatttctgccaccccgattggacgaaggtcttcaataaattctaagaaaaactcaatgacctcctctgttccataccccttggctatgcttgtttccggataagaatggttacgaacatacttctttagaatacccatgtacctctcgaaaggaaacatgttgggtaggtacacaggcccgagagccggagaatactgatctctttcacaatgtgacttggaagatgcgtcattatgttgaagaagaaaggtggaaagatcaactcaaagctgacaaggcattgcaccacatcattttgaagggcttctaatttgtctggattgatgaccttctgtgaaattgcgttcatgaaacacatagg

SEQ ID NO: 11346 - DNA, 1414 bp, Oryza sativa
tgactgcaaagcagcacaaacaatcagccttctagtttatgaggtaaaaggattaaacttaaacaaacaagcaactttttagtttgattttttgaaagccatgaaccattcttacactgttacgttaaaaggtatattgaagaagcattttttagtttatgcaaggtggaggtacgactccatcattaaacttaagatttcatatccattcgcttataaaacacataagctaaaaatctaacttaaaagtctaaacttgaataaagagggtcttagttgtgtgctaattaagtcaaaattttctacttttaactgtacaaatttatcacttgtttagggcgcactaccaatttttttttgtagggtaacgatacaaacaggctctaactcaacagtttgacatttggagtgcttcgattcctcctgcgctgcctcctttggaacacgtgaattaactttccaaaaaaaataataataaaatcctacccataattttacaaagtgagtagtatttatgaaaattaatttgggatagactaagcatcacttgtcacacgttggagagtttctaatgcttatccaaactagcaaaaataagttaattgttcctatctactgcacatctgcagaccgcaggtgttttaggacatctgactgccagatataggtaactccaaaataacaagtcaacccccatttttgtttctctctttcttggctcccatcaactgaactgaaaccatacgagtgtgtactgtacctagctagctaatcagcaatgttctccatgtgacactttgctatttttcgacaagaaacatggcacaggctattaattagccacttgcttaactagccaataattaagcgtgcatgcagcatgaaggttgttaggttgcatggcatttggtaggtagctaggtcaacggtgtgttcttcgtcgctcgccatggaagttcttttttatttttcttttaagctcttgatcgaactcctgcatgcacgagccaccagcgtgtgtgttcaactgtgttcatcatccaaatgcattccaggcgaggcaacatgcatgcagattattgcagtgtttggccagcctgacatccccatgaatcctaacatgccatgtcccctatctcaaacattccccacgaacatgcctcgcatgttcctgcaaattctatcatcttctcgatgatcaacctgttctcgattggttattataaatacaattccgctcgaaatcgaatagcaacagcaagaacaagaacaagaacaagaagatcaggaagaatcaattgaagaattaatattccatggcaatgccgtgttccggtgagcggtgccgccgcgtgtggtggtcggcggcggcggcggtggtggcgttcttcttcgtcgtctttgtggcggcggc

SEQ ID NO: 11347 - DNA, 1153 bp, Oryza sativa
ttttcagctttcctcacgctcccaaatatgtgtctagatttattaacatttatataaatgtgagcaatagtagaaagtcgtataacctaaaacgtagatagtagttcgtttgatccctctccgccgccattgccatcgagacagagagcttcgcattgacacgccgccattgatgcagaattctggtggacggcgtgccgatcagggactaccggaacacggcggcgcgcggcgggccggcgttcccgacgtggcagaagatgcgggcccacggcagcctgtggaacgccgacgactgggcgacgcagggcgggagggtgaagacggactggtcggaggcacccttcttcgcctactaccgggggctccgggtgacgccgtgcgcgccgtcccccggcgtggcgtggtgcggcgatgagccgccggagtcgccgtggttcgatcagcaggagatggacgcggcggcgctgagcaaggcgaggcaggagcacctgctctacgactactgcgaggacaccaaacggttcaaggacacgggcctccccgtcgagtgcaccatcaactagctagttatagctagagagcgtgtttagtttagtccaaaatttcttaattaattcgtgtgtaatttctctcggtttgtatatcggttatatatatatatgtatatatataatctgttttagttaaatttagaattatttctattattatctaaaaaaaatagaattattttacttaatggatacgcatgcaacaccattacataccagtatgttcaccatcgattacaagcgtgctcgatccataacacacacgcttcaagagatgtgggctcatgcaacgcatggacgtggcgagtcacaatggaacatccactcaagtgattataacccatctccagattgtacatgcatgtctttctatagtgtagggtatgcgtgcctcacacgcagcgacggttactcgtagcaatcgagcgacagactactcgtatgggatgacgtctgggcaagggaggggagaaggggggtgggacggcacgcaccagatcgaaggcggtgtatgcggcagtgttgtggaaaatggccataccgattgactaatcggtcgtaacgttaaaaccaccaccgcgttaatgtgatacggtgta

SEQ ID NO: 11348 - DNA, 663 bp, Oryza sativa
actcgaatcgtagtcaagcgagcaactggtgaatatgtgtcgaagaaatcctcgccttccttttgggtataacccttggccacaagccttgccttgtacttttcgattgtaccattaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttcatcattgtgttctatcggtgcaaagtgctcatggggcatgacagtttctttactagaagtgctaggtgtatatttcataggaaattcattctcaaagaatgtagcatctctggactcaaaaattgtaccagcatgcatgtcgggtactccagagtttactattaagaatctataacccacactgtggatagcataaccaagaaacacgcaatcaacggttttttgtccaagtttccgctttttgactataagtacattt

SEQ ID NO: 11349 - DNA, 2820 bp, Oryza sativa
tgaataattccaaactcttcgcaaaaagatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacataagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataacctttttcaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccttttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggatgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggcgtcagagactccgaacttggcctcgagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtctaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctcctgtcggcggcggcgtatcacctccgccaacagaggcggcagcaactctagacatggcgatgagcagtcgtgcgggaggcactccccaaaaacctgatcacccgcctacccggtgtagatctcaggccaatctctcgtgcgtgcaagagatcagaagcggggaagcgagagagcaactcaggcacggagggaatcgtgggaacgtgggttagtggctgcaaaaggatagcgacgtgacgtgacgcacgcacgccgccagccacgcctcgcccacggcccgcgcgcgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacataaaagaattagaattaaaaaataatttattattatcaacttaaaagagtatatagaagatatatatatatataggaaagagagtaatcacataaaaagactaaaattaagtgaaaaatatatgcatggtgtcataattttagcaatcccgtctaattttgcaggggccaaaacgcataattttcctctggagcagctatatatatgagactctacgtgctcactccatcgacactggccatccatcccgcctatgggtagcacgggagaagtaatgctggcatcgggaggaggagcggcgcc

SEQ ID NO: 11350 - DNA, 3432 bp, Oryza sativa
ttcttgacgagctgccgtcgccgaggctgatgtgcacgcacatgccgctgtcgctgctgccggcgacggtggccgacggtagctccggctgtaagatcatctacatttgcaggtatccgggactttgtgcgtgataaagtttgaggacactggctagcaagtactcctatatactggcttagtttattaacttacacatgacatgaggaagataaccaattgtggagtaaatggtaataaaataaagtgattgaattaataggacaaaaaaaatgatgctacatctttcgcaaaatccttatgtaggccacaatgcaaaaaattcataccgaattcaaatattaagtctaaactcaaatgtgccggatattaaaagctagatattaggcacatgaaaatttgaaaattccaaacacctaaaattatgcattaattgctaatcataaatttgtagtgccatgttaatgtgttcgattttagttcattttaactacaaaaatatattgtagtagtatatagatttactttatttttgcatttcactttgttttttttaccaattgttaattaaattatttcatggtatttgtaaaattactttaagtttaggttataatatatcattgttacacctcttatctatgaaataaggataactttgcaaacagatagatataccacagggaacaatgagaaccgtgccttcctgatgcccttattacaatattgcttgaactgtcataggtaccggttagaaactggtcataggtatcggtttccgtagtcggcacctatgcagttgcgcataggtgtcggttcttaccacctaacaccggtgtgaggaacaaataaagcaaggttgctcgacatcgagcagctactgatccccatccaagaaccattcctataagatcccctcatcacatccaataacacaattacgaaatcaacactaagatacaaaatcaatatcaaagaacaatagagaatacacagagaggagaataaaataaatcatcgcagttgctgcctctcgacaaaccggtgctgctcccgcttgatccccttaaggaggatggatccagatgatgacgttcaaggtggagatgtacaggcccggcagggtgtgcagcggcacgggaccttgcgctgctcaagcccgtgctcaccgtccaccgccgctgccccagcctacaccaccgctaggacgggttactcgtggatggcgctgcgacggggcagaagccactcttctccgtacgccgcttgtctatcctcggcattggctctgacgccggcgctgtcctcgtcgatattctcggccccggtgccaccagcgagttccacgttgacaggtccttctagcggtgctactgctgcgtggtagccggattcggcggaccccgacctccaggcggccggatctagcatggcttagaggtagtggtgaggaggaggggcagaattacttggaggggcgtcaccagggagaggaagaggaggcagaggagggaggagtggcggcggacgaagatggatgaggaggaaaggcccgtgtggtggggatgtgcaaaagatgtggacaaggagtacggggtagggagaaaagtagggagaaaatgtgaggatagatgtgtgaaagatgtggataagaaagtggcttggctccgtcaattttatgggtaatagttaattaaaaaatcagttcatataatatattataggttcttttttaattattaaccagtacctacaatatattacaatatattataggtcctagttcatttgaaaatattatgctgattttttctttagaactgacatttatattactcaaaggtgtatgttctatatttttttcatcgtgcaaatgtgagaaaatatccgtaggtaacggttttaaatgtcgaccgacacctatgaatcgatatcaataaggggtattgtagtagtgttaataattgtgatttctgtgatgaataacaatgggcagagaagaatatatagaatcatgtcgttattatatatatgtgcaaacaaaatatgatgagggggagagagagagagagaacggggagggagagagcgactggagggtattgtagtagtgttagtacagcgcaaggcgtacttgtgctagctacgtgatagaattggacaattaacgtggaagtaggtgactgggtgttgtcatatcaattaggtgtaccggatatttgttagctacaataaggacggtcgacggaatgggactgatatatgcatgggctagctcgaccaaagttgctagctactgtgtgtccttcaggtaattaatcggacagatacacaccacactttttatattatactccccccgtttcaaaatgtttgacatcgttgatttttttaagtacgtgtttaactattcgtcttattcaaaaaatttaaataagtatttattcttttcatatcatttatttcattgttaagtatactttcatatacacatatagttttacatatttcacaaaatttttaaataagacgaacggtcaaacatgtgctaaaaagtcaacggtgtcaaatattttgaaacggagggagtaagttgtttgatttttttattagttaaactctcttaagctttattaagtttataagtgtgtgtgtgtatatatatatatatatatatatatatatatatatttctaatataaaacaaacatattatcaaaatatattcaatgttaaatttaataaaactaatttaatgttataaatgtgacctaaagaaatttgactaataaaaaagtcaaactacttatatatcaaatggagggtgtatataattaaacaacctctatatatagccataatttgggcacatatattcctctttaatctctctcatcaacagaccgggagtaaatacataagatcttatacacatactctctctttctctttctgtatatgtgtgtggtatatatagatagacatgtcgatatatataatattcaatttgcggcccattatatttgtaccatgatgaagtgataattaactaagattgttaatgtaaacaagtgggatggaataataccaccattttcaaattttgcttggtgcatgtgcgaagaacctagatcactgaaagacataaaaaggcaaaaattaacaagttgcttgtgacaaatataattctcatatgatatatgttcatcgttttcatggaacacatcatgatcaacaatgttttactcctatcattcatcaaaaatccaaaccacaatttgataattgcatcgtgaataaagtattagagcacacacatcgaacactataatataatcactgcagcatgccatgtgtaattaaaaaaagagcacatcgatcgatctaaagacaaattaaagtttaacatataatgtccagccttaattgagc

SEQ ID NO: 11351 - DNA, 6872 bp, Oryza sativa
ttcttgaagcgcaatgggctacaaaatctgtacgagtccttctgcgagggcacatgcttcgggggccctgtttggaatcacattctcgagtactggagggcaagcaaagcgaacccaagcagggtgctcttccttagatatgagcggctgcttcaagacccaacagacagcatcagggagctagccgagttcgtcgggcagccattcactagctccgaggaagaagctggtgttgtcacggagatcgtagagctctgtagcatggagaatctcatgagccagaaggccaacaaggaaggcgcccaaggtgtgttcatcaagttctctcacgactcgtatttccggaagggggtggcagggggttggacgagccacatgacccctgagatgggaagacgtctggatgcgattctccgggacaagtttgatgggtcaggactcactatctgaatatgcatttagttttacgtgtgtttcgtcttttaatttatgcttaacaatatatagtagtacgcaaaaaacgttggattgttttttttcttgttgaaccttttctccatgtattgaaataatggtgttgtttggaagtatagtctgtaaccttttatgcttgtaaaacggttataactttgtaatttccagggcaccaaggaaaaccctttaattgtaatttccctaattcggttaatcacaatgtagcttgtattttggtaattgttagagttactctggttactgatgtaatgggataatggactagctatctggcataaatacataatgattccccacacattgctgcaagatggctgtggatatcatttgctttggagagatgcgcatactatataaaatgctttctagaagtctatcatcaatgattactgcaccctaagacaaatttagtaaattaaggcaaactgtttcagcttacttaagaattcaactaacttcatatatatttcccaattcaagatgactaaactaactaagtgtaatgtcaacaatcaatccagtatactgttcattgaaatataagctagaaaaattcaacctctaattctttcttttgagaagaataaaggaccaggtcttcgacaatggaagcctttatgccatatccatgtacttgtttatgaagtcataaatcctataaatcctataaatcctataagtttatacaggatttataaatttaatatagattactaagtatgctagtgttattgcccaagccccatatgatgagtcatcttaagggagggagggaagtaattaattaattcacacatctgcaattaatatggagatgatatatactcctcccgtccgtgaaagggcatatagcctagtggttgcagtgatctgagtagcacccaaggtcctaacttcaaatttccatatgagcgaattttagattgagttattagagggcaagttccttatttgataggctaagttcctaatttaaaaaggctgcatatatccggttggatgcagaatccgggtaaaaaatatccttcttaaaaaaaatactcctcccgtccaaaataaaacgaacctaagactggatgtgatacattcagattcgttgtactaaaatgtgtcatatcccgtattagatttggtttttatgggatggaggaagtatatccagtattagatttggttttttatgggatggagggagtatatactgctcgcagcctacatgaagaacatgtcattgcgcctccgctgagttggggcttctatttttcccattttcactgatagctagatctaaattttcatgagctatgtttttattcttactaattgtgtggaggcaaagcagctgtttgcatactgttcgtggatttgtgtatcaaattggcatgtgtgtgttacaggatttgttctagtaatttggcacatgtaattaatttggcacatgtgcgtggatatagctaaaactgctgatttagatgacaaatcaagatgtattatggtaaaccttttttaacatgctccaaaataaatacatcaaatacaaaaatgagagagagaaaaaaatgatgatcgaagtggaacggaggaagtacggtggtaattaagctagttacaagctccagcatacgctgcaagatccctagaacacactactagaaaaccacaaattggggacatcctctatctacaaggcctttcctatccttcgtaaattcttaaattaaaaatcaacacctataacgtgccaatttttctaaaaaccaacacgtataatacaagtgcctgattttctttaataaaagcagtacaaataaagatgtcatatgtgctaggttttttggcacattattggagcagcagcaccagcggaaaaaaaatcacatagacatacgccatatctcctcgtgacctcgtccattcctttcttatatccgtctctctcaaaccctctaagcctccacctaagataatcttcatcttttctctcattgtctctcactctttactcctctccacctctcagcatcctagcctgcgacgctacgatgacaccccaacacgtaaaggcggcagcctgcctctcccagtgacacgacgattgcggcgaacaagccattaggttatcctctcaccatggccacagcctcagttcccgcagacggattcatcgtcattggcgacggcggtggcaccgatgccatatctagattgtccgagttcaggaacctctagatctgccctcctccctcccctagttatcactgtcgaccatgacgagcgacaacgagcaacagtgacctcccctcggtggggcagcatcagcatcctcccctcggccccacctccccacaagcagcggtggtggcgatccacatgactaaccaatacccctcctcccaaaaaattcccctccctgatctctcccaccaccccttatatctgactgtggtcttctggatctgagtagtggtggtgagcagtagcggcaaaggtggctttggcctccgatgggtggtggtggccttggtctccgctgggatgaggcaatggaggcatccttgtgttgatttgtaaatatttttttctttgaggggggaggtcgtgaatgttatgtgtgtaatttctgggatgattctgatacattgtcattggatttgtgagaatcttccattcagtttttgtatgtgttcttggctcgtagcatatgttcgattcgagccgatgcatcgagcattttttttattcatggaatctcaaaagcaccaatttctagaccattctccacatcagtgtcacatgaagggtgccggttgtgaatttgacaccaaagaccggttcccaactgacacaaaagtgagttcctatagtagtgacagatcgaatgtaactgcagcatttacctaaacagaggttaattacaataattaacaaaaaagatggttgcctatggtgattgacaaaaacgatgggtagcatcggaaggattttatttggtgcaccgaaaattacataggtcatagatgtacctgtttataagcataaacagttaaagttaagcctccaaacaggctaggaggctttgttttattatgaaacacatagcttgaaaactgtgactacaaattaaaagatgaaaccccggccataatggcgcatcatatggtgagccccgatccatcaaacttttctcgcataatcgaatccagatgttcgcccatcttaggagtcatgtggttcctccagtccccttccacccccttcctaaaatacgagtcgtgcgagaacttgatgtacacaccttgtatgccttctttgttggctttctggctccttagactctctaggctacatagcttgacgatctccgcaacaatgccagcttcttcctctgtgtcagagaatggctgcccgacaaattgtgcgagctctctaacggtgttcactgggtctcgaagcacctcctcatatttcaagaagagcactcggcctagatctattttgcttgccctccagtaaccaagcaagtgatcccagacaggaccagcaaacccagtgccatcacatatagactcatacacttcttggagcaacagatctggcacattgcgtttccgaaagtgccagatggagaccaatctatctttctggtccctacaaaatataacaagctagagtaaagcaatgtttcattgtcactaaagttaatactatgtgaataaatgttttggattttggtttgcaatttctctctttctaaatatacatattgtatccaggacttgcttttgcgaattcatgaaattttggacaatgtttggatcaagtatgtaagaacaatatttttttcctagggtagagatcgaggttgttgaacaagtccaacaagctaacacacgagacacggggctctttacttctcaaagggcaccatggtctagagcatcatgactcattgcaagggagacaaaataagtttgtttttcaccgaactcttgcatactaatacaaagcaaaaagactagaataccctctactttatcagtcccctacttacctaattacaattaatgcatttgtcccctactttcataaaatccaatgcaatgatgactcaaagatgaacttattttgggacatacaagagggggcaaagataattatatttcagaacagagggactagaagcttgcgacactatagaaaaacatgaactgcctctccatcgatatggatataaggaaaagggaagccaattatttgacctcatcaccttgaactcttgtaggaggataatggcaccagtgaaagacaccatctaccaatactgcaaggatgactctcagacggaggggagtgggtgtggaaggggatttctttttgctttgaaggggctcttaccaaggtcatggttgtaattgtgcgtttatcttcttgtatagaaaagagtagattctataaaaccccacctattatggttcaagttgtacaaaaccatagagattttggcatgtgacacataatctcaagtattatgtgtaaccattttaatgtgctcctatatcaagattttaaaaagtggacaaaacatttatatgatgaataaaattctcaaaaatttaaattgtaattgtagaactaaaaggtgtggttgatcaaaaatcaaaatgttcaatagtacggttttatgaaattttagaaccataatatccggtgtgatgtgccacgtatcaaaatccttatagttttacgtaacttacaccataatagtagggttttatgtactttacttatagaaaaatacaatgttaaataatgacaacaaagtaccagctaatctagatcctgcaataaccaaataggaaacatgctacatcaccatatttggtagagggtcccgttctgtcataataatactacgcagttgtatcacacatagcacagcacgtggtcatgtaccatctttcttcctaacgcttttctttgggaaataaaaaatctctatttaacggccatatggcaaaatactcatttttaagggagaaatacataccatttccaaaattagtttaaagttttcacacatgagatttgagatgagagcagctaatatttgaatctgatatgtataaatttcggctggtgtacaaaaacgaaaacgaccggatatgattcaaaactaagattccccttagtaaaataatattacctccgtcccaaaataagtgcagccgtggatatccgtgtccaacgtttgaccgtatgtcttatttgaaaattttgaaaatatttagtcacacataaaatattattcatattttatcatctaatagcaataaaaatactaattataaaaagttttcaaataagacgaacgatcaaacgttgaacgtgaatagtgcaaaactgcacttattttgggatagagggagtaccaataacaatataacgaataagggatggctagctatagctatggttatgggtacctgcaaatgtagatgatcttggtgttggagttgccgtcagccaccgccggcggcagcagcgagagcggcatgtgcgtgcacatgagcctcggcgacggcagctcgtcgagaagcgcgtcgcggccggcggcgaagagcctgtcgaggaggggcacgcagtcgtgcgggttgaggcggcggagcgggtggtcggggctcgccggcggcgggcacgcgcggcgcgccatggtggcgaacgcgagtgccttgagccacgtcgtccccgacttggggaggctggcgaggaggacgtcgccggcgcggggcacgaggccgccgcggtgcatggcgaccacgccctgcgcccagctctcgaacacccaggtccccccgtagcagcgcatcggctggccgtaggagacgcccgccggcagggcggagacggcggcggcgagctccgtcggagggcgcaccggcgtggcgtcgacgtcgacagcgtccttgaacgcgacggggcctccaccatggcgcacagctgctcttgctgccggctctcctcccttgttcgccatggcggcagcaagagcgagtatcgactcttataagaccctagtacttactatactccgtatattggtttgctgttgagaaaagatttggtatgcatggccagatggccttgacagccggatgagattctctacaatactttatttggcaggttactataggcactatctggacgagattttagcggccacagtttctccaaaaatttctagctctcgaatgatcaatattcttatgcggattcttaggcccgtttagtaggactccaagctccaactcccaactttaaactctaactgcagtgatagctagctcctataggagctgaagtgggtatatacgtat

SEQ ID NO: 11352 - DNA, 7047 bp, Oryza sativa
  unsure (1)..(7047): unsure at all n locations
ggcggtcgacggcggccgtggtgggcggcagtcggcggggccgcggccgtggcgggcggtgagccgcgcccggcggtcgtggcgagtggtggtagcagcggcattgtttttttaaaaaaaaattgtgattcactgagatatacaaatttgtgattcattgtttggatctgtgatgtatttgagtaattttttaggatattgtgatgtatttgatttgtgtgtataagtaactttatgatttgtgatgtgtatttggtgatatgaatttgggatgttgctttgattgggggattgatttggggatttgcctacttgattcgagagaaaataaaaaggaaaaaagaaaaagaaaaggcgaccatctggtactgccgctattgtctctttagtcccggttggtaacatcaaccgggactaaagatcccctctctttagtcccagttgttggtaccaactgggactaaagatgtatctttagtcccggttattttaacagagacatctttagtcctggatccttacttccggttggaaaaccgggattaaatgggggtttccaaccgggagtaaagatggtttctccataagtggtctcatcatcacaatttgccacgtcatcagaataatcagagccgttggatgcaacatgcattcaatagataacgtcggatctagagtgaggattggacagtaaaagatgacccaggtcagggttcaggtcttgggaaaggatctagagaaaggaagcatagtagcagacctatagtcaaatggaaaaaaaaaggccacgtactaagcttcctgttactattatatagaccgtagctattgggtttacacatgatgtaatttgatcagaaaggaagttagttaatttaagggtttttattttattaacgcattagagactgagttgacactggttattttataattgagagtaaaatatttgaaaatatgaaaaatataattgcaatgcaataacatgattatcaaaaatagaataggagatataacaaaggtaaaagataggaggatcaaaattatattgaataaaagaagaaaaatatatatatattcaagtaaattatgattcaaatggaaaaacatgattaaatttgtaatcttaatgcccatggtaaattacctacggtaagagataatttatatgcgagtttctaatttatgaaagataattaccactctagacagattacttttcttaataccacttttaataatttaccaaataaaaaatggttttaagatattaaacatgtcaacggatgcatattaatatcatttctcaatcatttacaaacacaaaaattgaaaacccattcataatgcattcatggctttgtggtatatttcttgcaattattatgaataaccttaaacatgtgattcttttgtaaaatttatatacaataatataattctttttgtaaaatttatatacaataagtacaaagttatctataaacaaactcttagcttcggggtttgcaacaaggtgaatatagtaaaaaatgaatttactataacaaatgcactggtaggttatattaaatgttgtaaaatttattcaacatatgaatgtaaaattgacgacaaacatagaggatgccatagtccttcttagtggcatatgccatagtccacatatagagattgaaaaaagtcatgatagtcgcgcaatgggtgacgaatgtggctagtaataatatgaagtttttaatgcaactcttctacagaaatttttttaaaaaaaacacgccatttagaaaaacgaggaaagtgaagttagggaaagtagactaaagaacgtaacctaattagaatctatgttataaaattcagaaaataaacaagaagcaagaaggtatgaaatctaacttttctagtttattagaaacttaactattcaatcagtttttttcttataatcttaaactcttctcaacacagccacaggggaaaataatatctaggattacatttctttttttttacttgccataggattacatttctttgatgtccctccaatcagtcatttatcatttggatttgggaaaagtctgacttatccctccccaaattattgtcttagtttgttgaaatggtacagttcctagggttaattattcaaaaatgctttccgacgtacgtccgagcgcatgtgaaatatcggacggcttcatccttatccaaaactccaactaccttctcctccacatcttttctattaacttttttcctctcgctctccctccttcctcgaaacttccagccatcgagcacacggctcttcgcttgcttgtgttcttggctctcttcatgccttgcttcttcctcctcctcctcctcctccccgtcgcgtgctcctgttgccaccacatcctcgcatcctcctcctcctcggtacggtattcacctcttccatagcggaggcatccatggctgcagcggcagggcaaggtgatgcaagatagcaagaagatgctgacctcgccggtgcccacacaatagcggcagcaggagggcagaacgtgaggatgtcggggagggagacactggacttgccatcggcgtggatcagatgtggtggccctggctaaggtcactcctctcacgaggctgctcatatgtgttcttccctagccattacctctcccatgctgcatcattaacttgatttcggcggatggagtagatgaagaaaacaaaggtgggttcatttttgtttggatttttaacgatgttgcagcctattatttatctctattgcactttattttattaaggtgtttcgttttcttttgatttgatgttgcatatatcaattcttcgtgttgcaattggtgtgtttcgaatgttgtatttggttgaaacaatttcgttcaagcgatgaaacattttcctttaattggtgaaacatttttcatcgagtggtgtaacatgtgaaacatttcgtgcaataacgtccgacgttttgcaaaatatggtgaaacattttttttgaaacaatgaaacattgcgacatctctttaacacgtagtgaaacaccgtccggagttttacaaatctccggatgtccgacgtgtagtcgtctccttaattattgaacgaacacaaagttaaatgcattttttttacttgctaaatactagtatatagtaagatatttctgccatgtgtctctaggaccgtccgctgctttattagggaggcccatcatgaataaatcttttgaaaaatatctatgcagggcttatgcaatgaatcgaagttccatgtcctgcatttctcagctggagtcccatttcacatgagctgtgatagtagtagagaactgcattcatacactactttgtacactgcagaacatttgagcatgatgaggtacgactttccaaacagtaactgcaacatagggggtcaatcattaatgactagcagcacttctttgacgtacaagaaaaccaggacgactagcaacacgggtagacatagggtgtgtagagttcatgctaaaattagaagttttattaaaattaaaacgatgtgacaaaaaagttaagaagtttatgcgtgtagaaaagttttgatgtgatggaaatgttaaaagtttgaagaaaaattttagaactaaaattaacatctgtaggggttttcactgtcatctagcatctgatgttcgaagcagaaaacctcgtcatatcatagtactctcatttttaaatagatgataccgttggttgatttttgtctgatcatttgtcttattaaaaaattatataaatattatttattttgttgcaacttaatttatgcaaggtgtttttgccctcaaattttcgtacgttgtcccattttttatccatcgtcgcgtcggcttggttgccgcacgtcgctcggagacggagatgtacaggcgctgttctgcatctgaccgaggaagcgctcgtgagtcctgaatttttttttttttaccagctgggccatctgcccatcgccctaggcctcttgggcttcttcctgcctggccggtcctgctccttcccagctaaatagttaatgatttttttttctgttgtattctctgctttttggtataaataaacgggagaagatcctgtacatgatttatgatgaatttgataattttatcaacccatgcgtttttcatgtaacgtttgtgttgtgtacccttttcactaagccacttttaactgtattcattattttctttggtgattcaccagttaaatatgtaatatttgtatttctttacctattatacatattactagaaaaaatacccgtacgtggcaacggatgaaatctattttaatcttattattgttatatggtttattattgttatgcttttagtaatacagaagaaatcatataagaaatctatttaaaaaagaactcgcatgctaactactcttaactgcagctcatgattttctaaaaatatatatatccaacctaactctcacagtgaattccattttaactaaaccatataacaataataaaattaaaatagccttcacccgttgcaacgcacaggtattttttagcatatttataccaaattttggaactaaacaagggcatagaaaattaacatccgtaagggtttccactgtcatctagcatctactgtcatctagcatctgatgttcgaagcagaaaacctcatcgtatcatagtactctcatttttaaatagatgataccgtatcagtatgacttattctttagcatatttataccaaatttttaaataagacaaataatcaaacgttatttcataaaagtcaatggcgtaatctggtcaagtgattgaacccaagtgattgaaatgcagaccaaaatttggctatagaattggtgctagacaacaaggtcgatgataatatagtatcaggaaaatgtaaaataggaaataggtgaaacgaacacacgaaacatcaaagctgaataacaaggccctgcattggcaatcaagacaaaaaaaaattaaatgataaagaaatgttggtattagtcaagtactccctccatactcgttcgtattagaagtcgtttaggacaatgtttaagtcaaactttcgaaatataaatcatgaataactctcaagttgttgagtttgaaaatgtaaaaattatatgaatagatttgtcataaaaaatactttcataaaagtatacatatatcacttttcaataaatatttttatagaaacaagaagtcaaagttgtgttttggagaccgtgtcgctgtccaacacaatttcctttacgagtacggagggaatagttatttcagttacttcttcctgtctcaaagcaaacgaaaattaaataaagattgttgtttgagcttcctttcaccagtccaaccaggtccccataagcaattttgcaccaaatttgttgcagctggaaatctaaaaaatgaggaaaaaacaaagtgtgaaggacgtattttcatgcttcaacatgcctatcatgtttcgtgtataacactacaagttgggggaagaacgaattgccgcagtcctcccacaagtttgttttgaaaaaaaaaaatcgccaccaatccttccggtgataaatgtttgtattcatctatttgccacatgtcacctaacatgctcttgtttcagatttgttcctttcttacaaaaagaatcagtcagcaatgccaaaaggtttcaaaaagatgttggaaacattccccctatctctaatttgcatgtcctatctgaatgaaactaatttatgcagcacaccagacctagccaaatattgttccactcaagtacagctaaaattactggtagtaaggtttgagcatccatgttgcatcatttttgcatctttgcaacattgctatttccttcagcagattcttaaatagcagcatatccttggacataatggagttcttaaaatgcctggttaatgcttgttgagctggctgaagcctgaaggtgcatattggtaaattaggacttgaggttgcatgataatgttcctagtagaagagcttgatgcatgacctttctatgataaacttggtgtgtgattagaagctagtccctagatcatctttttctttgtagcgaatatgcaagagatgttctaagtgcatcctacctaaaagtttgcagactttggccctgctatttgaagtttctgatggctgagaagaactaaataaaccaatgcctattgagtgttgacttaaacttcaagaacactgaggatggtgtctcggcagcaccagctcttaccagtcgaactagcaaccaaaaaaaactatcatgacttccgattggcgtcaagcttctggtcatcattagcatgcattatggcatcgtgattaattgcactctgagaaaaatggaaaaaaaatatcattttcagaaacaaaagccgagacaaattatttgtgttagggataagaaataattgcttacatgaatccctgagcatcaaaaagactcttcaaaatgtgagattcttcattcatgccgagatgagctatggtctattttttttccgcattccatgcctggatgagtttggttcagtctcggaggtcgtctgcacatacctgatcttgccgctagtcatttggaaccttggtattcacatcttcagacaactcgctgaaaatattggatgtttcagtcaaacatctactgaaattattggatgatcagtctatatactatcacatctcctctcctaccctatcttaataatgtttgaagacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11353 - DNA, 4238 bp, Oryza sativa
atgtgatacggcgtacatttattgttcactaacgttaaaactcgtttttagcgattagttggtcgttttccgttaaatcacctgaataatcgtccgtatgttgtatttgatgatcatttagtgttgttttctttacttaatttagaattgtttttgttttgttacatatatttttatgttttacttatttaatgcaaccaattctaccaccatatgatatataaatccggtgttagaagagttaatgttttacttatctgtttaattaaaaaacaacatgaagatatttgatttatatagttaaacaaatataattcttcaaataagtatataatataataaaatttgtacatatattcgcgaacgtcaaatttccgtataatttcgattaatcggtgaacgataccctttttgtccgacaaccgtattccgtcttctacaacactggtatgcggcgaagccaagggcggaggccgtgccccacccgcagcgagaggccgctccatgtctagaggctgccggcccagctccctcatctcgatcgccctcctccgacccgcgcactgcccgacgtcctctcagacgccgccccggcgaccggcgggtggcgaaagttggtgggcggtttctggggaatttttttgagaattaatattatttttatggaaaatcgcaaaagtagtggccaaccggggaaaatcgtgaaagtaggtccctgtcgaacgggtgcaattcgatagggcacctatcgaacgacgggcagtcgacaaagccctgtcgaacggctggcgttcgacacgctcacctgtcgaacggagggagttcgacagggcccaccacccggcgccgcgaggcctgtcgaaccgggggcgttcgacagggccctccaccgaccctatcgaacaatgggcgttcgacaggccggcttaaagccccgtccacccaggccgcgagttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacaccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttctttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgttcctatacaaatatgtgatagcggggtggatttgactgtatatgccttccatgatactagtctgaatgcaccagagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcaagggttgagcaacatacgtgtttgttggagaatacctgtctggtgcacagaaacctgacagcggtatttgtggcacaaatggtatattcaaaggtggttagaaaaacatctttgtcccctttcaccataatgcatgacgttgagaaagagtacggatatgagatatcgtacgacaaggcttggagggcaaaatagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcagcacattaaaatgtgtgttgttgaaaacagaccaaatgtgtgtgttctgcatgaccgacacgccggtttgctatcagcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaccctatagttgccagacaggaggagccggagggacttgaacccattcctaatgaagcaccaagtattactcggcgcaggaagcgtggaagggccacagaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcctgctgggaatagagagttgttatatgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgcgatttcactcgtcctcctccagggcaagccaattgggttcctgactcaaatttattacttgatactaagggtcgtcgccagtcgcgcaggatcaagaaccttatggatgaagttgaagtgaaagatcgttctcgtcgtaagaaagcttgcattctttgcggggagaaccattcccgtaaagattgcagcatgtacaatgtaaggcaagatgccacaggcgctgatgttcgtcgcgttccaaaggggaagtcgaagaagaaaaataatcctta

SEQ ID NO: 11354 - DNA, 4782 bp, Oryza sativa
cactgcacttgtaatatcataatatatgtgtcgtgggcttgtaattttaaattgaaatgtactgaactgttcttatctgtatctatgtgtgctggtactgtaattttaaattgaaatggcatgcaaatttgttacttgaattatgttgcatacatttactgtactggtaccatacgtgcattgtactaatgtggttttcgatctgcaggtattgctgatcaatatgatgggcagcttatagacaaggagatcgataggaaccatcgatcgcgacgtcttagtacaggaactttctgcaatgtgctaaagatgcgaggaccggatcaatattggcgtattgatcctcgttgggtttcaaggtgtgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgccgatagctgggcaagcagttggcccaacaatggtgaatgctggatgggcgcatgaccttctggccagttttggtggtgtgctgcctgttgcactggaggatctcacagatgggcacgggcctacgaaaagttggttaaatcagtttcgacaggatgtcttccctgatgaccaggaggagtggatcgtgcagcggcacttagtcgcttacctgttgtggttgtttggatgggtgatgttcacgggaactcacgctgaccgtggacaagcacttcatccactttgcggagcagattgcagagttacctatcgcggagattccacagtacagttgggggttcacggtacttgcggcgacatatgccggactgtgtgatgcttgagtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtattttttgttaaaatcgtttatgttatcattatgaatactagttcacaaactttccttatatgactaatgaaaactactacttgttacagccgcagtgggttagcgggacgacacgtcgtgtctacactcagtttgtagctgactttgatcagcttacgcctgaccgtgttcggtggactccctacactcagcccgatgtcaatgatcgtgcaccgcacggtctcgcggatctttgcacgcgagatatgcaactctggatgacgacttgtcacctcgtggtggacgtgcacgtcgagccacacaatgtccacagggttctcaaacagttgggcatgtatcaggacttcccttcgagagatggtcgtccttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattatgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagcatttataaatgatgtgcaactggttcattatttctaacaaatgtgcatattgttaaatactcttaataaatgtgcaactgggtaaataattgtaattgccttgattacttgtggaacaggcggaatttgttgagcacgttcacgtggagtctgacaccctgttgcaaagactagaggtgagacctccagtcgtcaggcctgacgacgtggcgagcatccttcgcaacttccgtgcacgtgctgccgcactactacgtcgtgtctcctgtcggagcgtggcagatgtggtgcagacgtcgggccgacggccatcaccttcactaccccgacgttccagcgtggatcgcagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcgcttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccctagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagtgaggacctagcaagcgtgcgaagggcactgatcgtccttgacttatctatttgtattaaacttttagtcatttatgttctgtccgtactatttgagaaacactttacgattaacttagtactatcagaactatttcataaacttcttcggataattactcagtagcatacccttcgaatgaatcatgacaaattatcattcaaatatacaaataatgcacaagacgcgagcgtcgcagggccatgagaataaaatagggggaatttaaatataagatttcaagttgatgaattgaaaaaattgaaaatacttaaaacttgaaaggacgatcagttgagccgggccgggcaccgtagccagccggcgggatcaaagctagccactacggaagagccagcacaaggggtcccgggctttgacggcacccagagctcaactgcaagagtcctcccaggagtgaaccgaggcgacagcaggttcatgggccaaccccccgcttggcccctgagggccatggggaagacgctcgccatgacctggtcgccaccccccaccgcctctatgatcgccgtgcagatctggagggactcggaggggtcgacgtcgccgtcgtacttctcggtgaggcagggctggagctttgggggccatcagacattccgaagactcgccacaaagacctggcagccaaccttacccggtggggatgtggggggccttgccccctgcctagggtggcgtgacactcctgaggaggctgcaccttcccccgcatcggcagcgcgatgctaatcacgccggcggtcggaagaacctcaaaaatcacaaacgcgccccctacctggcgcgccagatgtcggagggttaactcctccaatagggaaccgtgaggccccccctttgagagttcggccgggggcagcgggtaattagcaaggtctttcgtaggcaaaagagacacaagggacttatacaggttcgggtcactgagaagtgtaataacctactcctgtgctatgctcgctgagtgaaggattacaagatctccttgttagagaagaaggtggtgctgatgatcgggggtaagagactgctctagtgtgtaaaatggctcatcccggatccatccatcgacccccctccccaagtaggtttgacctccttttatatctcaaggggttaccacatgggcccaaaaacctagctttggtggagaagtattacattctttgcattaaatgcatgtcttatttcttgacttgggaagcgggcgcacgtcatcttgatgttgggggcatgtcaaatcttgccgcctgacatgggagggcgcccatgtcagctgctattaatgggtgaagacttctgggctcctgcttacgccgggaaatggaaaccccaattgaccagggaggatggaccgaccctggccaggatgagaggttaagacctttcgccatcatgactgatgggataggacggggtgcacgccttctgacccatgcggtagtgcacctgacaccccgggtcctatcggtcattcgaccggtcacagaccaatttgggcgcgctgcacgccacattaaatgtggcgtggcgcgcctgctcaagttgccattaatgcgggtaggtgagcgctcgaaggtggccacctaacccaccgcacgtggcaac

SEQ ID NO: 11355 - DNA, 10847 bp, Oryza sativa
acccctagtcacaggagggagggccacgtggcgttggggggcagcctcctccggctaattttgggacgaagtggccgccaccccgcttcgggcctaactcccctcgggggagggccacgtggcattgaggggcaacctcctccggctaatctctgggacggagtagccaccaccctacctcgggcctgactcccctcgggggagggccacgtggcattgaggggcagtctcctccatataatctctaggagggggcagccgccactccaccccgggcgtcaccccctcggggaagtgccacgtgggtctggggcagcttcctccctccaaactcagtaccgtaagctgggagggggcggccgccactccactcatgcgccaccctcctcaggggacgccatgtgggtttgggggcggcctcctccctctaaacatgatacccccgggctcatatcaccgacagatgccgtattggttaatgtttctgtcttgtaacctgctcccatacaataaaaggtgggtaggaggccctctagggtgtagagattctcaactagaacgtcagatcaatatacactatccccaaacaggagttgggtattacctctcattgagagggactgaacctatcttccttatctccgcatctatccacttttaggtctcgtacgctaccccttttcatattgccaaaatcttgtttcgacaattagtgcgccatggtaggagatgtatcgagttacctattgacaagtgcgatgaaatcaacttcataagtcaccgtcttcgtcttcgcttcgggaatttcgacttcttcgtcaccgacaacttcgacaagctcttgctctctgactcggatccaaaccaattaggagagatacaatttaaccaggcgagtttcagattcaattactggagctaccagctgtttgaattaatggatgggctaaggcccactcgaagattaattctttggaaaatcacaaaagcctacctcatgggatgacatgcatggggagtttagtaccaccttgcttattctaggagagggggacctccttaaaagggaggatgccctcctagccatttgaagcatgtgtggtggagagaagagggggaacacacgcgcgctcgctcgcctggcctggcagggcaggggcgggcgtgcatgacgtacgtgtcgaatggtctgcaagattagctcctcacccttgtgcagctgtagcctccatttgcagttttgttttgccgcgggaaattcggatttgttttgttttggaaacattccgaaaaatccgatgcgtgaaaatggcgtggagtccggataagttacgcgcgacatatccggttcggttacgcggagtggagatcgtgtgggcgccctgatcaagcgacctatctctatataaactgagccgccgccttcacgcaacacacgcgaaatcaatctagggtttgcctcctactccgtgccgcactgtcgctcgtagactactccatcccactcgccggcttgcaccggcgatcgagagagcaggtctctggaacctctgccttcgacgtcctgcaccgggagaaggcgataatatggtttttgggaagcgctttgcgcgactgctctctgttcgtttgcgacggctcgtcttcctcttcgctcgcgtgctgcgcgccttcgtcgacgtccgcaaccgcaagtgattcctgccgagcaaccggttgttccgaaacctcggtacgtgttcaatatgttgcgcatatttaatctgttcatgttttactgcttagtttacatgtgtagatctaatgatgggttaatgctagtatacatctgaaatgtcatgctttatttatggaatatattaaatcattatatgcctataatctcaacaatccaaaaaccttattataggcactgtgattttactatggctggttttgccaatgcactgaggccggataaattcaccggtgtgcattttaagagatggcagatcagggtcactctgtggctgatagctatgaaatgcttctgggtgagtactggcaaggctatgggagttcttaatgttgaccagcagaaagaatttgatgaggccactactctctttgtgggatgcatttttagcgtgcttggtgatcgtctggtcaaggtgtatatgcatatgaccgacgctaaggagttgtgggatgcactgaatactaaattcggtgctactgatgctagcaatgatctgtacatcatgcagcagtttcatgactacaagatggctaacaaccgttttgtagttgagcaggctcatgaaatacagaccatggctaaggaactcgaactccttaagttgtcttacccgacaaatttttggccgggtgcattattgcgaaacttcctccatcttggagaggtttcagtactgcactcaaacacaagagacaggaatacttcgttgaggggttgatagcgtctcttgatgttgaggagaaagctcgggaaaaagactccgcgtctaagggcgatggtgggcagtccagcgccaatgtcgtgcacaaggcccggaacaagagcaaaggttaatacaaagctcagcagaccaccaacttcaagaagaagaacaacaacaacaatcctaattaggatgagaggacttgctttgtgtgtggccaacctagtcatctggctaggaagtgtccacaacgcaaggggatgaaggcacctgcagggcagacttccaagcctgctaatgtgaccattggcaacactagagatggaagcgggtatggtaatttacctactgttttttcagttaatcagtctactaattggtgggttgatgcaagggccaatgtacatgtttgtgctgacatctcattgttttcttcttatcaggtcgcacggggttccaccgtcctaatggggaataggtcacatgcttctgttcatggtgttggcacggcagatctaaagtttacttcggggaagattgtgcagctgaagaacgtgcagtatgtccctactatcgacaggaatcttgctagtggctcccgtctgactagagacggatttaagttggtttttgagtctaataaagtggtcgtgtctaaacatgaatattttattggtaaaggttatgagtgcggaggcctgttccgcttttccctttctgatttctacaataagtctgtgaaccatatttgtggcagtgtggatgatgaggctaatgtttggcattcacatttatgtcatattaattttagcttgatgtctcggctttatagcatgtgtttaatttctaagttttccattgtcaaaggttctaagtgccatagttgtgtgcaatcaaagtaatctcgcaggcctcacaaggctgctgaggagagaaacttggcacctctagaactcctacattcagatctctgtgaaatgaatggggtgttgatgaagggtggaaaacgatatttcatgtcgttgattgatgatgctactagattttgctatgtgtatttgttgaaaacgaaagacgaggctttagactattttaaaatttataaggtagaagttgaaaatcaacttaacaaaaagataaaaagacttaggtctgatcgtggtggagagtttttctcaaatgagtttgacttattctgtgaggaacatggcattatacatgagaggacgcctccctattctcctgagtctaatgggattgccgaaaggaagaaccgtacactgactgacttggtgaataccatgttggacaccgcgggactacctaaggcatggtggggggaggcattgttgacttcgaatcatgtgttaaatagagttcctaacagaaataaggacaaaacactatatgagatatggattgggagaaaaccatcactttcttacttgcgcacatgggggtgcttggcgaaagtcaatgtactaataatgaagaagcgcaaacttgggcctaagactgtggactgtgtctttctgggatatgttcatcacagcgttgcctatagatttttaatagttaaaaatgtggtacctgatatgcatgttggtataactatgtagtctcgtgatgttaccttctttgagagctttttcccaataaagaatacacatagtagttctaaccaaccctctaaaataattcccagtttaatcacaccaccagaacaaattgaacatacacatgaacatgtcactgaggaggatggcaatgaagctcctcgaaggagtaagagacaaaggacggctaagtcttttggtgatgatttcactgtgtacctcgtggatgacactcctaagttaatttcagaagcatatgcatctcctgatgcagactactggaaggacgctgtcggtagtaaaatggattccattatcgctaacgggacttgggagttgatagagcatctctatggatgtaaacctgagggatgcaagtgggtgttcaaaaagaagcttaggcctgatggtaccattgaaaagtacaaggctcggcttgttgctaagggctatactcagaaagaaaacgaagatttctttgacacttactcacccgttgccagattgaccacaattcgtgtgctactttccctagcagcctcacatggtcttctcgttcatcaaatggacgttaagacaacttttcttaatggagaactagatgaggagatctatatggatcagcctgatgggtttgtaattgaaggtcaagatggcaaggtgtgcaaattgttgaagtctttgtatggtctgaaacaagctcctaagcaatggcatgagaaatttgatagaacattgacatctgccggcttcgcagtcaatgaggcagataaatgtgtgtactatcgccatgggggtgagggagttattctgtgcttgtatgtcgatgacatactgatatttgggacaaaccttgaggtgataaatgaggttaaatcattcttgtctcaaaattttgatatgaaggatttgggagtagctgatgttatcctaaacattaagctaattagaggtaagaatgagattacactcttgcagtcccattatgtggagaagatcttgaatcgcttgggctacattgatagtaagccttctccaacaccttatgatcctagcttgttgcttcgcaagaacaagagaattgctaggaatcaactggaatactcccaaatcattagctcgcttatgtacctggctagtgcaactaggcctgatatctcctttgctgtgagcaagttgagtcggtttacctctaatccgggaaatgatcactggcgtgcgcttgagcgagtaatgcactatctgaaaggtactatgaaattggagcttcactatactgagtatcctgcggtactggaggaatatagtgattctaactggatcagatcaaagccactagtggatatgtcttcacactaggtggtggtgctgtttcgtggaggtcttgcaaacagaccattttgacgaggtcaaccatagaagcagagatgacggcactggatactgctactgttgaggcagaatggctgcgtgatctactaatggatctgcctattgttgaaaaactggtgccgactatccttatgaactgtgacaatcaaacgataattgtcaaagtgaattgttctgaggataatatgagctcatctagacatgtgaaaaggcgattgaagtttatccgtcaattgaggaactccggagttataacgttggattacatccagacagccagaaacctggcaaatcccttcacgaagggattatcacaaaatgtgatagacaatgcatcaaaggacatgggtttgagacccatgtgagttatattatggtggtaacccaatctatgtgatcggaaatcccgtgaattaaaacctgggaagaacaaacattagtaaactagaggagagtaccaatctataccctctctaagtgaagatgagtgtactctcgtgagctgcaaggcaggttggctataccttaatgagttctgttggctttaactagcgaagatattgtcctgcagagcattcttgaaagaactcacctttgtgagcttgactattggtcgcagtctatggagattttgggtgaatcttctaggaagcttactaaagacctaggagtatgtcttatacgctccacccgaggggtagtctacagacggtctagtaccagataagactctaagtgaaacttgcttgcacaagacttgcaattcaagacgtagtccattgttcaagttgtgagtaagtgtagctttagttctaggtggatgttcaaccttaatcggtcttcatcgaaccgctggtatataaacagtacattggaaaaggcaaatctcagtgggattttgagatttggtgggggattattggaattaatggatgggctaaggcccactcgaagattaattctttggaaaatcacaaaagcccacctcatgggatggcatgcatggggagtttagtaccaccttgtttattcttggagagggggacctccttaaaagggaggatgccctcctagccacttgaagcatgtggtggagagaagagggggaacacacgcgcactctcgctcgcctcgcctcgcctggcagggcaggcgcgaaattggctcctcacccttgtgcagatgcaggctccttttgcagttttgttcggttacggggagtggagatcgtgtgggcgccctgatcaagcgacctatctctatataaaccgagctgccgccttcacgcaacacatgcgaaatcaatctagggtttgcctcctactctgtgctgcgtgctgcgccatcgcttgtagaatactccatcccgctcaccggagtgcaccggcgatcgggagagcaggtcttcagaacctctgccttcgacatcctgcaccgggagaaggcggtaataaggtaatggtccgcaaaattggctcctcactcttgcgcagatgcagcctccttttgcagttttgttcggttacgcggagtggagatcgtgtgggcgccctgatcaagcgacctatctctatataaactgagccgccgccttcacgcaacacacgcgaaatcaatctagggtttgcctcctactctgtgctgcgccatcgctcgtagactactccatcccgctcgccggcgtgcactggcgatcgggagagcaggtcttcggaacctctgccttcgacatcctgcaccgggagaaggcggtaataaggtttttgggaagcgctttgcgcgactgctctctgttcgttcgcgacggctcgtcttccttttcgcacgcgtgctgcgcgccttcgtcgacgtccgcaaccgcgagtgattcctgttgagcaaccggttgttccgcaatctcggcacgtgttcaatgtgttatgcatatttaatctgttcatgttttactgcttagtttacatgtgtagatctaatgatgcgttaatgctagtatacatctgcaatgtcatgatttatttatggaatatattaaatcattatatgcctataatctcaacatcagcacattaccttcatccccatgcagacttgtttcgggagcttgggcttcgccgccgatactggctttgccgttctaatcttgaaactggacggtgtggatcatctgttccttgagcaagcgtaccgagccgaccgagcacttttccagttccaagcccgaagctttcccgccgtatgtgcagcagcgttgtcgatatcgaatcggattcacgcaactactgtttgacgcaacgaccatacaagcacaactggctgatcgttgatgaggagcagaggtgttcagtaagagcaagtttaatagtatagccaactactagctccaattcatctataaccaacctaatagcttattcatacaatagttacatactaccctattaatacatggtcctacttatcatacacacagtatgtcttggagtccgtgctacagctggctaaaaatctgtagcccgctgctcttctctctccttatttatcttcttaaaatatgtttgcagctggtttatagcctgctattgtatctgctctaaaggccttgtttagttttcaaaatatttttctaaaaacatcacatcgatacatgcatagaacattaaatatagataaaaataaaaactaattgcacagttatgggagaaatcgcgagacgaatcttttgatcctaattagtccataatttgtcataagtgctacagtaacctacatatactaatgacggtttaattagtctcaaaagattcgtcttcggtttccaggcgagttatgaaattagtttttttattcttgtccgaaaacctcttccaacatccggtcaaatgtccatgtgatatcaaaagattttcatttcgcgaattaaacagggccttagttccccaaaacttttcccaacaacatcacatcgaatctttagacacatgcatggagtattaaatatagataaaaataaaaactaattgcacaattatagggggaaatcgcgagacgtatcttttgagcctaattagtccgtgattagccataagtgctacagtaacccatatgtgctaatgacggattaattaggatcaaaatattcgtctcgcggttttccgacgagttctgaaattagttttttcattcgtatccaaaaaccccttccgatattcggtcaaacatccgatgtgacacctacaaatttccatttccctaactaaacaagcccaaaaaagaacggaggaaagcatgtacaagatccctgcagtagtcgagcaattgagagcaaggctagaagagagtacaatagcaagatacaggtcagctgtaagcacacgtagagaagagaagagaagaaagagaaggaaagaagagagagaagaaaagcgttgtagctacctgaagcacgaactccaatacaatatgtgtatatgaaaggtgtgactatatattaatggtgtagtatatgcttataggtagaataagctattatattgattatagatgaattgaagttagtagttggatatactattaaacttactctaataatatagcatgtttgtcggttgaaagattctttgtagctttctcttagactacccatataatagctagctctttataattaatacatggccgacttgtctctttcatatattttcttggttttgtgtacaagccagctgctagcgatataagtgtgccacgtcatgtaaagcaaattaattagtagctagagaatacagtaacaggctattggcacgttaaacaagattaagaaattttactatttttttaccgcatggtgcctttcctctctccctcagtgttctttgttttgcttcaacagggatgcagttaatttgggtgcctaggagcctgcgtgtagtcggcgacagatttgtcgcccgcttgctctctcttttctctattaattatcatatcatcgattttaaattgatttaaattctaatgatcatatataattattctatccccaacttaaaattggtttaaaatctaataatcatatataattaccatatcctcgatttaaaattgttttaaattctaataatcagatatcgccatacaacaatagaaagagatgaatcttcaatacattttaaaacaaatttacatcatccatacaacagtctaggctaatacatcggttttcctcacgtactttctcctcactaatgtttcctccttatgatcagctcgtgagtaaggggtgtcttcatttgataggaggatgctcaggtcaactgtcaccgcgaacggaagttgcccgtcgaactgattgtaatcttcgtcagtcttatcatcgactccgacgattttccttttgccagggagaaccacgtggcgcttagactcgttgggccctttccccttctttgctttgctagtcatgtccttcaatgtagaaaacttgcgttacatcattggctaggacgaatggttcgtcggagtatccaaccttagtaaggtcaaccgttgtcatcccactatcatcgatcgttatgcctccaccagtcagcctaacccattggcaccggaacagagggaccttcagaggtcaatagttaagttcccatatgtcgtcgatggcaccgtaatacgtgctggttgggccattctgtctaatggcatcgatacgaacaacactgttctggttcgtgctcttgctgtcttgggctattatgtaaaatatatacccattgatctcatatccttgccatgtcgtgagccagatggtcccctctccaagaaggcaagctgttggttaatcgtcgttagctatgagatgttgtcgtagccacgctgggaaagtatcaatgtgatgtcgtgcaatccaggcatcggacttaacgatgtttttggaccgaataatcgccatgtgctcctcgatgtaaggagccaccaacgaagattgttgcaaaaccgtgaaatgtgctttacagaataaatcgttgtctactgtcacgcccggaaattcactagtaatttccaaacttatttgtgcataaaatcctcgtccaggaatcaaccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataat

SEQ ID NO: 11356 - DNA, 1850 bp, Oryza sativa
atcataatcaccccctcaaaaaccagaggcatggagtccccagcaacccccgtgggcttatctccgccacttctcagtctggtgctctgcaatgaaccatgctatacgaaaggtaaagccgttgcccacgctggcttgtggttggcatgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagttgaaccaatatatataaagctcaactagtcaaattataatatcccaaggtatcaaggaatagagtaatcaatgcaaacaggccataacaaaggaataggttcacaccacccggtgacattcgaaaataaatgtacagttgaaataaatagaaaatttaaatataggatcaacatgctcaaaggattgtgtttagcatctgtgtgacttgccttgcaataatcggtcttcaattaatcttcttgaatacttccggcgcactcacgaaccttcgcaacgacggaaacgacaagctaacacgcaaaacaaagaaaaagactaataaaaaccaaataaacaatacataaaaagtaaaccaacatgtagatcatgattttagatgaatttagcaacctgaaccactcaaaaccgagttacgatgatttagttatgaatttccgaagatttaatctattagaaaaacaggaaaaagaaaaaaacgatgatgacgtcagcgatgacctcatcaatggtggccggctcggatggcaagcttgcgggagctagagcggccggctgcggatttggaaggcatgcacacgtagaggacgacgagacgaacccaacggtactcaccctcgaaccaaacgacgaacgacgacggccggcgacgaagtgggtggcggcggcggctcggtcggcggtggcggcggagctccggtgaccggcgatagcggggagggagcggccaggcttctcctcgctctcgcgcacctaacagtggtggcggcgaccggcggcgacgacggaggcgacggcgcggcgcggatggagtcagccggcggcaacggcgagctaaacggcggcggcgcggcagctacgaggcacgggaaagctcgggagatggggcaaacgaaagaggaggactaggggggtcctttatatagccatgggagctcgggtccgggcccaaatcgacgggaaaaactcgggaaagtttagggttctcgccggaaaaggaaggatttgatccgcgaaattggaaagaatttccatagaaaattttgaggatttcttagggaaaaggaagaggagattgataggattccattcccgcaaccaatttggaaataggagcaacggggaggtcggattttggaagggaatcggcggcactgtgcacggcacgggagacagtcggctggaggaggaagatggagtactgtagcgccagggaggcaaaacagactttcggcctggctgagaggaagggagaggggaaaggagggaatgggctggattcggcccaagctgaggaggaggatttttattactttttccaattaaattaatcaatgaaatgatctttgaattgttaaaaatacttccaatgctcaaataattccaagaaaaatcttgaacatacttggacactcaaagtacttaacaaaattataattagaccatttagggctgcaggaa

SEQ ID NO: 11357 - DNA, 7757 bp, Oryza sativa
ttcttatcctgcatacttattattctatttatattagaggagtgcccagacgactctccaagcattcaaacatactttccttctctgccttgcttagagtgtagctggttgggctcaagtactggcttcctttctcctttggttccatgtagaggtcctcgcgttgactcatatcttagagatcattgtgtgcttcaagtgtatctttcgacttcccgtatacacctaggaagcccagcaagttgacgcagaagttcttagtgaggtgcatcacatcgattgcatggcggacgtccaagagggtaactcccaaaaaatagacttcttcttctacatcgccgcgtgaccatcttcgctggctatgggttggctgccaggtccctttccaaacactactttgagatctttcaccatatcgaacacgtatttaccgttgcgaaatataggcttcttacggtagtccgccttctgttcgaaatgcttgcctttcttgaggacaggttgggtcacaacaagaaatcgacgatggcccatgtacacaacctttttacaatgcttcagatacgtactttcagtttcttccaaacaatggaagccttgtacccattgtttgactgttcggataggttgctaagggcaaaccaatcgttgatggttacgaacaacaacgctcgtaggttaaattcctcctgtttgtcctcatcccacatagggacgccttcttttttccacaacagtttcagatctttgaccagtggtcttaggtacacatcaatattgttaccgggttgctttgggacttgaaaaataatcggcatcatgatgtatttcctcttcatgcatagccaaggggggaggttgtagatacacatcgtaacagtccaagtggtatggccactgctcatctctccaaatggattcatgtcatccgtacttaaaccgaatcttacgtttcgtgcatcctttccaaagtctttaaactttctatcgatgtttcgccactgtgacccatcagcggggtgtctcagcatcccgtcttgttgacgttcttctgcgtgccatcgcatcattctttcatgctctttgttcctgaacaaacatctgagccatggtattataaggaaataccacatcaccttagcagcaactctcctcttcgaaggctgtctgtcaacttcacctggattgtctcttctaatcttgtatcgtagtgcattacagaccgggtatgcttctaggttctcgtacttctcaccacgatagaggatacaatcattcggacatgcgtgtatcttctgcacctccagtcctagagggcagactatcttcttaccttcgtatgttgtttcgggcaacttgttttcctccggaagaatgttcttcactagttttaatacgttgccgaatgccttgtggcagacaccattttcggccttccattgcaaaaattccagagttgtacccaactttttgtgcccctgttcgcaacctggttacaatgacgtcttgtgatccgctaacatacgctctaatttctgagcctccttttcactttcgcagtcctccttgacatcctgcaacatctgaccacgatcatttgcagcgtcattatcttcaacagccctttccacctcacccgttgtatttccttcaaatctaccatattgagctcagtccggaatgttctcgtcttctacttcatcttcttccatttgatcaccttgctccccatgcgaggcccaaacattatagcttggcatgaagcccatctcaaacaagagaatatgagtagttcttactgcaaaatactccctctggtttttgcacttagtgcatggagaacggataaaaccattattctgcttgttagcttcggccactctcagaaaattatgcacgccatcaataaactctttcgaccgtcggtctgcgcacatccattgccgatccatctacacaaaaagcacaaaaatcgagaaaaataattcactaaagccaaactaattaaacaatcatacaatagttatatataattattcaaacaataattataaaataataccacaaattattcatgtttaatgtgttgtacttaatttaatttaaattaacttagttttctattcttttagattaattttctatctttttctttctcatcacttttatcacaagttttttttttcaaattctaaataaacaaatttgattataaaataataccacatattattcatgttttaattatatttgaagttgtaaacaaatatttaatgtgttgtaattattttaattttaaattaacttagttttctaaccaattaaacaatcatacaatagttatatataattattcaaacaataattataaaataataccacaaattattcatgtttcaattccacaataaagttgtaaactatttaatgtgttgtacttaatttaatttaaattaacttagttttatattcttttagattaattttctatctttttctttctcatctcttttatcacaagttttttctcaaattctaaataaaaaaatttctatattattccatctctacacaaactttctctctcatcatctcccattccaaatttatagaggcaaaatagtgtacaaaacatatctctaaatgcagatgctcaccacaaaatagaggaggatgaacgtgctaaccttttgacacctccaagtgtatattatcaccaaaccaaaatctccaaaaaattgggcagcgcattcccttcaaactccaaaaaattttcaagcccacgttgaccggcgctagctatcagcctcgacctcaatattaccaaaatagaagagaactagttatgcttgcaatgcatatttctgttagaataataatattccactagtatttggatcactaaccttttgcagtgaataactataaagtagaggagaatcgacatcaaataagacgattaatcaatcggacgatgtcgaaaatcacacttatatataaatggcttaagaactcagaaatgacacgatcaattgggccaaaattcacaagtcttcggagaagagaagtccagaaggccaccagccaaattgtgggctggttgggccggcccctggttcggcgaaccagacccacctccaccgttggatgtggggtttggcagggacgctctagatcttctcctgatgacggttgcagggtatttcagacatttcacagcagttacaaccgtcatacctgcctatttaaggacttcaccttctcatttcactcacacatctcaagcaaagctctctcatattctctcaagtttagtttagtgttctgaagctagtggagtaggaatagagtagaaatcggagtccggaagccttcggaagagttcaggtatggctctagtagatctcctcttctcttttgtaagctttttgcttttattagaatactcttctttatacatttatggtattgaaatactttccaagtatatgaatgccaactttgcattatgttcatgttatactgattatactgctagcttatctgggagatgcatcagtacgggtatagcgtttgcttatgcaattactctatgtcatgacgatgatattagagtagtatctggtagtttaggcgtagtgtctagattacgggatatcattatttggattatatgctgcggatgagaagtgggccgctgatggtgacagctcagcacgggtattcctccgcgcgtgtatatagtcctaagttaatttcctggggagggtactccttcgtatttagccctggttgtatggtcatgacgggctgccgtgaggaactcggcagtcaggggtggcttctcgcagtaccaagagggcatcggatagagagtattagctagttaatcttataactagaatgtatgtatactatgtatactagaagtataggaatagattctctttctattttctttccacttagcttagatattttagtatgagaatgagtagctccctccttgtgtgtcactctacccttggattatcttaacctctgcttagactctgattatttcaagtaacatataaattattagtccggttctctctactatgatcttcccacgggattaaataaatacaatactgtcagggttttggataccacatacctaatagtagttcactaaatctcagcaggacccaccacataccatgtcttatacagaaacaatcttcggatataggaggagttccgcataaggaaggatgaatatagttctacatagaaacgacaaggactactcggattgtatccatattggtttccctagttctatttggacaatgggacacctatgggtataaatacaaggccccctatgaggaaaggggagaggggaacgatagatcaatatacaagccaacatacgccaagacaagacgccggatatctatgttagagatttgtctaggaggaccctcgtatggtacttacgactaccgtcaggagggatctagcactatctctgatctcgccgggcacggattcgaggaggaagactaccctgttgtcgactacgtgatgatacttcaagccatcacgtcgacaacaaatagataggctacccccaaatattgtactggtgtgattatggtgaataagagcaatgaccggcatcggccaacaggagtagggttattacctgacaattcagaggcccgaacctgtataaaaatcctcatccccatctcttttacctcaatctcgcatatatcctagtacctatgatccccatactatgcaaataccggaatcgcgacatcaaacgtcgacagatacccttggaatactctcgggtgaaatgctataatggtatatccgtgcgcttgcgaatgaactctgtaaccataatataccagaagtatttctgcgccattgctcggagttatatttctaataatatcgttaagaaataccaacagccttctcgggctagctagaggaagaagaagactatatatggatgggatctttagtcccggatggtgttaccaaccgggtctaaaaatcaccatgatctttagtcccggtttgtaacataaatcgagactaaagctctcatctttagtcctggtttgtaacaccaaccgggacaaaagatcccctggcgcctgacaacccctgacgcatttacaaccgggactaaagatgacatttagtcccggtttgtgttaccaaccgagactaaagatcatatcttcctgttgcacttataaaccgggactaaaaataatttttagtcccagtttttgggtgaaccgggacaattgtggtttttgcccatcctggcaaagatcacttctccagtagtgtcctctccgtccgcgcacacctcctcctctcgacaagctcacggacgacggcggccatcgtggccgagagaggcgaggaggtgcccaccgtggccactcctccgcggtcacctagctgttggcaccagggccggtgatggccgagagggcttcctcctcttcttcacctgtcagcttcgcggtggggcagagaggcaactgcggccgcggctggaggaggtgggggagagggggcgggaggtgacggggggtgctgctgtgagcctgcggctgagggtggggctgcctcagcgtggagctgatagggtgggggaagtggatgagttacaggagcgtgcgtggtgctcatcaaggtacctctacgccaagcccaccgcgagttgtgatctggccaatctcataggtacgaatgttgagacttgtacattaaagttgtaactttttagatcatgttcatgtgcgacacgaagtccgtgtcgagatcggatttcaattattttgtgtttcagtcttgtacaaatagaataatttatctggtgtaatgtgaaatagtttgttttgaaaaaaaattacctcttatctagaacttgacaaaagattgtattcgcgtgcaccgtgaagaatattctcttaaaacgcttggatcatgaaagtgtagttttccatagcaaggcatggacatttttctagtaaatataaaaattaaaaaatatgcaaggcttctagatgaattttttcgtccgtcgcaggtagaaacctcacgcgcacggaagcctttcaaccgattcctatttctagtactatggttgggaatcaccaccaccgctacccatgccgcatccgcctcccgccaccggccaccgccaccagccaccaccacgcggccgcgccacctcagcctcgttgtcagcgccttcctcctccctttccctctcggcatctcctagcacagcggcggtgcacctttgaggcacacacgataaaaaaaaaatcctccgagttactccctgctgccccaaatgcaaattaatccccatccccgaatcacaactcacaacatacaatatgcaccgacactaaaaaacgaatccaaaattttaagtatcatagccgaatgtataaaagaaataagaacagaaactaatcgatgcgggatggagcataagtcactaccaacatttttttacacacgcattgaccaaacttagaaaataaataaaacaattaagttttttttctagagattacagggaatcaataatcactaaattgactcaaaaatttaaaattctccacggattgtcggttccaatacccttgatgaacagaacgcttgcccaattaatttctttgtacacttgatgggcttcaagtcttatgatccatgtttcgctgatgcgtgtaccgaatagttggttgaggtgttgaattcggataattgatgagtctaatctaaaatttactgtcacagcctgatttttcgtttcaggatttataatttattcaataaattattaatagaatttatattaaaagttcattaatttacaagtgaagttaaatgtgggaaataaaatttcctaaacataaagcatggctggatttaatttgtattaaattctccatgattaattatactctctgaaattttctcggatttttcagagctcaattcctaattttaataatacaaagaacagttcagcaattatttaattaaaaaattaatcattaaatgatatgtttttaatattgttaaataattagagtgtccaagtatgttcaagatttttcttggaattatttgagcattggaagtatttttaacaatgaaagatcatttcactgattaatttaattgggaaaagtaattaaaatccccttttccttttcgggccgaaacaggaaaagttcaccttcagttatcggcccattcttgcttcttttcggccggccttatccattcccgaagtccattttgcatccctccttcaatcgtgccaaggaaaaggaagcccagaacaaaagtctaatttgcctccctccgatacagtaccttcttcaacctctggacagaggccgagcctgtgcagccgtgccgatctcctcctccaatccggcctccccgttgctcctttttccaaattagttgcgggaatggaatcctctcaatctcctcttcaatttccccaagaaatccccaaatgtttctatggaaatcctttccaatttcgcgaatcaatctttccttttaccggcgagaatcctaaactttcccgagtttttcccgtcgatgtgggctcgattccgggttcccatggctatatatagagcaccctccctcccctctttcgaccgccatctctccctctctccgtagtcgccggaatcgct

SEQ ID NO: 11358 - DNA, 6055 bp, Oryza sativa
ccaatctaacctagtccattgtctgtatagcgtcgtcgtctccgtgtgttgccgccgggtcgccgtcgtcatctctccctctccgaacgtttgggttcggtgcgacttctatctgtatcccctcgggttaggtttcaatccctcggtcgtgtcgccgccactgtccaagccgttgttgctctaaccctagcgcagccactgtcgcgtcgcttgccggctgctctatgcaccgccgctgccgccgtcgccttgttgccgccacgtcgctgtttagccgctggtgtgccgctgccgtgcacaccgcttgtcgtatcgctgtgccgctagccgcctagccgccgccgtgccactccctgcctcagccatgctgctgctgttgtgcatgccgtgttgtcgttgttgtgtcatgtcgcagctatgtgtcgcttaaacctagccgccactttagcccattgcttggtaatcgagttgtctagccgtaggtgtaaccctaggttcctatcggcctatcgtttgccgtaccaatgcttttaccgtgaatcgtgtctagccatcggtctagtcgcagccgttgttgagtcgttcgctcgttcattcgaacgaggtgttccccgtgtttcgttcgttcatccgtgtggagtcgtcctttagtttagagctgttcagagccgccggttccgttcgccagtttcggttgatcatttgggtgatcccgtgtcacgtagaattgactcgttgagtcggtatctcgtgaggcccgcttgccagatcaatccaagcattccgatattggtcgactaggtcaagattaatctcagccgtccaaaatcaatataaatccgtttcctcttttcagtaacatattattcctttttaatatatgtcatccactaaatatattctaatctttttccggaggttgttttaatattttatctcagttataaatcatttgtaaattgtttaattaatttggaatagtcttttctttaatagatttaattggagttaaatcttgtaaaattcataactaattcatatgaagtcggaatgaggctattcaagtctctaaatttatctaaaattatgatctacatgtttgtttacttttatgtattgtttatttggtttttattagtcttcctccttgttttgcgtgttagcttgtcgtttccgtcgtttcgaaggttcgcgtgtgtgccgggagtattcaagaagattaattgaagaccgattattgcaaagcaagtcatatagatcccaaacacaattcctttgagcatgttgatcctatatttaaattctctatttatttcaactgtgcatttattttcgaatgtcaccgggtggtgagcctttcctatttaattatggccgaagatgactttatttttctatgggttataatttaattagctagaaccttatatattggtttggttcagctagatgcttataatagattcttagccatgcttagaaacaatagctcactaatgggataaatcatgcttcactatcacttttggatatttaatggaagctcacgatggtcaatcgtgagtggttaattaattacttgccaactaaaacttgataatggtgggttgtgagcacatggttttgatggtcgtgctcatgacaattaaggaccggttcacgagtttcggttatgaaacattaaccgtgccaaccacaagccagcatgggcaacggctttaccttttgtatagcatggttcattgcggggcaccagactgagaagtggcggagataagcccacgggagtcgctggggagtccatgccttgttttataatggggtgattatgatccaggaacgatgcgctgtggtggattgtgttgtgcaagggatactgtcacagctcctttccaaggtatcgtggtggtatcgaggcgcatggtgatatgttgtggggctgtgttttgtgggtacagtggtacacctctggccagagtaaaactattcgaatagccgtgcccgcggtcatgggcgagtctaacaatatctttcgtgattagtctcacacttctcaccataataactgatcctataactggtaataatttgattagctcctggtttggaatggtacattcctggtttggagatagatcggtacagccgggtatggttgttcaggatggttgggcctgagcaattgatgattaattactctactgttttacaattcttaactgtttgctaaatgctgcttttgcaaatgagctctatattatgccatcctttggtatccttgtgcgcttgcatatttgctgtgtggcttgctgaatatgtcatatgctcaccttgcaataatcaatcaaatctcagttgaagacaagttgcgaaggagaagagggagtggagccggagcttcgctagaccgtaattccgttgttgttttctcttttcttttataagtatgtaacgttattattatgatgattctgtatattaaattatcagtttgtgtgtctcggctgatttctggacgaggattttatgcacaaattagttcggaaattactagtgaatttctgggcgtgacattttcccatccttattatatgcggtgcatgtatatacaatggcattgacatgttaaattatacagaaacaccaatgaagggcacccgtatatgtgccgattcatttgaaaccgatatttatagaacatttttcaatccatgttactcttaggaaagataaaagttaaaaccgatccctatgaatctctatatatgtgattcttaataaaaactgacaaatataccggtttttataaaaaagaatgggagtacttatacatctttcgaaagatttttatgatcgtatcacacagatttttaatctttggattaaaatccgatagatataataaaaagtaaaaagcaattaagaaacaccataatggacactaaattactatatcctcaagaaaaagaccaaatccaatacaaaatttaaaatttacatgcgaagattcaaaaattatagtgtaacttacaaaagttacagtgtaagtttcataaattacactgtaacttacaagaaaatgcactgtaaatttaagtgagaaaatcgagtgagagataagaaaaaatcttttgagtgagatatagcaaaatcgaaaaagaattgacttatatataataaattatggatgctaacgcccatccgaacgttgatgcggggaaggaaattacgtaggatatataagtcctactcctaccctcatccgaaaaaatctcagggcaggtttaccccctcatctcttcgtctccggtttcccattctttagctctcctcggaggagtcgagctcaatgtagcagagaaacttaccagcatccatgctcgcatagtcgcatgagacgtttatcgagaagaatcgtccaaacatcaacgttatttataaccctgaaggctcaactgcacgaagaaatccttgaaggctcagtcaagttcagtcaccagcaaaaattattagtgaaattcactatacaaactaaactcaatggcatacaaaatctaatcattgaataacttcatcatgaggcaactccttgcattgcagttcaagaagcagattggaattgataacgcaggcaagtaccctaggggagaagccctcctgccgctcagcctcggggtggcacgggcgggaccacttctcctcctcccctccgcctcgccgccgcccgagcggccactggcaaagtcgggcgggcgcatggacggcggcggcgggactccttgcctcctctcgcaggcacggcggctcggggcgctgccaagacggagggaggaccccaagtggtggtcatcggcgactagcttcgacgatggtggggacagatctgggcctctcatggtcggatccggtgtcccagctggtgtccacacggaggtggtcggtgtgcgcatggagaggccggcggcgcgctgggcggaggtcgacgacgtgtcgggaaggctgcaacgacggtgaccctcggcccgatgatggggacggccagttccggcgccccttggccagatccgccgtctggatgatgacggcgagctgccaaggcgaggtgggggccggcgtggcctcgccggcgtggggatggctacgggaggccggccacggagggaatcgagcgcgtgtgacggaggcgggggcctggtgctgcgacggagggggcgggcgcgccaccggcggttgcgggaggctctcgtcggcgcggagatagtggcagccactggctgcgcccaccgacggttgcggtggtgacggtggcagcggtgcagcggagtgtaggcgctcgcggtgacgttggcttgtcaagctttgacggccggatccacggccgccttggccagatcgggtcagtgcagcagaggatggcagcgggttggcagcacggtggactcgtgagcctgcctaagttgtgggtggtgggctaggcttggtggctagagggatgatgtggcggtccggcgtcatacgttgtgcgggtgggttgtgtggttttggatgacgctggcgaaagccttggctggcctttggttggcttgacgacggcggcgccattaggcgtcgttcccctccttggaggcgttgctatggcgtctccctcactaccaagaaccttttccatgcaaggatggtcgttcgtggaccccctacgtcgaagctctataagcctagctattcggcgaggccttcgtctcttgggtgccgctcttggatgtggcaagtgtccaactttctccgttttcttctaggtgaagtcggagctactttatcggggtgcgatgaagcttgacaacgataacacgttgaagttttcgagggaggttggtgttagctgtgtacaagtagtagtgctcaagtggcttgggttgatgttcaaagtggacagtcggtgtcttgctcgttttctgcgatgcctttggtaacgatgatgtgatagctgtggagtcgaagctgctgtgtcgctaggtgacaagctcggcaacgataacacttgccacgcgaagtcgaagcctttgtgtcgctttcaacaagctctttatcgatggctgttttgggcttcgccattctttcttttttcgcggtgttggtagcttatgttagagtgttgtggttttcgtccagtttttcctaattaactgcgcattgtaaggttttgtctcgttttcttcttaaaatgagacacattcttctttatataaaacgtcggcaacggtctgactgttcgaaaaaaaaagataacgcatgcacgtgatttatctttcattcagtaggacggcagcacggtgtgttccatgcgaaaattggaagtttaacttaaaattgaaagtttgaagaaaaaagttgaaagtttatgtgtgtaggaaagttttgatgtgatggaaaagttggaagtttgaagaaaaagttggtagggcttagcttgatgccttgactccaattcccggctgccactatgagctcaatggcgctcaacaccgcgtggatggtccgacccaagctcaacatctcaccagggtttcccttaccgccggtaaccgggcttaccgcggggatacggtaatataaataccgcggtaacctccttaaatttaaataaatttaaaaaataatttaaatttttgataaattttgcacggttttgtacggtttttcacagttaccacggttaccgtgtggtaaccgtgcttaccgccggggcacggtaaccccggctctggtggtttgggaaaccctgcatctcaccgggagaaaaaaaaataaagaattgggaaccacatggtaggagagaaggaggggggacatgtgtcgctttagaggaaatcaagtgtttgggatgagactagactagagaagagagcggcgtctcaatgcttggccccatcgaccttattatctctttccttccccaccttctctcctctctccgcggcgcgttaattcctctccctcagtccctctctccggccccctcctccccccccggcaacgccgcttcccctacccttca

SEQ ID NO: 11359 - DNA, 3277 bp, Oryza sativa
  unsure (1)..(3277): unsure at all n locations
tcccctaccactcacacagggcgcccttcccttcccttggcagccggcgtctcagccgcggtgccctccccctggctcctcggcggcgtcctcaccctcttctccgccacaacacaacggacggtatcgacagcctcggcggcggcacctctcctcgtagaagcggcgtcctcgcctcccatgaccagtggcgtcgctgatttagtttttgtgagttaattttccctggatgattttggatttgtgatttcgtgattcattttctatcgtttatgtattgtgtcttggctcagatggatcgaattgggggattagatttcttgggatcaaattcatgatatctaggttaaatttggtattttcgtgctgtttttggttgattgattaatttgggtatctagcacggggatttttttttccttgaagaccgacttggactcaaaacatacagatgacagacgaagcggactgaattttttaattaggggtaggtatatgatagatttatatttttattatattattaattataatataggtaggtagatatctatctatatctaatctatatctatatctatatctactagcaaaatgcccatgcgttgcattgggtgaagacagaaatagtaattagtgtgtgggagcataaaaccaccaggtaaattgaggtctttatagtcgaatcgaatctttctagtgcaaataagacgctaacatgatataattatttgctgctctaaatgcactgacatggatactaaagtttgaaaccacaaaaaatatttacttttttgtcatgtattattatgagtcaattgcagtactttgttatttttttggtactcgatattgataagcatttttttcatattgtaaagagtagccataatacaagaaataattttttgctagctatcagatcaacctcattgcactccaattgcataacctttcacttaaataattagaaggaaagaaaaaaatgtggtatatcgcagaataactttcactctaaataatagaagaaattatataatgaatggaaaaaaaagtgatgtgattaggtgtcctatggcgaatgagcaattgatgaggggaaaaaaatccaaatgtaaacacgattcattttgttggtgattacttctttttttaaaaaaagaaagacacatgtgattatttttattttaaaaaataatttattttgtcggtaaataattcattttattggtgactacattggtgactacatgttttaagtaataaaatcgcttcttttattatccgattcctgcttggcgtgagtccaaactttattcgtgttcggttgctacagtgttgtgcagtactgtgctgggctggtgggctgcttctcctccgctctgtgggctcgctggtgggctgcggctgctatctgggccggcctgctgctgctttgggtgggctgcctcgtcactaatccaatccgggctgctttggatgggctgctccacaaacaaggttttctctttttatttttcttttctcctttatttgcaggcgtaagagatcgtggccacgctttcggatcatggattagcgacgaattatcgtgtgggcccactcttaatgacggacgaaaagattaaccggaagccttacttattttttaattaggtatatagatatctatatctaataaaaaaattcgtaaggcttccattagtccgcttcgtccgtcgtttctatatagatatatagatatccaataacttgatgagtttaacgtatcataccttacccataaaccaaacacaagattgtggagatgatgggatttgctttgagatttgtgatggaacacgtgtcacctgtggtcgcgaattttctttcgcgagagcgagacacacacaagtacacaaccgcatctctactgtgggcccccttcccctcctcgcgtcgcctctccacttcgcctctataaagtcccatccaattctcgattcccaatctagcacagcacaaaggctcctccttcgaccgcagctgtgctacctacctccaatggggctggtcgtggagaaggaagagagatcttccaggctgatcccttctattggtacgaaagcagctcactggagctttgccacgaccgcgagcaatcaaatcgaaatctttctttcttttttattgatgctccaacctagtttcacatttgattttgtctgttgcaatggcaggttccccttcccaagccttgcttgaggatccctccgccggagtagggattagggagggaagaacaggaggcgattcaccatgaaggcgctcattctggttggaggcttcggcactcgccttcggcctttaacgctcagtttcccaaagcctcttgttgatttcgcgaacaagcccatgattctgcatcaggtaatatgtggtttcgctagtactctgatggagtaataagagcacttaatttgcaatgccaatcgatgaattgggcacaagttaattagtacagtattctttaccaacattccaacactgacactggcctctccatgaaaggagggagagggtgttaaactggtcaaagaacattaatactatttgatttgtttataacccccacataaacatggtgtaacaactaaacatccatgataggtggcatttgcatgtgattgaatgcacctttttactattcaactgtttctttccttatcaatttggttacatgattttggagaactcttttggtatcacaccaaattttctgtccttgaaaattccaatcagttatcaagagtacttcatttatatccaaaatgttggctccagcaaacatgagcatgaggattgaggagagtaatgagctctgaattaaaagttttctggtttatgcagattgaggccttgaaagaagttggagtaacagaagttgttttagccatcaactaccgcccggaggtaaaaaggagataatattttactgttgtctcatggtataagtataactatcttcgcattctaattggtttgttctgtatccgtcttttaggtaatgctcaatttcctgaaggactttgaggataagcttggcatcacaatcacgtgttcccaagagactgagcccttgggaactgctggccctcttgctctagcaagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11360 - DNA, 594 bp, Oryza sativa
  unsure (1)..(594): unsure at all n locations
nnnnnnnnnnnnnnnnnnnnnnnnnnnnnnnnnnnnnnnnnnnnnnnnnnnnnnnnnnnnnnaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgccaaatccgattattatttgcattactttcttagggttttctcttgatttgcacctgcattttcttggggttgtttacaaattaaatttggcttgggaggagaacttcggggtgtgacatccactgccgcccactgagttgcacctccggcatcaccgtgttgtgctactctttctccgccgcccaaccctagggcagtctccacgtacacgcgccgccatggccgaccaattggaagccgaggccgcgccgtccccttctcctccacgcagccgtcgacgtgtactcctcgccgatcttcttcgcagccgacttactccaccgcctatctccgtctataaatggccagcaagctcg

SEQ ID NO: 11361 - DNA, 918 bp, Oryza sativa
catctgagaggaaacagaaaaagtgagctgagctatagctcggtggtggcagccggtcaagctctagttcatccgtctagctaaccaccggtactgatttttcttttttgggcatctgatattttttctttctttttttctccttcacaatcctggatgtatattcaatcgaataggacggagcaacagattttttttccttgcctaagggagcagatagttgggaagtactccttggagatgtattgcttaaattgtttttcctggttttttgctttccttgttttttttcccaattctgatcggcgttatagaaagctgatatcaaagaactgaagaagtcaagcaatatgcaaggagattgtgttcaatttttttcaccaattacttctgccgtgctttttaatcttcttagatttttttttagttttctcaatgtggatttagggtagatatgctatttttttttcacacatgacctgatttatatcgatctgatgatcttagcatgaggctcttgatgtttcaggagggggaacgaatcatgtggaagatagggatcgtaccttttgcattcaactccctttgaatagcaaaatttacagttaggtcctttgcaccatctctacctttgaaggctttgatgcgtcggagcaaatcctagaatcagagaaggggacacgtggcagattttcagatgggccctaacgaaatttataagttggcatgtggcccaatgaaaaacttgatcctgaaccctgcaattggtagtattagagatgtcgatgtccaaagaatagggaccttaaatagacttatttagctatttatatatcacagcccaaagaagagagacataaaatagacttggtgaccctcaaaagtgattgaaatctaatccgtgaccctaagcctcaa

SEQ ID NO: 11362 - DNA, 741 bp, Oryza sativa
  unsure (1)..(741): unsure at all n locations
atgttacaaacatacaaattattagtcaggttctctctactatgatcttcccacgggattaaataaatacgatacccttggaatactctcgggtgaaatgctacaatggtatatccgtgcgctttgcggatgaactctgtaaccataatataccaggagtatttctgcgccattgctgggaatgatatttctagtaatgtcgttaacaaataccaacaataccctccaaccatcatagggagtgaatctccaccgttccctcaaagccctggatccaacggagctgttcctggcaggcttcctccttgacctcttctatcttcagacttgtgaattttggcccaattcgatcgtgtcaattcttagttcttggcccgtctttccataagtccgattctcgacatcgttcgattgattgatcgtctattttgatgtcggttctcctccatcttatgcttattttctgcaagaggttagtaatcctagtgctagtggaatatatattattttaacaagaagatgcattgcaaacataactagttctcctttatttcagtaatattgatggcgaaactgatcgataacgaccgtcgacaccctcctctggccccactctgccgactgttgacggttgttgccgacaaatttcgaccgtcaatataactaaaatattggagaagtagctatnnnnnnnnnnnnnnnnnnnnnnnnnnnnnnnnnnnnnnnnnnnnnnnnnnnnnn

SEQ ID NO: 11363 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnnnnnnnnaacgcatgaagggaggagatgaccgcggctcgacgacgattgctgccgtccttcttcttcgcggccggttacgagattgagagcgccggaggagcagagagccttctccctcggcttcttcggtttgagagtgaggagtagtgatgggtgaagcggctgggagggaagagatcaagagatgttgggtttggagcggcgacacgtctcggccacgcgtcgacgcgccccagagctcggtcggctctctctctctctctcgttctctctttttctctcagtctttagatcggtgggaaggatctgcacagagttggagctagcttgtgacaccgtcaggtgggcccggggcgaagtacactaagctggagtgtggggatgggtagaaaactgtgtgaaagagatttttggacgaaatttcagattattttctcttccctaacttggtaattcatagattaattccaggtgcatatgaggtcgtgaggattttattggagggtaatgaatgtacctagttaacgttttctactcaaaaattatggatagattgctcacagaaattacagaaatttaaagaagatgggcttattggaaacttatttgaatttttaggagaactaagtagagaagattaattcttgaaaaa

SEQ ID NO: 11364 - DNA, 689 bp, Oryza sativa
  unsure (1)..(689): unsure at all n locations
nnnnnnnnnnnnnnnnnnnnnnnnnnnnnnnnnnnnnnccgtcgggttctcgtcgtcgttccgaccgctgtagaccaagccaagccgagccgtcgcgccaacatattctccttgaagtcctcctcaaaacccttcaagaatcccaggcaatggcgcagcaagtgcggagatcggccaccgtcttcttcacctccggtcgccgtcgccattgtcgattccgcctcctccggtgagccattattagattactcgcgcacacaccatctctctggcctcactaacctcatggacacacatgcatgatagttcttggagccgattgagccgtcgccgttcaccccggaggttcttgccgccgccgagccgttacacgagccgccgtcgtcaacctagcttcgccagccttgttttacatctcggtgagcacactggaccccttagaaaagcacatgcatgcactcccttagtcgattcgcgcctatggcacaacatgcctacccatgccaaaacatcctccgctcggactcgccgccggcgttactccgatgtccactaaccgagaaaagtataggaatggaatcacaataacatgatcttcatttttattttggtcgtacccccaaacgagtcatcggttgcccccggcgagctcgagatcgagctcggccatggcgctctgttctcgcagg

SEQ ID NO: 11365 - DNA, 1680 bp, Oryza sativa
  unsure (1)..(1680): unsure at all n locations
nnnnnnnnnnnnnnnnnnnnnnnnnnnnnnnnnnnnnnnnnnnnnnnnnnnnnnnnnnnnnnnnagagattacagaaaataaatggaaaggttttataaaatttaaaagagagcgattaactttgcaaataaagtttaaatccaagttaaaagaaattaacagaaggcaagatcacttcagaagaatcgagaagagtgcaactaaaatatttcgcaaaaatttttcccaaaattttgagtccgttacaatcaagcatgtaagataaaagaagttagatcaggtaagatcggctgaaagtccgatactactctaatcggcaaccagaaagcagactagggattgaaattctaagcacgacttaatagatcaaactcaactgatgtagcattaagtatgaaaagaagaacaatatctagacaatcaagccgctggatgtttcatagagtggtagatatcttatataatctaagccaacctcactatttaacataatcggccgccttctactaacagatgttagccgattatagattagataatgataatgtcagagattatatagaatatatggtaactcgacgaattacataaacaagactagagtatcataaagatggaagcactaatcccgagaacgcaagccatcataataagttttacctcttgttgaagatcgaaaccgatgcagctcaaccttacatatggctcggggtctatttatacccgagaaatacaagatatgtccatattggacacgactcttatctctaacaaactcttagataccataagtctttgcggcagacttttgcccacatttatctctaaggaatttacataaaatatcctaattaatagatacaattgccttctcaggactctatccatgtgcggcaatcatcttgaagcacaccaactcgaacccgatgtcgtacaaaagtcgtattgtcggaatcgactgtatcactcaacccagtctgactcggacttagccgatcccagtcgtagccaatccggactccagccgattcttactctgtttccgcaacaatccttatctccgattccgctttgatcccatcttcatcttcgatgctgatattaccaaatttggtcgttaacacttgatgggataattacagtattagacctttttagtatcagaatgagctgcatgctcgagacatctggccatgcttcatattcgtaattatccaactaaaatacgactgaatggtgggctgtgggtgcatgggtttgctagttgcacccatggcaattaaggaccggttcgcgggatgccttggaagaacttatcgtacttaccacaagccagcgtaggcaacagttgggcttgtagtgtagctttcctctagccgacatacccagacgagggtgggcgtgatggagttgggtcggccggggtgtccgattgatcggcttccggattcaccgcggcacgagataggggctgcccgttgcctgctagggacgggggcgaaccctgaggtgtggtgcgatcggttagagggtgttatgcgaagggtcctgtcacgacctctttccggtatgtcgtggtgtcatgtcggcgcacggaaacgtgtggtggggctgtgtcttgttggtacagttgtacacctctgatcagagtaaaactattcgaatagtcgtgcccgcgg

SEQ ID NO: 11366 - DNA, 5778 bp, Oryza sativa
gaaatttgggctaaatttctgggcgtgacacccaggccgctgtgtttcgcatcaacacgctccggggcggcgaggtgcacagcctcgccctcccgtcgagcacacatacgctctgcagagtttggttcgccaccggtttgtaacatcttggtatcacgagaccatgatcatgttcgccgctgccgcggcgccatgtccactagctctaacactaccggcgattggaagaagggcctcgatgcggtgattgagcgcctggacgccatctgcggtcagatttctgacgtcgacaaccaacagcaatcgcaccacgtcgcaatccaacatctggaacatgctcaccgcgatgctgatggcgatcgtggcgatgatggctgtcattctaattgtgcaccccgctaccacaagctcgattttcccattttcccaaattcaatggccaaggtgaacccctccttttcttaactgttgtgagcagtttttccgtggtcaacggacaccaaaggaggttgtgagcagtttttccgtggtcaacggacaccaaaggaggggatggtttgactcgcgttgtaccatctgcttgacgtctcgagtgcgaccatggtactgcttcatggcaccgcttctctaacaaacaatcaagcaaaatatagaccaacccaattgtacagtggtttttggagaccattatagtcatccatccgaagaacgggatcataaaaccatcgaagtatcaccagcgaagcaatggcccaatgttgtaggatctccggatctcccattatatttgagagatgaagtgaatgattcaaatcatcaaacaaatataatgaaatatcttacgcctcgagagaagaatattagagacattgctggacctttagcctaccagtcaacttcagcctgagatgtacccgtcaaaccactcgaaagtggcgaccagatgtgttacatattcaggagacttgacaaaaatagctaaagatttacaacatctcaaatattcttaactcgtactcatgtgaatctagttcccaggatgtgcactagattcacacttttatcttaagcatggaaatcatagcaaaatacacttaagacgaaaatgatctaaatcacaactatttcatagttacataggccgactagccaatgatctaaatcacaactatttcatagttacataggccgactagccgaatatagtttatagaacaacggaagcttgactacccaatcctcaagcacaccgactaggggtttaccccattaagttcaagtcctagaagaagcagacgaaacccgcatcactcaaagactaagtctaaaacctgcaagcaaatagttaatccaatagcaagagccagtacattattagaaataatgtactggcaagcaccaagacaagcctaacaccctacttgcaaggcatataatcaaagaaggcataatatggttccttttagcataaagcaagttttatttgcataaaatacattcaaatcatatttgcgaataaatgaggaatttgacaaacaaaatgttgaaaaacttgaattttaagtttgggcctcatgtggtatacatatgttgactagttgtataccgatagggggagagtgtgcccagactgatctaaggactatactcaatgtctgttcattatgtttaccgtacatccacatgtgttattatggggtgaccttggcctactaagttaagtgctggtctaaccttgcattcgggaggccgttgtagcattcgggaggccgttgtagtagcgatagtgcctacgagtgaactgtagggctatttgtgtttatgtgtgtattgcaaaggagatgactgtaccaatccgctttttatgtgtatgatgtttatgaggggacgactgtaacgttccgcctcacttttatttatggtttggtagggaacgactgtactgttccgcgtgaggggacgactgtaatgttccgcctcacgtacaacgttgagtgccacataggaagcgattgtaccggcttgcctatggcgttatattggtaaagaccccccaatataatgacattaagattctagaattagtgtggaacaacactcattgtgctcatgcaaggattagacaagacttaatgtaaaagcctcgttgtgacctctagactcgcttaatgtgtagagtgtggtggtaccgacgggtatcggacaaactagagcgattcacattatgtgggtaaagctgtacaagctcagcagagtctaaaaactaatcgattagccgtgctcacggttatgagcggtatgtggatatgtgttgagtatagacttatgtttaatcttctaaatgctgaaatttaacttcaaaatgtgatgagatttaagaatgatctccttgctactatggatggcaatgaggtgcatatttatatatgattaatgcctactttgatggccatatgctttgtttgtcaaattcctcatttattcatttctgtccagaacttgaataaaatcattttttcaagttaataagagcccaaatgacaagtactacacatactaagcatggctaagcattatagcaatctagtgacatctaaactcatatataaagtggcatagtcatattgttcctaaggttaggaatgtgggatatggatatatgtggggttagggtgataatgcaagtaataggagtttgtctaacaagtttaacaaaattttaatttattagtgtccaatcgacatgcaagatttgcaaatattttcaataaccttcaaaacataggttcaaagtgatcaaagagagggaggtgggacttgccttgcaactggaaaatgtcagcacctaattcacttcttcaccgtttaagcaatcatctatacaaagtacacgttatgcaattaaacaccgaaatatgcgaaaaatccagaatgctctaaaatgcttgatttgtgcataatggataggtactagtataatatgaatttaggtgaaagaatttctattttatctctttttatttgagagttatgaattttataagtttgctcggtatagggtagtatttacttaggtactattgtgaaatgctgttgtaaggtgattcttattaagtttatgtttgctgaggtgaagatatgtgttttctaagactaacaaatttggtttcacaatttctagagttaacatgaattctttatgtattttacaagttataacgtgttctaggcatatagtctctatgtgtacatggttttggagatttaggtccagaacttgctctaacttgctagtgatgtataaaatgagtattttagttagctaatctaatcttagttcataattttagagtttatattattttactacatattttataaatagggatggtctatgttagttacttaacctaccaacctagaaattgttatgagttaagtttgctaagtctttgggaattaaggttggaactatgacctctctggtctaacaagttttatttttggtttattcatagctagagttcatcttaaatacttctacacatatattttgcttaaccaatactaggtgattaactcctagggtatctaattaaagattagagctataacctgtacaaaaagtgccatattttatttactatgttgaagcttaccattttctggttctatagaaacttggttcactctatttggactaaagatgaattttctacaaattttacaaattaaaggctgctcaatgttggttattccttacataaatatttgaggcttttattatacagtaagtatatgattttattttacaacttggaagtatatgttttgatgactctatagaacttgggtttactcaaaaaggatctaagatgaattttatataaacttctaaagttcaacttatctaaaactattcattttaaagataatagttttagaggcattaggtacaaagtaagtatattattttatttcactttacagtagaaaacaaattggtgattctgtggaatgtgaatttaccctaaaatgagttgagatgaattttatatgcattttataagtttgtgcatgctttatgtatattttttctcaaataaattttagaggtgaaatttgtactgcaagtgtaagtttttatttcataacattaaatttcatccttatatgagttcacagaaactttaatcatctcaaaatgagttatatttgattttatatggatttttacaagttttaagtacttttcttatataatctcagattttgtttctaggggtccgctgtcagtcatacggacaatatgcaaaaaggcccttgagatttctagaaaccaacccgtagtcctaggcccatatgtcagtgtttagtatgtttatttaaatttatttatttaaacgttatatttaaataaataaattctcatgaacgttatatttatttaaattctcaaaacgaagtccctgcgagaacagagcgccatggccgagctcgatctcgagctcgccggcggcaaacgatgactcgtttgggggtacgaccaaaataaaaatgaagatcatgttattgtgattccattcctatacttttctcggttagtggacatcggagtaacgccggcggcgagtccgagcggaggatgttttggcatgggtaggcatgttgtgccataggcgcgaatcgactaagggagtgcatgcatgtgcttttctaaggagtccagtgtgctcaccgagatgtaaaacaaggctggcgaagctaggttgacgacggcggctcgtgtaacggctcggcggcggcaagaacctccggggtgaacggcgacggctcaatcggctccaagaactatcatgcatgtgtgtccatgaggttagtgaggccagagagatggtgtgtgcgcgagtaatctaataatggctcaccggaggaggcggaatcgacaatggcgacggcgaccggaggtgaagaagacggtggccgatctccgcacttgctgcgccattgcctgggattcttgaagggttttgaggaggacttcaaggagaatatgttggcgcgacggctcggcttggcttggtctacagcggtcggaacgacgacgagaacccgacggcggcactcggtgcgcgctccggagcaacgatggtgaggtccgcgttcccgacgatccgctgcaccaaatgggatgaaacttagaggaatgaagccggcatcctgagtagacaagggaacgcatgaagggaggagatgaccgcggctcgacgacgattgctgccgtccttcttcttcgcggccggttacgagattgagagcgccggaggagcagagagccttctccctcggcttcttcggtttgagagtgaggagtagtgatgggtgaagcggctgggagggaagagatcaagagatgttgggtttggagcggcgacacgtctcggccacgcgtcgacgcgccccagagctcggtcggctctctctctctctctcgttctctctttttctctcagtctttagatcggtgggaaggttctgcacagagttggagctagcttgtgacaccgtcaggtgggcccagggcgaagtacactaggctggagtgtggggatgggtagaaaactgtgtgaaagagatttttggacgaattttcagattattttctcttccctaacttgttaattcatagattaattcgtgttgcatatgaggtcgtgtggattttattggaggtaaatgaatgtacctagttaacgttttctactcaaaaattatgga

SEQ ID NO: 11367 - DNA, 1530 bp, Oryza sativa
  unsure (1)..(1530): unsure at all n locations
nnnnnnnnnnnnnnnnnnnnnnnnnnnnnnnnnnnnnnnnnnnnnnnnnnnnnnnnnnnnnnnnnntgaagcggctgggagggaagagatcaagagatgttgggtttggagcggcgacacgtctcggccacgcgtcgacgcgccccagagctcggtcggctctctctctctctctcgttctctctttttctctcagtctttagatcggtgggaaggttctgcacagagttggagctagcttgtgacaccgtcaggtgggcccagggcgaagtacactaggctggagtgtggggatgggtagaaaactgtgtgaaagagatttttggacgaattttcagattattttctcttccctaacttgttaattcatagattaattcgtgttgcatatgaggtcgtgtggattttattggaggtaaatgaatgtacctagttaacgttttctactcaaaaattatggatagattgctcacagaaattacagaaattaaaagaagatgggcttattggaaactaatttgaatttttaggagaactaagtagagaagataaattctgaaaaaattatatttattcatgataattaacctaatatttgaataaattatttcccctatacacttccatgcagtttaatgcacaattagtgagggtaggtttttagccgattaaggattataattaaactattatttgactggtttgactgatttatttgagatattaaatttagttattaaattgtaccaaaattactatgagttgcatgttttaagtagagcctacatgaattttcccatgattttatcttgcacaaattattttagataattagcaagacttttctttatataggtttccaatttataaatggatctacatagttgtaagaaatttatttagactactcttgacctgaggtggtatcatttgacttcattttcatgtctttataattattgctcaagtgtggttataggtttgcttagtgaatctttatcttttatttatgctcatgggtcctaatatgcaatgccaaccaaaaatccaaatgcataaagaagactcaagttaaaatatgttttatgcaagtatgcatgcttacacttgtgtttgcatctatgctataggttaaagatgaaaaagtttgttctcaaattttattcatgcaagagttagatcaaagtttacctaggtttaaaatggaaatttttggctcccaaaaataaaaaacttaacttccaactattttgacaggaaatttttaaggtctaaaatttgggtatgttacacccaaacccaaaccagatttgctcctccgctccaccatccatcggcgcaaccacacgaccctcacaatcccttcactagtgccagatggaccaccggtgaagcaaagagatagaattggaggactgttattacaaagaacgccatcattttcacccatgcgacgaagtaggtgaaacgaagcccatagccaatcacaccccataaaatagaccaccgagacaagatggatagggacca

SEQ ID NO: 11368 - DNA, 4035 bp, Oryza sativa
  unsure (1)..(4035): unsure at all n locations
actatagggcgaattcgagctcggtaccctatattcgacctcttaaattgctctagttcggttggtatttttgcctaccaatttatcatatggctatgttaatttaatcttagcatatcaatttagctctatcggctgcttctcgctttagggtttctgccggtatcggctaaatcgtcttgctagattagattgacttagatatctaccaccccgaaaatcagttaagggtttgattgtctagatattatgtttcttttcatacttagtgctgcatcaattaagtttgatctactaagtcatgtttagaaccataatctctagcttgtttcttgattgctaataagggtttcatcggggtttcagctgatgagttatctggacattgcatcggcttacaacgattgcatacataatggatttagccgatcgcaacaaagattttactgtttatctaatcgtttggattttatggcatcggaccttcagccgatgtatgctttaaccttcggatcagtgtttattctatcatgtcattgttagccgattggtttctactggattatattattgttatgttgttacatcatcattagccgattgcctttatattgttatctacatcaaacatataaccgatagctcaaaactctatcgctatcagctggtatcggcatcagctggaattaatctatcggcttgtcagtcgattggttcattgatctgctatttgtatatcttgtcagttgtaagatcaaactgactggcacgcctgcatcttatcaagatttggacctgcactggaactaagcagatctcctaggccagtgtgtgtttttcgcgtaaacaggggggtcgggccacatggctaccgggggcagcctcctccctatggtcctgatacccccgggcccatatcaccaacactgaccactacactacatggagagatttctatgccaaatcatgagcgatagtgaagccgcctataggcgaagggacgaaagcccgttagacctaatgggaaaaagtatgaaaaaaaaaaagtatgttaaggttatagactaacttatacatctacaaagggaaaggcgtcgtcacgtcagctatggatatagactaggctcaggaacggagtcttaaagtatttactgagagtatactaaggaagaagtcagtggaagtgagctcgtaactaagacttccataatagaaggcaaagaagtcgacgaacgaagcagcttttctaataacccagttgaataggagggtgaaggctctcagatttcctgttgtctgtaagagtttttaaccctaccaatattttggcagcgataagatttatcaggattgtttggcttggcgttaaatttttgctagtgctcttgtttatgtttcttaccaatacttttgcaataccatttcttctctagcaaacggaatgccatccaattctattggcattgccaatttttttggcatggattcaaatcaaacaggttcgaatcttcggctattgttccgagcgtggcatccaacacggctgccgtctcctctacccgatgaagacgagaacatcaacattggggtttcgtggtacaagtcaaacgcgtccagtagaactggccaactgggtctgtttagaaacattttgacaaaacaaccaaaatttataacttctatactactccctccatctacttttgactgtcatatttcatattggcacacagaccaataataagcaattctacttatcatccatttaaacaagttactagacattcctcgtaaacaagcaattcattaatatttacatttcttgatacccatgtaaccaatcttgtgaggaagaatagagagtcatgcattaaatccgaaaaaatcattaagatgataagttgttgaattgaaatatgcctatcaaaaatttttcagatttagaaatatgactatcaaaagtagatagaggaagtactatacataacagtcagaaaaccaaagctgactaacaaaagcgaccaaaatacctcgttattaattctaaaaccaacttataaaaatcaaaatagctaaaatcaaacagtgaaccttaaccaaataccctcagggaaattctgacgacgatgacatcatagcaactcagtcaaatggtaccatagcaattaagcatttgttatggtaatgacaaagataaatctcgaataaacaattgttactaatatagtactaaatacgatgagcattgcgaagacattgatggtggaaaggaatttcgttctacacataactattatccctatggtcagtttctcccgcaagggaaataacctgtaccaagcacctggcaaactaaagggtaccctaaaacctagagttaaggcaataatccctgttctccccagctgatcacggaagaacagatagccaagcatctgcttgtattacttcatccatccactggtttaaactacatcctgaaatccatgagacagactgtgttgttcgagaaacatgctgcaatcttgctgccttctttattccagcacacttcaaaaatgccaccactccctctgtatgtcttcaagatcctcccttctttaacggaccatatgtgtaggcattgatcaagggaaccacttgctaagtactcaccaccagggctaaatgcgaccgaatacacaggttgcctgcaatcacgaataagttgagttcagccattgcaagcaaccaaaagaaagaactccatccgtttcttttataagtcaacccatctttcccttgatttaatactcaaaatatgccttgtattttgaaaaggtgtattttttttctcctggtatcaaatacctgtggccagccaagctgtacagaaggcgtccttgctcaacttcccatagcttgatagtcgaatcaaaagaggcactgcacatgaaacaaaatagtcaatcgttgccaaaaacatccgctggaaaaggtgaagctaccagaattcctaagaagcaagaatcatactccaggtaactaagcaaccctacttacatctccaataactatgtatatgaggaaccagcaatggtgtcagaaaataatgaaaatggcaaattggctgaaatttggtgatctactaggtcacaaacaaggggaatcagcgtccaaccatgtactgcttaggtaggtagcacaagcggctggttgggccatgtaagcgatataaggttggtggcagcacaaacaatggttactgctttagaacctttcaaaattagatgccgacttactaatacattgatgtgcaacagagatccctgggttccagcatatccacattaaaaaaatgagctatgttcatgagatattttaaacaaaaaagggaggatgccaagtataccatgcacaggaagcacaatagtaggttgcagtgaacccaacattgagaatcgactaaaactatcttagaagaatgaattcacagaaccataaattcacagaaccataaatacacagaagtcactcataaatcatgatatccgagataaacaaacttgtgagtctgattagtcatcaacaacatcttccatatttagacatgttacaaaggcgattatgatcctactaagaatttgttgcaggtaggcttgtgtcttctttttgacaactattcgaatttcagaaagccatacataagtcagaacaactatattttcttgaatatatagtttttgcagtacaagtgtaatttaatgtaatttactccattttacatgtaggacagtgggaactaaaatgataaaatttgtactgctcttgctaaaaacataaaacaatatgcactttacttcatttgacaaatttcaaaggacataaaagctagagggtgagctatcaattatcaaccatcagatacccaatatgaatctaggtatagcttctagtatttaattataattaaaaatatagcttctaggtatttaattatttgcacaaattattnnnnnnnnnnnnnnnnnnnnnnnnnnnnnnnnnnnnnnnnnn

SEQ ID NO: 11369 - DNA, 11133 bp, Oryza sativa
atctccaaggaagaagcatccatgatattatttcaatgtccagcagattgccaaatgtctcagtgggaggaaagaaccccatgtcctactcaaattggatatctcaaaggcttttgattcagtttcttggtcttttcatgtggaggtcatgcagcagctgggttttcgtcattgttgttgtaaccttttgtgtttggtcctctctacttctactcgaatactggttaatggtgaagccagggaggtaatctttcatcgtcatatggtctccgacaaggtgaccccctctcccccatgttatacatattggtcatggacgttctagatttattggtgaattgtgcgtcgctgcccaacatttttgctccttctatgaggatgatgcggttatgttcctaatgccggtgaatgttatctctattatcaagcaattgttgaaggtctttggtcatgcatctaggcttgtgaccaacttggaaaagagctcagtgacacctattcagtgccaagaggatgatttggagttcatctctagtatgctttcatgtgagtgaggattttccttgtacctctcttggtctcccgctcaatattcgaaagcctactaaaaactaagttgtgagctctagtggataaggtggctgacaatctcacaggttggaaagcttctctaatgaatcacgctgagcatctcatcatagtaagagtggttttgctgcccatcccaattcatcttatgattgcaattgatacaccaaaatgggtagtttgtcacaagctccaggcaattatagaataggatatgaatgagatgtaggcggccagggcttagggagcttggtagatcgcgacccgtggcgctgacaaatgcaaccggaaggagatgagaaaccaaagaatagtagatgagattgatagattaattcagcttgctttattccttgaatctatgcccttataagagcttacaattgtaactaatttagctgaagaaaagggataatatttgctaacaaacttgagagtaaatcctaactaattgagatgaagccgaagacctgcagcaatccgggatgcgtagctcaactcatgcctgccggcttcacgctcccatcgcttttgcgcgtttgccccttcggtggaacacaattccgaccctaacatctctcccatccttcagaaacagctcatcctcgagccagaatgcagggaaacggtgacgaaaatccgattcaatttcccaagttgcatctgccggtgccttaccttcccactgaacaagggtttcaggaacaccgcaagccaaacgaccctatattgccttggccggaataggaagaacacaaccatgagccatattatgtaccatggtatgccttgagggatagcggtagcggtagggacgaacggcgactgatgtggccccaggcttgaggtggatgcggtagtcgatagcccgtgccgacagcaagccttggggttcggcgaagaggtcctctaattccgccaggagatgctgcaaaatattgtcgatgtcgatcggccactcatcacatcgggccctgatcagcgaggctgtagaacatgacctcgcgtgtgctgcgccatatggccatgcgcatgttcttgaaatcccacagtattggccccaacgtttgcaaccattgcatgcctaggaatgatgtcgacagcacacaagtcaagggcgaagcagtcgaccgagaaggcctcgccatcgatgttgagcgcgaggttgcgacacaggcccgggctgacaaggcgatcaccattggccatgacaaagcgaagtccctagcacgccggctcaagatggaggaggtgatgcaccacctgtgcgtcgagccggagtcgacgagtgccacaagcccacaacacgtatgtcggctattgtaaccggaagcctcatggtgctagctccgtcaatgcctgatagcgtgttcacttgtggcaccgcatcgtcgttggctccgtcatcatccgtggagtcatcatactcaatgtagaacatccgtgcacacttgtgtccgcatacaaacttctcgtcgcaatggtaatagagcccttggagacaacgttccaccaactctgccggagaaaggcgacgaaattgttgttgcggcgcgcatcggctagggtttcggctggctgagccctggttgctggtgcgggcacaggtgacgctgctagcgccacgtcgcagaagtagggctgagctgaggaccttgtgcctgcccatcgtgcttgaccaccttgcactcatgcacgagcaagactcatggcctcctgaagatcgggctttttgagctcgtcgtcgacggcgaggtcgtcgtggagcccggccgtggagaacttaacctgctagctatcggtaagtggttcagtgatgcggctggcaagcgtgagaaatttggattggtacaccgccaccgtggaggtttgcaacaaacgcctgatctcaccgagaggattattgcgtatgggaggaccgaattgaccatgacagagctccttgaacgtgtcccgatccggcgggtccctactgctgctcgtagtggaagtaccagtcctggggcctccccgaagaaatgggtaagttgcccaggcagaaccccgggcccctggtgttcggttcttttggccctggaaagaaactggctccgccaatgggtctttcaagggagttcgttccctggcccatcaaatttgggaaattcaagtttatagaaacgaggaacgttgcccccggcatcaccgtgttggagtcctgcagtgcgccagagctcaatggttgcgggtgtgggttgacgggtgggaagccagggcgcgttgttggacgtagatgtagacgacgcaacctggaactgctcaagtgcagtgatgcgagaagtcgcaacggcgaccgatcgactgagatcaaccatatcaatcttggacgcgagcagcgaaatgctggcgaggacatccaccattgtcctgcagcttgtcgaggggaccagggttccagaagcggttgtttggcagtggaggtttcttccatggtctgatacaaagttgtcacgagctcctggcaatgatcgaataggatatgaatgagatgtaggcagccgacgcttagggagcttggtagatcggcgacccagggcgctgatgaatgcaatcggaaggagacgaggaaatggaaaatagtagatgagattaattcggcttgctttattccttgagtctgcccttacaagaacaaacatttgtaactaatttagctgaagaaaatggataatatttgctaaataacttgagagtgaatcctaactaattgagatgaagctaaagtcctgtagcaatctggcacgcgcaactcgcgcccactggctttgcgttcccatcgccttcgcgcgcttgtgttccccgtcgttccgcatccttcccccttcggtggaacacaattccaaccctaacagtaatcaaggctattgacaagatacgaagaggcctttctttgggcaggtcatgaaaaggctaacggtggcaaattgtttggttgcttgggagcaggtttgttggtcccttatgtacggtggtttgagaatccacaatttggaatataagagttgagctatgcgcatttgatggctttggttggaaaaaactggcaatgcccatgcttgggaagggttacctctacaagttccacataatgctcatactctttttaatatggccgttggatccatagttagaaatgggtagtgtattttgttttggtcaggtggatggttgcaaaacaaaaccgtggtggagataagctcttaatctgatcaagttgatgcctaaaaggattatcgaacgtcgcactatgacacaagccttagaaaaccaaagatgggttgctgatatcaaaggagcactcactgtccaagttattatagagtatgtgcgaatttgggacttagtggccagtgtggcccttcagaacggtgtaccagatcagcaccgttggaagctcccaaagtctgagtcgcatacctccaaatcagtctacgagtcattttttgttggcacaatcggattcgccccttggaaagaaacttggaagagctgggcatccctaaggtgcaagttctttgtgtgtggccataattaataacagcatttggatcactgatcgccttgccaagcgagggccgccacatctcatcgcttgtccgctttttgaccaggctgggggatacatcacctcctagttacttgtgtcttttcccaacaagtatatggtctcttattctcaaaggttagggctgatatccatctctccaaatcaggacaccaagcatttctccaggtggtggtccaaggctgtaagaggcgtcgataaggattccaagaaagggctcaactcgcttatcatgcttgcggcatgggagatttagaagtataggaatgaccacatatttaatggcgtcaatcctagtgtattgactgtcatccaaattgtggttaatgaatgtggtctttggtgcatggctgcagcttctaagctcagcgaattccttagtaggtcggtaacctcgcttaggtaaggtctttttgagtcgggttttcttgtaaatgtaagacttgttttggtgaggggtgtttttgcttcttccgtctcttgatgaaacgatatgcagatctcatgtgtatttaggaaaaaaaaaacttacttacagaaaagcgtagtaccatgcaaggtatagagcaaagtgttttagcaaccaactcgaaacaaagtcacttccattccacaagcaaaactctacccttgattggttgccacatcgcttatgtgatgttctggcttatgcagacaaacaattgatgtgatcacgaaaatgaaaaataacacatatctaactgtgattgacatttaagggtaaaatcgataattttgcagtcagaggtttatttccaaactgtggtaacaaggtttttcatgtatgcatttggggcaactagacttacttacgccaccaagactcaaaataaaatatgactgtactactgatgggatggggttagtgtaaaaagtcatgactgatacagtctacagaatcataacactgtactaggacaaagaaactactccctccgttccaaaatattgcaaccttggactgtataagacaacctagtacaacgaatctggacagggctgtccagacgtctaggttatgtctcatccagtccaaggtatattttgggatggaggtagtaaatttactaagaaaaacatctcaagatattatatcaactcaattgcatatcgagcaggtacaaaatgtaagactatatacagtacaaaagtacacagatgtcaatatattacaacgaagaaagtctatttagccctcgaaagtgggggtttgtctaataaacaagtatgaaactgggcatcagaccccctaaagtatgggggaccttcgtatatttataaatggaagattgaatgacaaagatgaaactattgttgtatattaattaccttagcagtccaatcatctgaacatgaagccagcagagaaccagttggatcccacttgatagcattaacttcactctggaaacaagcttaattgtcacaatcagaagatcacattggttgccaccttttccaatttcgcttacattctttttagaaaatgcaggagagctgtgcttcatttcattaaggaaaaaaaaatcacacatacaaccaagggctcacgagcccttcgcccaaaacacatccacaaatagcatcacacaaggcaacccatgaccaaaaaccaccctacgacagcctagtgcccttgagttattgacctacaaaggaaaacttggagcacaagagctccagccgggcaccaaagcctagcttctgttgacactgcccgcagaatctccatgatgtttggatgttacattgaaacacatgatatttgcatgggcaaacagaaagcatgactcaatgtttgaacacaaataatatcacagcattcaactgaacagtgttcacattcattcaatacatcctgcagcatcaacaattttgcagccaaccaacgtatgactggataatggaagacagtcaactgaatcaaatagaataaatagaaggaactagatagactgaatgcaaggaacttcttgtttgctaactctataataaatttgagttgttgggctaattgggcccagctccaactagagctaaagatctcagccatgaaaagtacagtttactaccttctctctactaatggctggttgatctgatgtgtattatacttagaacttctatgcaagaggatttgttttgtatttttaaaatctagaatcttttatttctgtcaagtgttaactccacttctccccatatccccatctttaacttgcttctgattccagaaatcacctctaaactccaaaataaagggaattcaatgcattttgaaggacagcacatatcgaaaacatgtactgcttggagaacaccaacctgatgaccactgaaggatttaactgggcgctgatccccaatcttgcaaacatagatcatattatcagttgagcatgttgcaaaagaattattgtttctccagtcaacatccagtgttggagctgtatgaaaaatagaggcagtttacagtttattgtgctggatagaaatgcatccaatgcaataaagataattataatgtaaaaatcagcactgttgtggcatgcaagcatacctgaatgaaattcaaattgctgcttacactcccatgtctttgtatcccacacaatagcagttttatcaacacttccacttaggaggaaatctcctttcttattccatttcaaggaaaatataggtcccttgtgtttgaacaaagtctgcttcaactctcctgataaattcaatatcatcagggctgatttttgggaaaagtttaaatgcataataagtcgttctaagctatgcagtacctcccaatttgcaaatctaatacagttaccatgcaaaactatgaactaatatacaaagccacaaaaaaaatgcatagcaagatagtaatttccttaccatcgctattccatattcttgcctgcccatcataggaaccagtagccaatagagttccttccccctagaagagacaacaggcaaaacaaatccaaagatgaacatgtcaaagtggaagaacatagatgcaaaaacaagtattttgcgaaatgtaaaataaacaagtgggctggtacagacgaccgtcaatagcaagcctattataaaactcacattccagtcaagtgtggtgacatccttgctcttctcattagttcgacccttaaaatgtttcaaaacatgaacacctggaggagatgattgtgtgatggaaccacatggtccatctggaattgtccagattctagctgtcgagtctcctgacctagcagcatgtacaaaatagtaatgtgagtcatcaaagaggatagataaggacagaaagcattggtgttaagcacgtatataaatataatttgcaacaatttatagaagggatgcaataggaataactgtataaagagtaaaatatgagcatgaaagttttgacaggctgacatatctctatctctagtactataaaagcgtagtttgtcctgtttgtttgtcccacgcggcgcacagcgcaccacccagacatgcatggaaactgcaccctcttggaaacattgggcttccaagaaaatccagcatgaaaaccaccccacctaaaaaacgaataccacaagaaaaacctggtggacactgcctgaaaaccatcccaccccttgagaaaaccggataccgaaagaaaaccaagcgggctgcatggacttcccctcccaaggaattgcgctgtgcaccccatgtccttgcccgcacacaccatcatggcgaattatggccctatggggctgcctcgccaacctctccctccccaaacttgaaactggaagcatgtgtcactctcagactctcctaattgcatttcttccatcatcatccctcatcatccttgcagaccaaagacatcttctggtcagtgacgaggaccaaattgtggcacagctatgcccttaaagagtgcggcagtatttttgccacgtcctacaggagaggtgctctatagagggattgtggtagttgggtccatctgtttgctcccctctgatctggtggtgtgctcatgaaatacattcccggtgtacccctcgatctccctctagcgcgattgctcaatcctccctgctagtattgtattgttatctgttatggtgaggctacttgatttggtgggttcaatgatgactgcacatactgtccagttgctgatagctatagcgctgcctgttgttgttgctccaatccaactaagagttagttgagttaaatattctcacattgtgcctagaattttcacccaacaagtgtgtaaatgttatttagaacaatattacactaatagtagaaaactcacattatgttgtcaaattaattccagtgttagattatttcctattatgttctttccaaatcaagcatctgtgcgcggggggcagacctacagtgctagaacctgggtcaaatgaccctaatgactgttgctaaaaactatggtcaaaatggctcaagtatgatcgaataatgtataatagaaaattaattttaaaagcttcaaaattgacatgatgtaaaattgtaaaaattatatttccgttgctataagtggacaatttactagtgtgaataataagagagaaaaatccaaaaattttatcttaacaagtctaagttccagccctctaggcatatctcaaaaagtattaaaatatggtgcaacacacctgacaatcgttcacatatacacagactagcagtttgatgtctatgtcaaatacaaaatgagatcataaggctacaggagcacaaacaatatcaatggaagaacacaaacatcgatgcagagataataaggactcacccagacgctagaagggaaccagctggactccatgcacaagcgaacacctaaatacaaagaaatttgaaagaagcagtaagagaacatgctttctagtactaatccatgataggtcaaatagctgtatggcagaaggctatttaaacctctgagctgtgtccttccaaaacagtcacatcagcactagaaatttcatgagcagttgtgcttacatccattggtgtgggacctgtagcaataagatttagtacaccctggcatggtagcgttaaactgatagacacaaaaatatccaaaaaatattatgaaggctccatacaagtgacaactaattccacaaggaggttgctactccaagaagcacactaattctacataaggaaattaaagcacaatatcctaaatcagttccatgaccattcatgtcatttcacttatgtaaatcaaatatcagaaatcaaacaatatattggttcatacaggaggttaaaatcatggttattatcaagcattaatgcacctaagaacacagttttagcgatttattgccatcaggaaacacaatagtaatacacactcacaaatgtaatagaaatgtatgttcgtgttactagaacatatgacacgtaccacaaggatattatggagtttttggcagggataattgatcatacaccacccataagtcacgggctctaggatatgtcactccagagaagctaattgattatttgccacctgttagataaaaatgctttaggaattgccatgttaaaattattttggttttttcgatttctatttcagtgattacatgacctagaccctactttcttttccagttttgcccatggtagcccaatggtttctccagcacgatgcatgactgaacaggagcatggatggctggatggtgagaaggaaaagtcagttggcaaggggagctaagtgatgtctctcctctcctccagcactacaccaggataaactccaccagggtggatctgttgtggaggtctatcctcaaccgccacgttaaaacagcagagcaaggacacaagtgcctgggcattgctgtgtgaaagcactgacaggaatagccatgccgcagccgtgtactgtgttctccaactcctctgcactgcgtgttgcctcccctcactgaccttgtctcccctgcagggcggtattgcatccacttccgtgtgccagtgctgctctggctccatgcgctcttgcttgcccgcctcgcctcccaagggatccatcccctcctccactcaaagctccacaccactagccatcgccaggcacaaagagaccggaggtggagaaatatgagggaaggaagaagagcaaaagggtacaagaaatgtgatctctactatcttaaaagtcgagtagttctccttccatctccttccatcccctcatccaacgcatgcggcatgtccgtatgcgaaaaataaccaccatcacttcctaattatatgggcttggcccattaacatacgggctcccagtttatccctaattatatgggggcctgacccgttacaacatacgggcatgaaactagttggtcaaaagtgggagctcatactaatcacatctgatgacgagcaaaaaaaccgattcaattctgcggagtggcatatcctggaattggaaagcttattgaattgcttccatacaatcaaatccctactgtgacaatatattggattttaactaagaaaatttataagctgaaaatgatacttagtactttgtccacatttctcaagtcgcaattgtcattctccgacttccaaaatacaccaaatgcatgttcaattgtcattctggtgtctgcattctttgcaagcacaagtgttatattaaattgagcaatctcacgcttttagatgcaataagataattctttgatggtcctgtttggtttcgggctaatattggctattacacaaagaaaaccaagtcaaaaaacttgacattaccaaaaaaaaaggtaaccagtttggtaagtatgtcttcataaatgaactggagagcttatgtggcatgttacccaaaactttcgcga

SEQ ID NO: 11370 - DNA, 3010 bp, Oryza sativa
  unsure (1)..(3010): unsure at all n locations
nnnnnnnnnnnnnnnnnnnnnnnnnnnnnnnnnnnnnnnnnnnnnnnnnnnnnnnnnnnnnnnnnatatattggattttaactaagaaaatttataagctgaaaatgatacttagtactttgtccacatttctcaagtcgcaattgtcattctccgacttccaaaatacaccaaatgcatgttcaattgtcattctggtgtctgcattctttgcaagcacaagtgttatattaaattgagcaatctcacgcttttagatgcaataagataattctttgatggtcctgtttggtttcgggctaatattggctattacacaaagaaaaccaagtcaaaaaacttgacattaccaaaaaaaaaggtaaccagtttggtaagtatgtcttcataaatgaactggagagctaatgtggcatgttacccaaaactttcgcgaaccaagtgaaagataaatgtggtaactcttgcataattcgtcaaatcatcatattaatttgcatgttgctttgactgtaatatttatagtaaaacatacagaaaaccgatggacataattacataaggacattttcaagcattatcttgcaaatgctctgctgatccgcaacaaatgaaaacttgtcaacattgtaaaataatcagtaattaacatatttatcgcaaagaaaagacacgcacatatcaaacaactgtcacaaaaacatttctcaagttaacaaataaagttatcaagattcaatcatctgtagactgtagctactaaagtttactcacagtatgctgaaaactgtaagatggaatcgtaagggaaatgcagcaaacagatattagttaattacctccaccagcaagagaatcttcttcagccttaaccttatcaatacgctctgtgtgcagcttttctttctctttatcttgatccctgtctctttcagctctgtctttctccttctctaactctttttcttggtcatggcgctccctctcccgttcacccccagggcgtcgttcatgctcctccatacgttccttttcttttcccttgtccttgtcacggtcactttgagtcttctcccttttccttttcttaacaatctgttgcaactcttcaacattttttgtgattatttcaagaggttcaagaagggcaaaatccttcgcaagatcttcatcattctgcaacaagataaagagcatgatgtagcatgcatcagaaaaggtaatgaacactagaagacaaacaaacttacttcatccgtatttgcttctagttctatgtattggaggcctttctgcacgatagtgataagagcaccaggtggaactagatttccatcaatcccacccttatggatccctgcttcataccctaatgtgaatgcggcatgaatgaaacctggaaaggttgagaaaccatcagcaataactgtcatagtcatatataaccaaatatatatataagtcgggtgcagcataaagtagttgcagctacatcattggacactgacacagatcacatgtcagttatgtatcaggaaaaagtcagctaaaatagatgatgttttttttttccgatacagctttggaacttcattgacaagcatgcaaaaatttatcgcacatgcaacacaaccctgccacttcaacaaaaagtgaaaagcctatcactagaaacagacaactaaagtaaatgatattattctttgatacagctttggaacttcattggacgcatgcaaaaatttatcacatccacaacacaaccctgccacgtcaacaaaagaatgatataagcttatcgctagagtgctagaccagcctccctccataggttttctcctcgtcatccagaccatgcacctctctggacatgcccccatgtcaagctcagttaagccatgtcaagctcactggtgggttcttattagttcctttcatcagttccttctgaattattaagttcttctctaagttaggttacatggagcaaaactggatgagttttggatttgttcttcttacttccactttcatattttagaaaatagaaacgaataatacaagtattccaagaaggagcacatactatcatcaaggcttcctatgttgaattgttgaaaaagacaaatactgaaatgggaaataatgtgcatagagagacatatcgtcatgttgtcttgtttgcaaaaatggcaatccctctcttggagtctatgtatcgtattcatgcccgtggaaccatatatatcaactgtgggtaacagataaatgagagaatatggcataatattcttcttgactcgttaggcacttctagaacaaaaaggcaccatagtagcacgaactccctatagcttggttctgaactctgagttctgagccatattttactctctgcaattgaggacagttagaaatatggaagccagcagtgctacagtgatcagtgaacaggcaccaaacgcaattctctcccgcaaattaccagttaccactacaatttcaaccccaaaaccaacaaaaacaacaacttcccatgcaccaacggttattaaaatcctcgggtccaactaaaaggaatgaaacggaagttagtaaaagaaacagacaacatcgaaccctattatatatatgggcatgtttggattgctaccctaccagtggtagtgccaaatcttgggcaagttttattactatcaacattttgttagagatttctagggagagatttctattgatttggcaagttatggaatcaatccaaacatcacacaagtactatttagactacctgttggtagtgcaagatttggcactaaaaccaaaacagccctatgtttccctggacacatcagatcccaagattgtgccctagcagaccctattttccccagggccgcacatctccaccacaatagcaccgaaccacactagagctactaaacatccagcagcggtaatctccaacccacacgaaaatctctccaacgtaaataaacacaaacaaagg

SEQ ID NO: 11371 - DNA, 1844 bp, Oryza sativa
  unsure (1)..(1844): unsure at all n locations
tagaaccgaaccacactagagctactaaacatacagcagcagtaaatctccaatccacacgaaaatcctctcaatctattcacaaacaaaagaacctagtttccccagcgccgcacatcaccacaacagaaccgaaccactagagcagcagaggtaaatctccaatccacacgaaaatcctcgcaacgtaaccacaaacaaaagaactagggagaagaattcgagagtggacgaaccggactcctggagataccggaagatgaggaagttgagctcggccgaggtgattgcccccataggcgccggtcgacgaacgcgtggccgccgccgagacgggaaggctccggaggagaggggagaggggagaggggagaggggagagtggccaaggggacgaaaccggcgaagggatggatggtgtgggtataggaaaaattgatggattgagaattttaggtcatctcctgaagtcagtctggacacggtcaggatcgcgtgcagaaaaatcggacggggcatgagccccgtaggcatggacgggcctagaccgttcgtttgctttaagatccgtgcacaactggaatactaaatgctacaatgtaattctattgtatttaataacttttaagatcttgatttttctgttcgtcacacaaggcacacgtcgaccgttgccctttgagcacatagcatgagagcatgaatataaacccaaataatagttcgatatgaagtagatgtcaaattaatagtttcaccatgtataaccagattaacaattttgttggtcatctcgttatcgtcttcttttaagatctatatggcacgactattaaaatttgtcgatggcaaaagtaaatatttagagaggcatacttgttaacatagtcatggtattattccggtgcaaatgggcgcatgtagcacgagatggtatggagaagataatcacacaatattctacatgaatggtgatggcgtgctgtacagaacaagaggacattggtgagtaacataaagatcagcaatttactatcctctagattatgttttcgaattaattttgatcatgcgaacctatatttgctcactagtcaagaacgtctttatatacgatattcctagtgctcttccctgtggggtctacttctttctttggcttggctaaaatccttgttgtttgtcttgacacaccccttaacaatgcgacatacaactgaccatgtgaaaaaataggctatggatgatagatcccaacatttggggctgtgtcttgtgggtacagttgtacacctctgatcagattaaaattattcgaatagcagcgcccgtggttatgggcaatcaaccggattcaccgtgattagtctcacccctagtttagcttaatggaactggttagttcaggtggtggattggccctgtctcaacgtggtgtagtgttgagcagtgattggttaatattgattaattactattacagttttactgctttcaactactgcttttaaatgcctgctttatgcaaataaacctttagcctcctttggatatatcttgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaannnnnnnnnnnnnnnnnnnnnnnnnnnnnnnnnnnnnnnnnnnnnnnnnnnnnnnnnnnnnn

SEQ ID NO: 11372 - DNA, 540 bp, Oryza sativa
  unsure (1)..(540): unsure at all n locations
gatactcagtcgatgcacagtccgacttgaaaatcaacttgattccacaccaaatccgctttgatctttcttcttttttctccgaatctaatgcaaaatttcgttgttaatacatgcccccaattccgctgtattatataatacagtggaatttgctcttgttgaacccgcaaaaatttagggttttctgttttaacttttagctcataagtagaggcccattccttcaaaacacctttgtccggctatgtcctcgacaagctcttcattgtagaaatccctaatcctccggcaaccttctccggcgatccagctctccggtagcagattcctctgttcacaagcagcctgcgcagattcgcataaatggcgcacacggtaccaatccttgaggtatatttatcaatctttgttgacggtccttaaatcataatatttgaccgtcaatacctgcatataatgaaataaaacatggtatccaacttagtgnnnnnnnnnnnnnnnnnnnnnnnnnnnnnnnnnnnnnnnnnnnnnnnnnnn

SEQ ID NO: 11373 - DNA, 1298 bp, Oryza sativa
  unsure (1)..(1298): unsure at all n locations
ggcctgatcaacttcgtcttcaattatctcttcatctaaggcttgttcaatagatggatccaaggtgggcagatcatcggccggcttgtcagtcggtttggttttcttgaacttggcctttttctttggagccaagattgaagtgctcacagccgaggatctggttttcctttttgggcctgcatcggctggttctctagttaggccgtgaaggagagttgaggtcttgggggcatagtagccaataacagggggagatagcccacctccatttggaattaagcccgaagcatactcaatgttcttgccactattgctttggtgaggaggggaggactctgttgtctgcaaagcaggagcaaaagattggttaagtaataaatcgattaattgactacgcaatttgatagtaacaatgtttacctagggtatgacgtcgggggacagatctgtcatatacatcgtggctgattgatgaaacagatgtagcttctattcaccccaccatctgtcgaagtttttgcttctgaatccagccaactcaatattttcaatgctgccaagaggaggtcccgatagattgagtagccgatccatcattagagcagacgtgatttgtcctcggcactgaatcttgtcggcaaaaaataagccgattgggagttggcctaatccaagttgcctagccgagctcattgggtgataaaactcgtaggagacttggatgtttctcccttggtgaatgccgacaggaaggatgcaagggctgattgcggctataagaacttctctggatttctggaatttctcatggttaatatcttcgaatctaaaatctgatggaagttcgaggtctgctgattcttcataagggaaccagatccgggtatctttcttaaagccctcatagaagctgcagaaccagtccttaagcagctcagccgataactttgctccagcatcggttggtgtggatgcatattccccatatcatgtgcacctgcgatgagtacattcttctccgtcgtcacccacaatcggctctggcagtgggaactcagcttctgttacagaaggccgattgacaaccttcataaccatcaggtttaaccaagtttgcagtagccaccagggtccacctgctccaactgccgagccgacggctattctagccgatgtgttgttcaacatctggtacagatagccgagaaggattttgcccaannnnnnnnnnnnnnnnnnnnnnnnnnnnnnnnnnnnnnnnnnnnnnnnnnnnnnnnnnnnnnnnnnnnnnnnnn

SEQ ID NO: 11374 - DNA, 4487 bp, Oryza sativa
  unsure (1)..(4487): unsure at all n locations
nnnnnnnnnnnnnnnnnnnnnnnnnnnnnnnnnnnnnnnnnnnnnnnnnnnnnnnntaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagagtcctgggaaggcaattgtatctattaattaggatattttatgtaaattccttatagataagtgtggggcaaaagtctgccgtaatgacttatggtatcttagagtttgttagagataatggtcatgtccgctatgggcatatcttgtaatcctcgggtataaatagaccccgagccctatgtaatgtcacaccctaaaaatcctaaatatataaattgttgtttaattggaattattagaaataattttaaaagcctagaagagaagatctaattttaaataataaattccaatgtaaaagtggctagataaaattttattaaatactttacttgattttatagttcctggatttttctgggatttatttgagccaaggaagtatttttaataaatggaattgcatttcatgaataatttaaattgaaaatgttttaaaaatcctccttttggctttgggccgaaagtcggcccaaaaccctctctctctcctccccggcccaagttggcctgcagccgagacgccgctcgcgcgcgcgtcccactcgctgacaggtggggcccacctatcggactcgtcgtccacctccagccgtcgcccggccgaaccctagccaagccgcgccgccgccgcccttccaaattcgctcgtccctttctcgatccgatgaaattgtttgaggggaaatgatccccgagatctcctctactttttcccttttggaatcatcgcctaattcgcttttgaaatcgccggattcgagtttgattcggattcgttttcttcccctgaaccctaatgtttccatcgccgtcgccggccgccgtgggcctccaccgtcaccccctagcccctataaaggacccccgagctctcctctacccgccgccaccctcgcctcgccttccatggccggtagagctctagcaccgtgagctcttgcaccgctgtcgctgccgcaagtccagccgtgcgacgccgtcgctccggtcgtcatcgtcgcttgggaaggacaacgccgggttcaccaagccgtcgccgtcctcgtccacccctccgtcgtcgccgaggatcgccggaagaccgccgtcgtcgtcaagccgaccgtcgccgccgcttcttcctcgtcgccgtccgccgccgttcgtgcctcggtaaggatcgctgcatcgtccactacgcatagaggccctccgtttgcgccaccgcgccgttgttcgccggcgagcatgcgcgcccgagccgccgccggtggtgacgtcatcgccgacgtcatcgtcgtcgtttcccgtgagccgcggtagaccgattagatctcggccgtctgttttggatagggttgatcccggccgttcgtttccgtagaccgccgctgtgcacccggtccaccgtgaacccgagccactgacgcaataatccccttttccttttaaaaaattattcattattgcatcataattcaattaaaatctatataaatgatttaatccgatttaatctttaaaaattcataacttattcatcttagctcggatttagttggttcaagtctctaaatttttctaaaattgagatctacatgttaaaaatatccacatgtactttttatgcttgtttatgtgctgttttagtgtttttgctcttttctctttagattccgatgttcccggagagtccgattttgcaggagaagactttgaggaattccaaggcgagcaaggcaagtcacacagattccaaacaatcctttgagcatgttgatcccgtttaaagttattgtttctattcaactattgcatttatttttgaatgtcattgggtggaaataacctattgccttgttatagcccttttgttcttgattactctattccttaatactttgggttattataatttgactagttgagctttatatattggttcagctagatattagacataattgcttagccatgcttagaaacattagcacactattaggataacttatgattcactattatttaatgatggcttaatgatagctcacgatggttaatcgtgattggttaattaattaatttgccaactaaaacctgataatggtgggttgtgagcacatggttttgatggtcgtgctcatgaaaattaaggaccggttcacgattttcggttgtgaaacattaaccatgccaaccacaagccagcgtgagcaacggctttactttctgtatagtatggttcattgtagagcaccaggctgtgaagtggtggagataagcccacgggggtcgctggggagtccatgccttgtttataagggggtgattatgatccaggaacggtgcactgctttaaattgtattatatagagggtattgtcacaatctctattcgggtactttgtaagtatcgcgacgcttggttgacatgatgttgaggttgtgtcttgggggtacagtggtacacctctggctagagttaaaactattccaatagccgtgcccgcggttatgggcgggtctaacaatgtctttcgtgattagtctcacacttcttaccatattaaatgatgctgtttaataacttgtttaactcctggtttggaatggtatattcctggcttggagatagaactgtgcagccgaggttggttgttcagaatggttgggcctatgcaacagggtatgttgtatagcgttggattaatattgtttaatttaatactctactgttttattaaattctgaaatatttattaaatgctatttatgcaaatgagactatactatgccatcctttgttatcctatgcacttgcatatttgctgcgtggcttactgagtatgtcatatactcaccttgcaatcattcatcagaggaagagttctactgtgatgctgatggtgtggaggattaggcctagccctggtcaagctgcctgtggagtagagtcgtctgtgctgtttcttttattttccgctgcttagaactttattgtttgagaggaactatctacctctgtaatgacattatagtcgcttattaataattgtactctattatcaatttgttattgtgtgcctcggctgattcctagacgagggtttacacacatgtaagcgtttggaattttggatagaaatttcgggcgtgacatgtaatttttaatacacacgttcaatacaatctcggcgcatcgccatccttttgctttagttttattttgacgagttcttgctttcgggttgagctgcatggatttcgatcttcaacaagaggtaacattcgccgtgatggattgcgttcttaggattaatgcttccatcctcatgacactctagtcctgtttatgtaattcatcaagttatcatataccttatataatctctaacgatattgccatctaaactactatcggtcaatatctgtatgcagaaggcagccgattaggttagatctagatgttgatctagattatataagatatctaccattctatgaaacagctagcggcttgattgtctagatatggttcttcttttcatacttaatgctgcatcagttgagtttgatctattaagtcgtgtttagaatatcgatctctggcctgctttctagttgccgattagaatagcatcggggtttcagccaatcgtatctgatttagccatatttattctacatgtctcatcgatatgctaaatctgcccttaatatcaagatattgctgcatctaaatatgttagggctttgtttgatatattatacctgctttaatatcctgatatgagttagtatcggagtattagccgatacacgctagatctatctgatcggctacgctataaacatatataatcatgttattgatatatatttcgatctaagtgatttatactgtctcggcatggtgtccgatctattccaatcactcgatttaagtatataccaatataaggagtatatatcgttaacatctacagccgatcgagtagatttagtggttatttactttttcatgactgccgatcgatacacaaatgacatcggcccaaagataaatgatatgtcatcggcatctagccaatccgctatcatttatagatt

SEQ ID NO: 11375 - DNA, 10402 bp, Oryza sativa
  unsure (1)..(10402): unsure at all n locations
nnnnnnnnnnnnnnnnnnnnnnnnnnnnnnnnnnnnnnnnnnnnnnnnnnnnnnnntgggcaaaagtctgccgcaaagacttatggtatcttagagtttgttagagataatggtcgtgtccggtatgggcaatcttgtaattctcgggtataaatagaccctgagccctatgtaaatgataacacacacgttcaatacaattttggcgcatcgccaccctttttactttagttttgtttcgacgagttcttgctttcaggttgagctgcatagatttcgatcttcaacaagaggtaaaattcgttatgacggcttgtattcataggattagtgcttccatctttatgatactctaatcttgtttatgtaattcgtcgagttatcacatatcttatataatctctagcaataccgccatctaacctactatcggctaacatctgttagcagagggcagccgattaggttagattttgacgtcgatctagattatataagatatataccactctatgagacttctagcggcttgattgtctagatattgttcttcttttcatacttaatgctgcatcagctgagtttgatctattaagtcgtgcttagaatatcaatctctagcctgccttctagttatcgattagaatagcatcggagtttcagccgatcgtatctggtttaactatattttttctatatgcttcattgacatgttaaatctgccctttatatcaagatgttgctgtatctaagtatattaggcctttgtttgatatattatatttgctttaatatcctgatatagagtagtatcggagtattagtcgatacatgctacatctatctgatcggctatgctataaatatatatagtcctgttattgatatatatttcgatctaagtgatttatactgtctcggcatgatgaccgatctatcccaatcacttgatttaagtatacatcgatataaggagtatatatcgttaatatctatagccgatcgagtagatttagtgtttatttactttttcatgactgccgatcgaaacacaaatgacatcggcccaaagataaatgatatgtcatcggcatctagccaatcggctatcatttatagatttaaccatggtttctttgcttttatttcttgttgattacaggatcaaatcaactggcatgctaatacatccgaaggcgagttttggacctgcactggagttaagcagatctcccaggccacgtgttttctgtcaacacacttttggcacgcccagtgggagttgattagaagtcagatgtcagttcttcctcatggccgagaaacaagcaccaccaccatcaagcccaggttccattaaaggcaaggcattgaagccaggattgactgacatcattgatgacaatgtcatgccaatcgatccagagaaattcacacttgagatgaagcaggagtttgaagcaatgatgcagcaagcacgggatcagtatctgagctcgtttggacatttcccaatgtcggttggagggcagtttggacatttcccatagccataactgtcatatggagcttataaaatgaggtctccatccacacttcaacacacacaactttgagctgaattacaagaggctctattgtatctcttgaacattagaaaataggtagagagtgaggggaagctttggaggactgcccgaaagtttggcgctccatccgacttctatctcaacgagtgtagctttctaggaggaattctggaggagtaccggagttgtcggcacatgtcacgcccagaaatttagcccaaatttccagactattttgtgtattaaatccttgtccaggaccagccagggtacacaaaatgacaagtaataaacagctccaaacgtaaataaagcataaaatacttatagaagaggcacttagtcctcacaccgaaacaaaagcagcagcagcggaaaaggcgatcctagcggggcttcagctccactccacaggcaaaactcaactggggtctgagccttggtcttctaacttcgtcttcagctcagaagcactacacttctgaaaagggggaataatagcaagactgagtacaaccaccgtactcagcaagccacaccaacgatgcagacgtgcaaggggatacaaggacggtttgtggctatttgcataaatgcggttgtaaatcattttattgagcaaaacagtaaaatagttgagtaattaaggtaatattaaatctccattgatcaacgctacaccacgttgaacaggcccaaacaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaatccaccggcatgtcaccgtgccatcatgtgcccatgatgcacacgtcaccatgtcgagtgattgtgacaaaaccctccgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcacattttagttggataattacgaccatgaaacatggccagatgtctcgagcacgcagctcaacaagataatagaatgtctaatactgcaattatcccttcgactgagctagtggtaattaagcatggctaagcatatagttctagctaggtcatcaaagtaacacaagctaggcgatctattacccatggttgacaaatgacagatatcaagtaaacatggcacaagcgagcagataggtaaaccctgatcccttgtaattagcaaaacatgcatatttatttacaaacggtaaaacatttataaattgggaacaacatgctcaaggggaatgtgtgacttgccttgcttcttcacttggattttttgaactcttttcctcgcgaccgcgatcttccgaaacgacggattctacacgctggctcgcaaaacgaggaaaaaaactctaataaaaaccaaggaaacagtacataaaaagtaaacaaacatgtagaactcaattttagatgaattttgcaatttgaatggcccaattcggagttcgaatgaattagatatgaattttagaagttttgagccatttaaatggatttctataattattaatgatttattgcgcaattatcaattattttctcaaaggaaaaggcattcgctgatgtcagcaaggggcgccggcgctgacacgcgggccccgcacgtcagcgacacaaaaggggcgggcgcacggtggactcggtccaccgcggcctggcggcaccgtggacccacaccacgggagtggtccatgggtggcgaacagagcggcaaggggcgggctcgccggccagcccgacaaggcggcggcacacgcgcggacggcccccggcgatggcagcacgacgcggcgccggacaaggaaggcaaaagggaaaagggaggaaggaggcctcaccgtgcgccgggcggcgaggggcgatgagcgcggcggcgagctcctcaggacgactgcgggatggtgctcccgcggcggctccacggggtggaaacggcggacggaggccgggatgacctgggagggcgatggaatgattaggggaaagggaggaggcgcgaggcggtggaaaaaaagcggccagaggccggcaacatgggaagtagctcacctcgacgggaaggagaggactccggcggtgaatggcgagggcgaaggggcggcaccagacggagaagccgatggaggcgacggcgcatattaaggtggtctgggacggcagcaggaggcggctggaggcggaaaatgcagcgtcggcctcaggttggcggtgggggtggttttcggtggtggaggggaaaaactgatcggtggccgggcttgcctgcgcggcagcgaagccggctgcggtggtggcaggacgcgggagcggctcaggcgacgacgacatgcgactggaggcggtttagggtggtggcgactcgggtgcatggtggaaggggagtttcggcggaggtttgtgcaaatggagcggtggccggtgtgcggcgaggcatggcgaagccggcggtgtaagcagcgcagcgtggcggtggctacggcgacggcggcgtgcagccggagctcgccggaaagcggcggagcacgggctcgcgcggggagcacgggagaggtaacgaggagctcggggaggggagggaaacggaagaggagagcacgagggtgcttttgataggcttggggaggagaaatcgtggccggacgtggcggatttgaagcggcaacggccggcgacgtgggcgacaccgtgggcgaagtggggctcgatttggcgccaaaaattggggaaaagtaggggatttggtggagnaggtggaggggtgacgtaagagtgcataaatgccacaaccacgctggcagaccaataaggagtgatctctcggtagtacctaggtgcttggaacaaagtcctatgttgtcaggatatatatgttaagtgatactaaatatgattactatagaagtacagttatatcatagtttcctaatgttattttccactagacattattataaaggtgaatctcctgtttgttcactacattatcaattataggttgattcatgagatataaaccatatatttataccgccgccttcccggtggaatataaatacgatacccttgggaatactcatgggagaaatgctacaacggtatccgtgcgcttgcagatttatctatgaacgtacgaaataccaacacatgacccacgtgccccaatcatgcccaggctggcatgcgacacctcaggaataagtccacattgactccctcaactatagctctaatctgattcatatccctgaagagcaataccatatatctttttttagtgtaaaatactaccagagctttgcctaataattatatattaaaataaaaagagttatttacagaggaaaaaacaaaaagcaaaaccaatacccctttgaaaattacaaactttgtagctagctaagaatggaggagctaagagaatccttcattctgcagaaatgtagaagaatttcatttgtaaaagcaacaaaccacctattaagataaggctgaacattataaaaaacatggccatttcgctgcttccaaatgtgccaacaagcaaatcaaataatatccagaaaaccttttcttctgaataaaattcgacatttgggaaatttccaagtttcgattccaactgaggcgctcccagcacaacttactaaaaggacaagtgaagaaaaggtgaatcaacgtctctctaggaccaccacaaattacacagtttaaaactgcatctttaggagcacaatgcctcctatccaacatgtcgttggtatttagcatgtcccacaaaagcaaccacataaaaaccttaattttcttcacacatttggtcttccaaatctagataaaaggccttggaacatagagtcccacaaaattagtcctgtaaaacttttggccagagtagatgtgtgaattccagaagaaagtccataaatctcccttatttggactgagagacagaatgactaaatcagattgcaactgaagaaactgtctataagcctgatcatctaggggaagattaaagtaatcttcaagttgtaaattcaaaaagtgattcacagattcccatcttaaagtagtttgggagaaaagatcacgatactttagtttcttaatctcaccattccagagatcatcccaaaacaagactgaagtgccagattgtattgtacattgggaaatagctctataaatatcggccaactgaattatgtacctccaccaaaaagaccctttattgaaaaccatatgaggtacttttgttctgtagcaagaagcccaaataagtctaacccaaggaaggtcttgttgtaacgtcccgcctttgcctctcccaggctaggcccacttacattcataccattttgtcacgtcccgcctctcccaggctgggcccacttacatctaatagcttttatagttcatagactaccctcacagaccaacacaagtcttttctgcacactttatcctcactcatgtgcacccggaagaattttccggtcggtcacccatcccaaattgctccaggccaagcacgcttaacctcagagttctttggatatcggcttgaagttgcaacttgttgatatgagtattctattaatcctattaagccctgggccagaatgtcacacttgtgctgtgtaaaatttatgcaaatgcttcaaaagcaaagccacattctaaatatacagatttaatacacctagaccacccttgtccttaggtctacagacttcatcctatgctgccaaagattttcttttaactaaaacattagaacctttccaaagatttcttcttgcagtgtcaatggcctctataatagtctttggcaatttaagggagcacatgcaataggttggaatggcagataaaacagagtttatcaaagtaacatgcctccataaggaagagaagaagcaatggcagtcaacctcctttccaccctatcaaccactgctgccatatcaaccactcttggccttgtggaaccctttggaaagccaagagaagtgaaaggcacagagccagattttccaatttctcgtcaaggacattcaaaggataaatattggacttatgatagttaattttcaaaccagtgtcttgattgaaagtgtgcaagagggccttaagacaaagcaattctctttgtgaagcctttaagaagatgagagtgtaatcggcatgctgaacaccaggaaaatcacctcctccttgaccatttataggcttagataacaaaccaagactcatggctctacttaaaacatcctgaagaagttcagcaccaatcacaaaaagcaagggagagagaggatcaccctgcctgacccctcttttgcacctaaggaatttcccaggaatcccatttagtaagatagaagaacttgctgattcaaaaaccatcttaacccaattcaaccattttgtagggaacccatatgtttcattattttcaaaatggtcgaatgttcgattgtatcgaaggccttttaaaagtccaatttaagaatcaggatttccctcttggattgctgacactgatgaatatactcaaaagacccggctaaatagtcttgtatagtcctctctttaataaaaccatattgattttcatgtacaatcttctttataactccttgaagcctatcagccattagcttagtcaaaaattttagagtgatactcatacgagaaataggcctaaaatcattaacacattctagattaaccttcttaggcacaagaataatataagaagaattaatgcattgcaggtcaaccaactcagcatgaaagtgagcatccagtctgtaataatcttgggctataattggccaacaatttttaataaaacaaccattaaagccatctgggcctggagctttgtcaatcggaagacttttaacaaggtcatccatttcaagagtgaaaaaatgatctaccatgctatcaaggttatcatttcttggaataagatcatattgatcaaaactcatagccgataagtagaaacacccattctagattgaaaagtgtcagaaaagagagaggctttatcatgatgtgctgagacaacggatccattatcattaatttgagctatcaagttatttttaaacctctctgtagccatggcatgaaaaaacttagtttctattcaccaagttggatccatctatttgtgcatcttttcttccaatactcttccaaactgaaaaaagtttcaaagctgttttttcacaatttctctaaaattccattccatcagagataaagctctaacttcttcaattagatcaagaaaatctaggactttattgcaagacttgattaattgcaataatttagaaaaaccattactccaaatcagcagaccctttgttaaccgtttaagcttaaaagtgatacgcttagccgaataaaaaaactagggtcaacactctatacttgtgccacatgatcaaagaaaccctctatctggacccaataattctcaaagcgaaaaacattcgattttggaatagaggattcaattttgatcacaaaaggaacatgatcagaaatagctctaggcatagtataaaccacaatgttagggtactttagggtccagtcattagaggtaaagacccaatcaagctgttctaagaggtgattactttgcatattactccaagtaaaacttctccctttaaaaggttctcaatcagccgtaaagaactgataatattgttgaaaatgaaaatgttattcatatcagcccctggtttatttctattctccacatatctgtaaaaattaaaatcactaagaaaaatccaggcttcatcatgctgaatttggaaggattttaaccaatcgacaaaataaactctttcatggcctctacaaggaccataaattgaagctaggaaccaagatttagagttatgcctagaagtaaattttaggcaaagtgcaaaattattagaggttatcaaagaacccctaaaaatggaaccacaccaacagaccaaaatgccccccctaagcaccatgagaaggcacaaagtgaaaactatcaaatcttttgggcacaacttttttaagagaagcacagtctacaatctctcttttagtttcctaaaagcaaaccctagctggtagctactatcatcaatatttataagagcagcccacttgtccactgaattcatcccccttattctaacataggatatttgagctacgctgctgattcataagtaaaaagatgaacaaagagagaaaacagaccaagcaaagcaagtctggcataagtggcatgatacagaaaaaactagtgaccggctgagtacaataactatcattacaaaataaccacataaaaacaccatatttaaaacaaattgttttttgaaacgaactgccattgataaacaatttaaactaatcatcttcttcagctggcctgggcaccaagtccaatttagctcctcccagcttgcttttagccaccttctcaagagatagactgcacgtttgaactcccatcttttgtaaaaagggaaacagacaatcagatggggaataatcagtttcaaaataaatatcagaatcaaagttagattccttaaggatactgccagaagataaaacattagaaatacatgccaattatttcaacttctttgcaaattttcccctaggtttaccaatgcccatcctgggatttaagtccgcaacatcaatcagcaaggccctcaacctcgagctttgcattctcacttgatcataaagaactgttttaccatctcttttcttagcaggagcctttggaagcactaaatgttagtgatatgccctagaggcaatcatagagatgattgtatcacatactatgtttacatatttatccaactttgttccttgaaatagataactcattattggttaatgaatatgtgattctttcatgaggctctttatgttgtgtgttgctatttctaaaggatccctgatcaaatatcatatgtggaacaaatatgtttagatgatcagcacatatattaattgatgatcatgtctcatggatcatggtatagagataccaaattaataatgtggacacatgttggtgaacatgttgttggatatacccaacatgagacactgcaagagccatatgtgttgtgtcatcattgatctcagttagtgttggtgttgaatccttagacctgagattatcatggttcccaacatgtgtagtagcttacttagggactgctaaacgctactccgtaattgggtagttataaaagtagttttcgggcatgctatgaaacatgtagtgggatatgaataatcaagatgggatttacccctcctatggagagatatctctatcgtgaggcaaagggattcatacaagnnnnnnnnnnnnnnnnnnnnnnnnnnnnnnnnnnnnnnnnnnnnnnnnnnnnnnnnnnnnnn

SEQ ID NO: 11376 - DNA, 1501 bp, Oryza sativa
tgatcatgtctcatggatcatggtatagagataccaaattaataatgtggacacatgttggtgaacatgttgttggatatacccaacatgagacactgcaagagccatatgtgttgtgtcatcattgatctcagttagtgttggtgttgaatccttagacctgagattatcatggttcccaacatgtgtagtagcttacttagggactgctaaacgctactccgtaattgggtagttataaaagtagttttcgggcatgctatgaaacatgtagtgggatatgaataatcaagatgggatttacccctcctatggagagatatctctatcgtgaggcaaagggattcatacaagtatacactagaggttcagccaatatggtttttatgtatgcccggtgggtcaatacgttctgctgggggccgctgttgacgcgtggaccgaaaaggagttttcgggttacagccgagtgtacatgaacctactgggtcgcacacttaatgggccggaataaggagattggatggagatccaatatgagcttaattcggatagggatccgaataggagtcctacgggccttggaggcctgagtgatggatcctatatattcgtgaggggtgtgaccggcggaggtattgcatcacgtgagaaatcctagccgtcactcccctccccgagcaaaaccctagccgcgcgcgggtgctagcacatctgcgcgtggcgttccgtccctgtacgtgtggataccggtagcggcgctgctggtttgcggtgctgatcagcgtaggaatacagcgaggagaacgcacgaggaggagaaggtcgagctggtgcgatcgactacttcttctacatcgacgcacgctacttcgtgagaattccttcgacttcttagcgccttcttccgctgcgcagcacgtcgagtggtaacgatctatgatctaatacttgcatggttcctggtttacgcgatagaaaattttgatttctgctattgtagcctacgcgtaacccaacactaaagtaacagagctagaggcaacaagtgaacttgggtgcacatccatctcctgagaggcagaaatatcaacagggggccacgcagtagagggacttcatcaggagcaaaaatatccagaggggtagggggtagaatagccaggggaactagagaaatcattagatcccctaaagcatgcatgacatcatcaaccactaatagactttttttccatggcccaacttgaggcctcacccacgttgtcccttttaataacaggtggagaacagtcagtgatagctttccttttagggaaaggagcggattgaaaagagcagctatttgaatgggcattgggatgggggctctattttgcaaagagctcaaaagtttcaccctcaaaaggaactcatcaatcttctcctgcatctcaggtgttatagaaaactgtggaaaatatttagtattgtcagccaacattatgatctgcatattttc

SEQ ID NO: 11377 - DNA, 4505 bp, Oryza sativa
ttcattctagagatggttacaaatctgcaatctgtgaacatcccattcatcttttgcacttggggttcaatcttatcaagcacgtaggcttcatgctgcttttaacgagcaggaaccgtaatgtcagctttgtgcaaacgatttggactaccatcttgaacatgatgaccagctcccacgaatcaccccggattgaagacaatcttaggacctgtttagtacagctccaactcctaaatttagctccaggagttcgatccagagtagagttctggagctgcctaaacctagctccacaactctagttcattttgtgagagagctccacctagctccactcccagttttggtggagctgaaactgtttggttgagctccagatctaggagggatggagcaggagctggagctatgccaaacatgcccttagccatggcaagattttccgacagcatattggattgagaaggattggggttttctagagcaacagtaatctgtcgagaagaagtaggtgaagaagatggaaaaatagatttgttaacgcctttccactgtcaagtctctttaactatccacttggaagtagtcttactcttttgggccaaacactaatgggccttatgtccataactaaaacagaagttacaccggataggattagaacaatttgaaaccccatgatcctgcctaaggcatcgtgaacaaaactgattagaagatttagaggcctttggggaatcagaaggaaaaactagcctatcaaaaaccgaagaatgatttggcacattgaaatcaagctgatctttgacagatctagaattcttatccagtatactctttttcaaagaatcaaaaaccttttagacagggatcatagatgagggaactgaacgctcagattgaacaacatttgcaaaagaaatactaggctatactacgactgaagatctcagatccttagacttcggtttcacttaagtccactcacgatcttgcttaatgatccattgagaatattctttataccaatctggccccccatttctccacagatgaaaaaataatttgaagtggtgacgagagaaagatttaagagaatagatgtcggcgggtgaactcctccaccagggaaccatgaggccccccttttttggttcggccgggggtagtgattggtattcgaggattctgtggtggagtgtgaataagagggggtcgggcccccctagggagatgagacaatagcggtttatacaggttcgggccgttgagaagcgtaacaccctactcttatgctatgctgattgagagagtgagattacaagatctccttgttggagtggaaggtgttgatgatgaggggaggcgactgcctctagtgaaaaagggctcatcccctccctaagtaggcctgcacctccttttatatctcaaggggttactacatgggcccactgagcctattcagggaggataatcacattaaatgcatgtctcgttccttgccttggaagtctcttgcatgccatgttgcggcgtggggcccgtcaaatccatctggctgacacaggggacacgtatgtcattcgatatttaataaatgaggacttttgggtcctcacttgtgctgggaaacggaaaccctaccataaccgggttaggcaagcctcacttgtgcgacaagaggctaagcggcctcccatcatcacgatgtgacagggggtctcaggcggcacgtgttggtatttcttagcgacactactgaaaatataattcccagcaatagcactagaaataatcctggtatattatggttacagatgtgatctgcaagcgcacggatataccattgtagcatttcacctgggagtattccaaggtatcgtatttattttatcccaagggaagatatgataagatagtactatgctaataattcaaatattacttatatacatcaaagtctatgcaggagttaatttagttcaaagggtagggtggcacacagaagaaagaactaagatattctcactaaaatatagtctaagctaagtggagaaagaataacaaaaagtatcattcctgtacttctagtatatatacatctttagtctatacttgttggtatacaatcatgcaaccaataccctctaacagtgtcctcctggtgttttgagagaccaccccttgttgctgagttccttacgacaatctgtcatggccatccaaccgaggctaaatacggaggagtaccctccccaggaaattgtacttaggataatatacacatgcagaggaacacccgtattgagctgtcaccatcagtggccagcctctgaaccattgcatattaccccaattaatggtatataataatctaagcatcgcacttacattactaaatactactctgtatccttgcaaccgacatagagcaaacgaatactcggacactaaacccacaccaatacacctctctggtaagctagtcacacaactatattcgtacaagtataaagtaaagtcggtactcaattatatgaatggaataagataacgaaagtgtataaagaagaatattgtattaattcaataagtcttacaaaagaaaagaggaaagctagtagagccatacccgaaatctcctgaagagtcgaggactatgaagactattctatttcctactccactagtactagaactactaaactaaacttgggagagctcttgatcttcttcttgaggtgtgtggagaatggaatgagataacctcccaatgacggttttggcggttggaatggtcgaaaatgccctccaaccatcattggggagtgatccacaccgtccatcgcaaaccctgcatcgaacggcttcaaggtgggttcggccgaaccatgggctgggctactctggcccatttttggcaggtagcccccataactcctctcttatccagaatagtgaattttggtcctattggatcgtgtcatatctgagttctcagcccatctatccataagtctgattctcgacagcgtctgattgatcgttcatctatttttggtcgattcttctctatttatatgtgcttcttctacatagatgttagtagcatagtacatagtggaagtagatattttattcgggaattatacatcgcaaacatagctagtatttactaattgggtaatattgacggtcgaaactggtcgataacgaccgtcaacaaaccccccaagcttgaacctttgctcgttccgagtaaagggctcacaaaaatttaaacttggttgtcgattaggagttgctactatgctgtatatctcaaagatacagatgcaaggtatgtgtactctctctcaaaccaaataagtttggcattatggcttacccttacacctaattcccgcgagacactgcctttccttgtcttgagcggttgagagacagaacaacaattagagcgctagtcacccaatctttatttaacttttatcttggaagttttcaaatgatttttcaaaagaaatctaagtttcctcaaatgattctctcgatcactcagagtgtttgaatatgaattcctcaccaaatttgcctttttgaatcctactctaaggtttgatatatggagcttggtagggatcaaacatggcatacttgtattcacatttattactaagtcaaaaacttggactaaaatagatgactaatcatactcaagatcaagattgtgcaaagtgtgtgtgacatatggtggaaatggaatgtggaaaagaaagaaaattcttctcctttgtgcttactttcttctccaaatcctcctttcataaatatagagagggcatggctacattttttttaacatcttgctcaatattttgagagagcataagtttattatgattattattttcataaccatgcctttccctcctttttctcttttcttttttattcagaaaggattttctttttaggagaagaaagcacatataagcatgaagaatttattttgatgatggtataatggaaataaagatagaatggatgctagcttgcagtgtagaagtttagcatatgcatatatgtgggtgtatgatcttgatcatagagcatgaaaagtatctacagaagtcacaaagatttgacaaatttcaatggacttacaagtaaccaaaatgtatatggcttaatcaatatggatattttttggctctagtaggaactcatatcaaatgaggaactttgaaatttatcatttcggaaaataaaacattcggaattcaagtcaaacttagaacaggatcatagaaactcttatttactatctcatatctcgcaacaacctagactcagatcaacaaagtgcagctagactcagatcaacaaagtgcagctcacttacctcaggttcctgataattgttggttattcttactcaaattttgagagagcacttaaccatgacccatatatgagagatataaaacagaataact

SEQ ID NO: 11378 - DNA, 1406 bp, Oryza sativa
tttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattgccgaacgaaaatcggggcgttacaaatctcccccccttgcaggaatctcgtcccgagattctgggatggctagaaagaaagccagtgctggtgggcgatctgactgatctgcacattgaactgccacattctgcttcgaactgattgattgactggttgatcaaacctgcatgattgaactggctggattcgacctttctgttcctttgctttgccaaaactggactgattggttctgcttgaactgacccaggccagaactgcggatgctcctggaacttacttatcttggactgaaccgttgatgctagcaatttgataacctgacagttcaccaagttggctagagaaggatggagttgttcctgaatcttgcatctggcatttgtaactcattgatcctacatccgcttgaacgggttctgactcgagtgacacgtaattccaggaaacctgcttgacctgtctttcgtctgaactgcaactgtcctcactgttgctcctctaagctaagctgttgaactgggctcatcggatgccctgggatcggcttagttcttctgataccttgcaacatgcttcttcaagtgctaccctgattgcggcactggttgaaccttcaactaaaacagcgacgaagtgaggcaaaactcttctccgagacctaccccccttacaaggagtagtcttactttcgcgtggctgagatcggttgaactgttgtccttcgaatataaccaacacttctctgttttgcgaagagccctgactttgaaaactaaaaacttcgccgatcgatcaaaatagagtaacaacgatgcactttcatcccattaagatttggaacttaaccctcagttgctgataggaaattccacataaagaaattctcatttagctcctgatcttactaactcttaactgactatcccatcagtaataactgctggcatgactgtccttcttctgacctgacttcggtgtcatccacctaaatgggttgtgtagttgatatctcaaaactaaactgaccgactcgcattggaattgacacaacttgaggaactggggtgcctgcgaatagagctgttgtctttgatgaccctaaacgccttgccgtgaaccaaccttgcaagaactgaccttgtaaaccataaccactaataggtagca

SEQ ID NO: 11379 - DNA, 5872 bp, Oryza sativa
  unsure (1)..(5872): unsure at all n locations
nnnnnnnnnnnnnnnnnnnnnnnnnnnnnnnnnnnnnnnnnnnnnnnnnnnnnnnnnnnnnntctatgcagctcaacctgaaagcaagaactcgtcgaaacaaaactaaagtaaaaagggtggcgatgcgccaaaattgtattgaacgtgtgtgttatcatttacatagggctcagggtctatttatacccgagaattacaagattgcccataccggacacgaccattatctctaacaaactctaagataccataagtctttgcggcagacttttgcccacatttatctataaggaatctacataaaatatcctaattaatagatacaattgccttcctaggactctatccgtgcgtggcaatcatcttgaagtacattaacttgaacccgatgtcgcgtacaaatcgtattgtcggaatcggcgttatcggcttacttagcctgactcagacctagccaatcctaatcgtagccgatctggactccagccgattcctgctctgtttccgaactcgatctccgcatccgatttcgctttgatccaatcttctttcctgacacagatgttaccaaatttggttgttaacagtattaaaatgattagatgttggtttagggaacgcttagccatgcttagttcaactagtacatagaggggggaattacagtaatgcatagactctgattattggtatagctttggaatagagccaccgcaatggtgttagttaattaaaatacactacatggtgggctgtggatgcatggttttgctagtcgtgcccatagcgattaaggaccggttcgcgggatgccctggaagaacttatcgtgcttaccacaagccagcatgggcaacggctaggcttgtagtgttgctttcctttagccgacgtacccaggcgagggtgggcgtgatggagttgggtcggtcggggtgtccggttgatcggcttccggattcaccgcggcacgaaaggggggctgcccgttgcctgctggggacgggggcgaaccctaaggtgtgatgcgatcggttagagggggttatgcgaaggatcctgtcatggcctctttccggtatgtcgtggtggcatgtcggcgcacggaaacgtgtcgtgggactgtgtcttgtgggtacagttgtacacctctgatcagagtaaaactattcgaatagccgtgcacgcggttatgggcggtcgaccagattcaccgtgattagtctcacccctagttagctaatgaactggtgtagttcaggtggttggttgggcctgttgcaacatggtgtagtgttggacagtgactggttaatactgattaattactacaactgttttattgctttcaactcctgcttttaaatgctagctttatgcgaaagaacctttagcctcccttggatatatcctgcatcatacctcctcttccggtatgacttgctgagtacagtgggtagtactcagtcctgctctcttttccctacccccagagttgaagttcttctcagttggagatgtctcgaagaagttggtttcgtcgctgccgtcaaggatgcctgtggaacggagtcgcccgctgcagcagtcaagtcttcaggcttagctcgcttttatcttttccgctgcatttgtaatcttttatatttttgtaagacgtggatctgtatgtcaacaattgtcatttgtataccctggctagtcctggataggggtttattacacattaagcttagaaattctggttcgtgaatttctgggcgtgacaacatataagagtgaccgatagcatggtagatcattttttcactcttgaaatggatgaccttgttaaaagacttccgattgacaaagctccaggcccagatggctttaatggttgttttattaaaaaattgttggccaattatagcccaaggttaatctagaatgtgttaatgattttaggcctatttctcactcttttaatctagacttgttaacatgaaaaaatgaccgaccggaacttcttttccctttattcattgatatacgtattaaattattgctttttaaaattctccactctcatgttatctaatcctattggatgcatgtattatatttattaggatgatccaaactacgagatgataataattatttcttggtctttgggttaagcgtggttgtgcattatattttggaatagagggagtagctcacacatgttgattgcaaaacaaaaattgtttttgtttttttcttattgtgttgtaggaatgttttgcacacacctgattagggcgttcgtacacatccaactggagaagatccctgttgtctattcctaaagaggtataccatgaaagcaaacagtgacaagtgtgatcgtgagactgcaggaccggatggggtgcatgaaaattacataacaaacatgatgatgattgaagcatttggagtgatgagggcagcatgcaagtcgaaggtcgcatatgaaagagctatggttattttgaaagagttgcgtaggcaggttgaggaggtaccacaagatattcaagttgttgtttgtgttctgtctctcaaccgctcaagacaaggaaggacagtgtctcgtgggaatcaggggtaagggtaagccaccgtgccaaatttatttgatttgagagagagtacacatatcttcttgcacctatacttttgagatatacagcatagtagcaactcctgatcagctaccaagtttttttttgtgagtcctttactcgggacgagcaaaggttcaagcttggggggttttgttgacggtcgttagcgatcaatttcgcccgtcaatattattaaaataaaggagaactagttatgcttgcaatgcatatttcatgtcaaactaaaatatattccactagcactaggtttctaactttttgcagagaatgatcataaatgaaggagaagtgacagcaaaacatacgatcaatcattcagacgctgtcaagaaacaaacttatggataaatgggctgagaacaccaaattcacaagatccaacaagcccaaaattcacaagtctgcggagaggagcaaacggggaggccacctgccaagaactgagccagcccagggttcggccgaaccagccgtagcaccgatggatgtagggtttggctggacggctgggattgatccccaatgatggttggagggcattaccgacctttccaaccgtcattaccagcctatataaacccctcactccctccatttcttcacacacctcaagcaagaagaatcaagctgtctctctagtttagtagtcttctcaagctagtggagtaggaatagaataggagtcttagtccgagaagtcttcataggaatcgggtatggatccggtagctttactttcttttgtaagacttatacttttattaaaatattcttctttatactactctggtattgtactactttccgaatatatgagtaccaattgtatcatacattcaaactatattgattatgatgctagcttatctgggaaatgcaatggtgtgggtataatgatcgtgcatacgattgctctgtgtcatgacaatgatattagagtagtatttggtaatttaagcgtggtgtttagattactagatatcgttatttggggttaaatgctacgaatacatcaaggtgggccgctgatggtgacagctcagtacgggtattcctccgcttgtgtatatactcctaagttactttcctggggaggctactcctccgtatttagcccaggttagatggtcatgacggattgttgtaagaaactcggcaatcaggggtggcttctcgaagcaccaggacggtattggaaagagggtattagctaagtaatcatataacttggatgtatatgtataatatgtatctatattagaagtataagaatagattctttctattctcttcccacttagcttagataatttattatgagagtatataattctcttgctgtgtgtcattctaccctatttataatcttaacccctgcttatactttgattattacaagtaatatataaattattagtatagttctctctgttataatcttcccgcaggattaaataaatacgatacccttggaatactgtcacgcccagaaatttagtccaaatttctagactattttgtgtattaaatcactgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcatctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaggggatacaaggaggggtttgtggctatttgcataaaggcggttgtaaaacattttattgagcaaaacagtaaaactgttgagtaattaaagtaacattaaatctccactgatcaacgctacaccacgttgaacaggcccaaccaacccacctggactacagtgtattgggtcgatttattaagatgggactaatcacggtgaatctggtcgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggacccttcgcataaccccctctaaccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgactagcaaaaccatgcacccacagcccactattcagttgcattttagttggataattacgaccatgaagcatggccgggtgtctcgagcacgcagctcactctgatactaaagggtctaatactgcaattatcccatcaactgagctagtggtaattaagcatggctaagcatatagttctagctaggtcacataagtaacatgagctagtggattcattacccaaggttgacaaagaacagatatcaagtaaacatggcacaagcgagcagataggtaatacccggatcccatgtaattagtaaaacatgcatatttatttgtaaacggtaaaacatttataaattgggatcaacatgctcaaggggaatgtgtgacttgccttgctgcttcactttgatcttccgaactcttttcctcgcgaccgcggacttccgaaacgacggattctacacgctgacacgcaaaacgaggaaaaactctaataaaaaccaagaaaacagtacataaaaagtaaacaaacatgtagagctcaattttagatgaattttgcaatttgaatggcccaattcggagttcgaatgaattagatatgaattttagaagttttgagccatttaaatgaatttctataattattaacgaattatgacgcaattattatttatttttccaaaggaaaannnnnnnnnnnnnnnnnnnnnnnnnnnnnnnnnnnnnnnnnnnnnnnnnnnnnnn

SEQ ID NO: 11380 - DNA, 4087 bp, Oryza sativa
  unsure (1)..(4087): unsure at all n locations
agaggagacaatttgcgaatagggttttcagaaaacttgtccttagggtttgaccatttggctcaacctacagtcaagttgcctctgataccactttgtcacgcccagaaatttagtccaaatttctagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcagctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaggggatacaaggaggggtttgtggctatttgcataaaggcgggtgtaaaacattttattgagcaaaacagtaaaactggtgagtaattaaagtaacattaaatctccactgatcaacgctacaccacgttgaacaggcccaaccaacccacctggactacagtgtattgggtcgatttattaagatgggactaatcacggtgaatctggtcgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggacccttcgcataaccccctctaaccaagcacaccacacctcaggttttcaccccccgtccccagcgggcaacgggcagtcccttctcgtgcctaaggtgaaatccgaagcgacagaggccgtcgcaaggggccccgcccccgctcccatcacgcccaccctttgcctggatgcgtcagctagaggaaagctacactacaagcccagccgttgcccacgctggcttgtggtaagtacgataagttcttccagggcatcccgcgaaccggtccttaactgccatgggtgcgactagcaaaaccatgcacccacagcccactattcagttgcattttagttggataattacgaccatgaagcatggccgggtgtctcgagcacgcagctcactctgatactaaagggtctaatactgcaattatcccatcaactgagctagtggtaattaagcatggctaagcatatagttctagctaggtcacataagtaacatgagctagtgttttctttacccaaggnngacaaagaactgatatcatgtaaacatggcacaagcgagcagataggtaatacccggatcccatgtaattagtaaaacatggcgatttaaattttttntttaaattttttttggtgggaaacggtaaaacatttataaattgggatcaacatgctcaaggggaatgtgtgacttgccttgctgcttcactttgatcttccgaactcttttcctcgcgaccgcggacttccgaaacgacggattctacacgctgacacgcaaaacgaggaaaaactctaataaaaaccaagaaaacagtacataaaaagtaaacaaacatgtagagctcaattttagatgaattttgcaatttgaatggcccaattcggagttcgaatgaattagatatgaattttagaagttttgagccatttaaatgaatttctataattattaacgaattatgacgcaattattatttatttttccaaaggaaaagacggttgctgacgtcatcaaaggggaggggcggcgccggcaagcgggccccaccggtcagcggcacaagggcgccggtccaccgtggaccgggaccaccgaggcggtccaccgccggtccacgggaaccgacggcccggatcggcccaaaccgatcgggcggccaggggcggcgcggctggggcacagcacggcacaaagccggctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggggcgcggagagggcaatttcagtggttcccggaggcgaggaagcggtggccggggtgcggctcggagttgccgatccgagggaggaaacggcgcagtccggcgtcgaccggggaggcggggcgacacagatggagacgacaaacacggcggcgatctcgggttggtggtgaagttggtgctcgggcggcgagaggcgacaaccgagcggcggccgagcttgactttgaggcggcgaaggtactggcagtggtggcgcattggggcgacggctagggcggcggtggcgcgcggctgaaggcggtgaaaggggcggcggcctcgggtgtgcggtgggagtggtgctcgaggggtggagagggggaaataagaggcggccggacttccccttgcggtggcgaagctggcggtggcggcggctcggcgcggcgacggctgtggcggcgggaaacggcgaccggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaactggcgccgattttcgcggggagagtgggggaaatggtggaggacgtggaggggatcgtgcccacgtcgttgaatgcgagctcgggtgcgggagggcgccggattttgcggcgacgtggacggcaatggcggttggggtcggccggtgagaggtaggaggacgagctgacgggtgggaccgtcggtcccacctgtcggcgaagggagagaaggagggacgcaaaacagacttttgcgagcgggccaagtgagaggggagccggcccgagagagggagaaggcgcgcgggccgcgggagaggaaggaagacttgggccgaaaatggcccaaagagaggaagggggattttaattgttttctttttattttaattgatgcaatgatctttgtgctattaaaactatttctcgagctccgaaaattcatggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattcccgaacgaaaatcggggcgttacaaatactctcgggtgaaatgctacaatgttatatccgtgcgcttgcagataaagtctgtaaccataatatacgaagagtgtttctacgctattgctgggaattatatttctagtaatatcattaagaaataccaacaaccatgattctaatttcattggaattaatccttgaccaaacctttgatctagtcttatctctaattcttctctatcctgacatgttaccaatccttctgtagatattccaatagtcaaattcctttttcgatcgagcctccaatttaatccctatggcttcaacctccccggcacaagaatagtattattacaaattttggaatgattgctcttgtgctaagaaaatagattttaattcatcgttctcatccaaaatctaaattccctattagccacaaataattccccaaatattcatactaccaatttaaggattcaaatccttttttttttgcctctaagtattttccttccttattcccaaaaatatattttgcgagtaatcatatcatttatttcccctcctatttgagtgctttaatatttagtccaagtattctttctctcatatattgcactcaaa

SEQ ID NO: 11381 - DNA, 1924 bp, Oryza sativa
  unsure (1)..(1924): unsure at all n locations
nnnnnnnnnnnnnnnnnnnnnnnnnnnnnnnnnnnnnnttttgcgaagagccctgactttgaaaactaaaaacttcgccgatcgatcaaaatagagtaacaacgatgcactttcatcccattaagatttggaacttaaccctcagttgctgataggaaattccacataaagaaattctcatttagctcctgatcttactaactcttaactgactatcccatcagtaataactgctggcatgactgtccttcttctgacctgacttcggtgtcatccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattgggggtgacttagctgtgctggtctgctaaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgctacatcaatatctggcacatccatcttccaatcttggctaaccagagcgaggtgctctgacttagctggtagcttgttgtcttgaactgatccactgactctgactgcaacacactactgctggagttatttccgctacatttgactaggtgtccaacctgcatctcccacatcgatacacccatcctctgatcttggacaccaaaagttgatcatgagcaggtttcatctggcattggggcaccttgcagctttcaactaacccttgatctgtggcttaaattgatcttatctctcacactgaccatctgctgccaggacgaaagagaggtggaagaaaggggtcgctaaagataaggtactaaaccacttgcctactgatatgttgttaatagatttttattgttcaagttgcttaagcaaacaacctagtatagtcgcatccccaccaatgatgcaaaccatacccctacacacaagcaaacaacacacgatctagaatctaacgaactactcttccgggaaggattaggtttaggtgaacttcgggaaaactcttcttgatcttcgcggaacgatgactctgaactaatcttcccgctccttgcacgaagcttgagactcgacttgacttctggacgggcatgaagctggcggtttctcctacatgtttgacaactaaaagagttggagggacagggaggaaaaattttaataaactgtttcgcaaagaaatgccgaagggcgagaggagacaatttgcgaatagggttttcagaaaacttgtccttagggtttgaccatttggctcaacctacagtcaagttgcctctgataccactttgtcacgcccagaaatttagtccaaatttctagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcagctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaggggatnnnnnnnnnnnnnnnnnnnnnnnnnnnnnnnnnnnnnnnnnnnnnnnnnnnnnnn

SEQ ID NO: 11382 - DNA, 750 bp, Oryza sativa
  unsure (1)..(750): unsure at all n locations
nnnnnnnnnnnnnnnnnnnnnnnnnnnnnnnnnnntacaccttttcaaaatacaaggcatattttgagtattaaatcaagggaaagatgggttgacttataaaagaaacggatggagttctttcttttggttgcttgcaatggctgaactcaacttattcgtgattgcaggcaacctgtgtattcggtcgcatttagccctggtggtgagtacttagcaagtggttcccttgatcaatgcctacacatatggtccgttaaagaagggaggatcttgaagacatacagagggagtggtggcatttttgaagtgtgctggaataaagaaggcagcaagattgcagcatgtttctcgaacaacacagtctgtctcatggatttcaggatgtagtttaaaccagtggatggatgaagtaatacaagcagatgcttggctatctgttcttccgtgatcagctggggagaacaggattattgccttaactctaggttttaggtacctttagtttgccagtgcttgtacagttatttccttgcggagaaactgaccataggatatagttatgtgtagagcgaaatctttccaacatcatgtcttcgcaatgctcatcgtatttagtactatattagtaacaattgtttattcgagattatctttgtcattaccataacaaatgcttaattgctatggtaccatttgactgagttgctatgatgtcatcgtcgtcagaatttccctgagggtatttgg

SEQ ID NO: 11383 - DNA, 611 bp, Oryza sativa
  unsure (1)..(611): unsure at all n locations
nnnnnnnnnnnnnnnnnnnnnnnnnnnnnnnnnnnnnnnnnnnnnnnnnnnnnnnnnnnnnnnnnnnnnnnaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctctcccttcgccgacaggtgggaccgacggtcccacccgtcagctcctcctcctacctctcgccggccgaccccaaccgccattgccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttctcgaataaacaattgttactaatatagtactaaatacgatgagcattgcgaagacatgatgttggaaagatttcgctctacacannnnnnnnnnnnnnnnnnnnnnnnnnnnnnnnnnnnnnnnnnnnnn

SEQ ID NO: 11384 - DNA, 715 bp, Oryza sativa
  unsure (1)..(715): unsure at all n locations
nnnnnnnnnnnnnnnnnnnnnnnnnnnnnnnnnnnnnnatgcacagtccgacttggaaatcaacttgattccacaccaaatccgctttgatctttcttctttttctccgaatctaatgcaaaatttcgttgttaatacatgcccccaattccgctgtattatataatacagtggaatttgctcttgttgaacccgcaaaaatttagggttttctgttttaacttttagctcataagtagaggcccattccttcaaaacacctttgtccggctatgtcctcgacaagctcttcattgtagaaatccctaatcctccggcaaccttctccggcgatccagctctccggtagcagattcctctgttcacaagcagcctgcgcagattcgcataaatggcgcacacggtaccaatccttgaggtatatttatcaatctttgttgacggtccttaaatcataatatttgaccgtcaatacctgcatataatgaaataaaacatggtatccaacttagtgatagggattattactaatcaattccactagtgttggtgaaatatgtgtatgcaggtattttaaggagaaaacacacctgtcatacgaggaaacacaccttttgcccatcaaacgcaagcacacggattggagggcccacaaattacgtggaacccgncatggaacaggtcataactaccataattgccataagtgcccacc

SEQ ID NO: 11385 - DNA, 733 bp, Oryza sativa
  unsure (1)..(733): unsure at all n locations
aggtccttaagtcagtttttgttaaaaaaaataaaaaaaaaagtgagaaaaaaaagggcagaaaggtgcaaaaaaaaaagaaaaaaaaagccgcaccaaaaaaaaatcagaaaagaaaaggaaaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcattatctgatttgagcatttgctattcctttgctacgtatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgnnnnnnnnnnnnnnnnnnnnnnnnnnnnnnnnnnnnnnnnnnnnnnnnnnnnnnnnn

SEQ ID NO: 11386 - DNA, 735 bp, Oryza sativa
  unsure (1)..(735): unsure at all n locations
nnnnnnnnnnnnnnnnnnnnnnnnnnnnnnnnnnnnnnnnnnnnnnnnnnnnnnnnnnnnnnnnntgttgaccacctcccgttttgtgcatcacagccaccggaacgtgaccacgccaacaacgccctgaagcacgcactggagcgccaccgcttcgacatcattgtcgaccggccattctcgtccatctcgaagcaagccgctgtgccaagaatctcgcctcgactacctcttcaagacgcctcgagaaccccagccggagacgtgaaggacttggagaacgcatcttttcttcccggcgtcgatctaggatcgcctccgccatcatcgtcgattaccgctgcctcggtgagccattgttcgattcctcgcgcatacaccatctccataacctcacgaacctcttggacacgcatgcatggcaggtccttgagttgttcgagccgtcgccgttcacctgaggaggagcgccgccgtcgaacctttccaaccgaaaccgctgctatccaagcttcggtgatttcttcctacagcttggtgagcctcctggacctcttaggaaacacatgcatggatgcatctagcaaaatcaaagcccgtaggcaacatgcagtaacagctcatgtatacctaccgctcaccctccaatgtctcctagccaagaaaactagaggaatggaatcgtgagagcattctcttcattttataatttgacctcattcccaatcgagccac

SEQ ID NO: 11387 - DNA, 716 bp, Oryza sativa
  unsure (1)..(716): unsure at all n locations
nnnnnnnnnnnnnnnnnnnnnnnnnnnnnnnnnnnnnnnnnnnnnnnnnnnnnnntccactttctctttattttatttgataaattcctacaacatgttattctccaagtacaagtggaaatatattatttggaaataaacatgcattgtaagcatagctacttctccaatattttagttatattgacggtcgaaatttgtcggcaacaaccgtcaacagtcggcagagtggggccagaggagggtgtcgacggtcgttatcgatcagtttcgccatcaatattactgaaataaaggagaactagttatgtttgcaatgcatcttcttgttaaaataatatatattccactagcactaggattactaacctcttgcagaaaataagcataagatggaggagaaccgacatcaaaatagacgatcaatcaatcgaacgatgtcgagaatcggacttatggaaagacgggccaagaactaagaattgacacgatcgaattgggccaaaattcacaagtctgaagatagaagaggtcaaggaggaagcctgccaggaacagctccgttggatccagggctttgagggaacggtggagattcactccctatgatggttggagggtattgttggtatttggtaacgacattactagaaatatcattcccagcaatggcgcaaaaatactcctggtatattatggntacagagttcatccgc

SEQ ID NO: 11388 - DNA, 1274 bp, Oryza sativa
  unsure (1)..(1274): unsure at all n locations
acacagaagtcactcataaatcatgatatccgagataaacaaactgtgagtctgattagtcatcaacaacatcttccatatttagacatgttacaaaggcgattatgatcctactaagaatttgttgcaggtaggcttgtgtcttctttttgacaactattcgaatttcagaaagccatacataagtcagaacaactatattttcttgaatatatagtttttgcagtacaagtgtaatttaatgtaatttactccattttacatgtaggacagtgggaactaaaatgataaaatttgtactgctcttgctaaaaacataaaacaatatgcactttacttcatttgacaaatttcaaaggacataaaagctagagggtgagctatcaattatcaaccatcagatacccaatatgaatctaggtatagcttctagtatttaattataattaaaaatatagcttctaggtatttaattatttgcacaaattatttaccttgccaaaagcaactgttgattgggattatttgttcctggtcctgttgggctccatctaatagtgtatatttcctgcaaaatataattaagcatatgatagacagtagaacaggttctagggatcataaaaaatgagggtagatttctcaaaccttagtatgctccttaaaatcataaacacatttatcctgcttcatactccatatctgcaaaaaaaaagaaggcaacaaaagtgggaaaaggcttcacaatggacgatatagcaccagcacttcccaaggattgtaactgcaaacccatagcgttgtttaaaggagtaagttcattggccccctcaactatcggtttcatcaaattgtttttgacacattatcaactccacattactggtttttgttgttttatcaaaaaatcatctccaaggaagaagcatccatgatattatttccttgtccaacagattgccaaatgtctcagtgggaggaaagaaccccatgtcctactcaaattggatatctcaaaggcttttgattcagtttcttggtcttttcatgtggaggtcatgcagcagctgggttttcgtcattgttgttgtaaccttttgtgtttggtcctctctacttctactcgaatactggttaatggtgaagccagggaggtaatctttcatcgtcatatggtctccgacaaggtgaccccctctcccccatgttannnnnnnnnnnnnnnnnnnnnnnnnnnnnnnnnnnnnnnnnnnnnnnnnnnnnnnnnnnnnnnn

SEQ ID NO: 11389 - DNA, 718 bp, Oryza sativa
  unsure (1)..(718): unsure at all n locations
tgagccatattatgtaccatggtatgccttgagggataccggtagcggtaggcacgaccggcgactgatgtggccccaggcttgaggtgnatgcggtagtcgatagcccgtgccgacagcaagcctggggttcggcgaagaggtcctctaattccgccaggagatgctgcaaaatatcgtcgatgtcgatcgccactcatcacatcgggccctgatcagcgaggctgtagaacatgacctcgcgtgtgctgcgccatatggccatgcgcatgttcttgaaatcccacagtattggccccaacgtttgcaaccattgcatgcctaggatgatgtcgacagcacacaagtcaagggcgaagcagtcgaccgagaaggcctcgccatcgatgttgagcgcgaggttgcgacacaggcccgggctgacaaggcgatcaccattggccatgacaaagcgaagtccctagcacaccggctcaagatggaggaggtgatgcaccacctgtgcgtcgagccggagtcgacgagtgccacaagcccacaacacgtatgtcggctattgtaaccggaagcctcatggtgctagctccgtcaatgcctgatagcgtgttcacttgtggcaccgcatcgtcgttggctccgtcatcatccgtggagtcatnnnnnnnnnnnnnnnnnnnnnnnnnnnnnnnnnnnnnnnnnnnnnnnnnnnnnnnnnnnn

SEQ ID NO: 11390 - DNA, 1381 bp, Oryza sativa
actgcttttaaatgcctgctttatgcaaataaacctttagcctcctttggatatatcgtgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaatcttttatatgtttgtaagacgtggatctgtatgtcaaaaattgtcgcttgtgtaccctagctggtcctggataggggttttaatgtacattcagcttagaaattctggttcgtgaatttatgggcgtgacagtagcgaagtatctgctaaggtttagttgtttgctagtcattgctagagttgggtagcatgatgactgagtttggtatcttctctagccggtgtccacgaatagcatatcggctagaggaataggaggttggtgcaagtttagcgaggcgaaagtattacttcacaatcgtgggtggcgacggagcgactaggatcgcacagagcccgagagttaactgtgtggcgtgttgtggaggtcaagggaatagtgaagctccgaccactgtacacatcaaggcgtggggtgccaggagcagcacttcgaccttgggtttggttctgctggattttacaaccaacggtccgacgtggggcccgtagaccgcacgaacatccccatggaaggcgtaaagttccaaccggcggctttttagtggctaataggtattttgggataaaataaaatatttgaaaataaaatataagtttaaattggaaattcaaatataggagtaaatcaaatataaactcaaatggtatttaaataaattaagaaaattcaaataaaatattaaaatactaaatttggtatcaaaatgtagagtttgaatttatatgaatttaggtataagtttcactataatcggatctacactttaggagatatgggcttctaaagaataggatttgaattaaataaggaaaatacgaaaagttactgtgtaggggcccacctgtcagtatagatggccatgtgggcagcttgtcgggccggcacggtccgaccgacgcaccgggctgtgccgtgccaacccacgtgccgcactcacggcccaggcatggcccaacacgactcgggccgtgccgggccggcccaaaggtagagatggcccatcgtgcttttcctcagaataagactaattttcctccctcctattgggctgtgacatatatattgctaggaataagttcacttggtgaccctca

SEQ ID NO: 11391 - DNA, 1263 bp, Oryza sativa
  unsure (1)..(1263): unsure at all n locations
nnnnnnnnnnnnnnnnnnnnnnnnnnnnnnnnnnnnnnnnnnnnnnnnnnnnnnnnagaataagactagttttattcttttctcctttttttcgactttcatctcggtgatttctctatgagctttatcagcatgggcaaaacgatatgggccaagagcccaaagagaggtaggttggatatggcagtagtactatgtgtgatttatttctaactcgatttgttcgccaagattttcaacatattgcaaaccccaacgctaggggggcttgggggaaaaaagattgtctaaaatacaatttcatttagaagaatctagaatacaatgggtctccttaacaattagaccaagtgaccagtccgactaggtagattagtcgtgctgtcctaaaacagcgtcaatataacttaatgctatttttctagattacacgacagagccacacatgtacacatcactatatacgcaaatacgcaataccacactgacaaattttgctataacttacaatcgtctaaattacatctaaaacaaaaatttagataaagaatcaattatccaaaatattaagttaattataactatcactgatcgattagtttgatgtatttgtgacatccgcatgcatagtgttactacatacccaccttgatcactacatatatgcatgtactgattaaccggccagcatgccatttggcctaattagaatactcaggagcatttgatatatttcccgtgttctctctttccgtccaacaccaaaactaatactccctccgtttctaaatatttggcaccgttaactttttaagaacatgtttgacctttcgtattattcaaaaacttttgtaaaatatgtaaaactatatgtctacataaaaatatatttaacaatgaatcaaatgaaatgaaaaaaattaataattacttaaattgtttgaataagacaaatggtcaaacatatttaaaaaagtcaacggcgtcaaatatttagaaatggagggagtaaaatagtgggatgatgtccagtagcaaggagccacattataacagtgtgtttctctaaataaatatttacttttacgctacaactaaaccacgaagtcgcaaaatccaataacagattttaccatatttggtgtttcagaaaagattaagtacccaaggataaaagataaatgtggcataaacaatatacatagaaaataaaaaattgttagcatttcatgttcacattgtaaactatttaaatttatctca

SEQ ID NO: 11392 - DNA, 989 bp, Oryza sativa
tctctctcctcccccacttctcccacgttggccggcgaaatcccgcctctcccggccacgtccggccctcccctcccctatttaagcttccccgtcactccctctcgctttttccttttctcgccgaactccctcgtgctctccatcgctcccgcgccgtgcaaccacccgccgccgccgtctccgctactccggccgccgctagccgccgctaggctcaccgccgcaccgcgccgtcgccgccgtcgggttcgcgtggccgagatccaccccgtccacccctcctccgtagagattcgccgccggagccccatccccgtcgtgcgctggtgagtgacgccatggccgccgccttcggccggcgccctcgctctctcgcactctcctctctccctctaacccctctccttttgttcgttaggaggttccgaagctcgtcccgccgtcgccatcgtcctccgtcgcccgccgtcgtcgaccgttgtcggtgaggcctctcctcctctttctctctctcccgcactgtttagccgtcgcgccgccgcttagccgcgtagctgccgcttcacctctagccgccgctctccgccgccggtcggtcgccgtcggccgccgtcttgcgccgctgccgcatgtgcgccgcgccgtcgcgcgccatggtcgccgggccggtttgcgccgtgcccgcgcgcaccggccgcgagctcccgccgccgtccgatctacccttgggtagatcggggccatcggttcggccgccgcgtggcgcgccgctcctccccggtccgtggacccgatccgccgtggaccgccctccccgagccgctgaccggtggggcccgcttgtcggcgcccttcctccctccccgagccgctgaccggtggggcccgcatgtcggcgccgcgccccgccttgatgacgtcagccctggaatatattgcgcaataaatgatttaaggtttttcttgtatagtaataaacacagtga

SEQ ID NO: 11393 - DNA, 660 bp, Oryza sativa
atatgaatgcaagaatgatacattgatggtttataatgagaagtgcctggaactaatgaaagagttttggctggttactttgaagcatgtatctcgagaacaaaatcttgaagctaatgatttggcccaaggggcatcggggtataagccgatgatcaaagatgttaaagttgagattgcagcaatgtcagccgatgattggaggtatgatgtgcatcagtatttgagtaatccatctcaatcggcttctaggaaattacgatataaggcattgaactatacactgttggatgatgagctttattatcggacgattgatggggtattacttaagtgcttgagtgccgatcaggccaaggttgcaatcggtgaagttcatgaagggatctgtggtactcatcaatcggctcacaagatgaagtggttgcttcggcgtgcagggtacttttggccgacaatgctggaagatttattcagatattataaggggtgtcaggattgtcagaagtttggagcaattcagcgagcaccggcgtcggctatgaatcctattattaaaccatggcaatttagagggtaagggattgacattattcgtatgataaacccccatcgagtaaagggcataaattatattgggtgccacttgatatttcacca

SEQ ID NO: 11394 - DNA, 689 bp, Oryza sativa
  unsure (1)..(689): unsure at all n locations
ggataaatatcggctagggttttaggtgtntgctagtcgtcgctagagttgaacatcatgacgactaggtttagtatcatttctagccgtgtcgatagacaacatatcggctagaagaatagaaggtgggtgcaggtttagtgggccgaaagtgttactccgacacccgtgagtggcggcggagcggcttggatcacacagagcccgagagctaactgtgcggcgtgcaatggaggtcgaggggatagtgaagctccgaccgctatacgcatcaaggcgtggggtgccaggagcagcacttcaaccttgggtttggtttatgccgagctttacaaccaacggtccgacgttgaggttcgtagaccgcgcaaacgtccccatggaaggcgtaaagttctaaccggcggctttttagtggctacagggtattttggaaataaaagaaaatatttggaaagcaaatataagtttaagttgtaaattcaattaaaagattaaatcaaattttattcaaatggcatttgaataaattaaagaaattcaaataaaatcttaaaatagcaaatttgatatcaaaatgaatagtttgaatttatatgaatttaggtccaaatttcactggaatcggatctacggtttaggagatataggcttctaaannnnnnnnnnnnnnnnnnnnnnnnnnnnnn

SEQ ID NO: 11395 - DNA, 1254 bp, Oryza sativa
  unsure (1)..(1254): unsure at all n locations
nnnnnnnnnnnnnnnnnnnnnnnnnnnnnnnnnnnnnnnnnnnnnnnnnnnnnnnnnctagtgtacgtgaactacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggtcaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagcctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatatnnnnnnnnnnnnnnnnnnnnnnnnnnnnnnnnnnnnnnnnnnnnnnnnnnnnnnnnnnnnnn

SEQ ID NO: 11396 - DNA, 30279 bp, Oryza sativa
ctcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagcctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatattgttattctggactgtattgttattctggacctacatgtggacatcgttatgctttgaaatgtgagattgatgattgttattgttgttataatgttatgaattattgtattgatttgaactccacaatatagagtaggtcatgccgaatttttctgttgtatagccacatcttaattaactaaaatactcacattttagtttttttctattatttttttcatttttcttatttcagttccaacatatcgcggttaccgtcctcttaccgcggttaccgtaccaaaccgtgcggttaccgtgtccataccgtggattttgaattcaaaaatttggaaacgaaatttgtgcggtttttcgcggtaaccgcacggttaccgcagtaaccaccataccgcggggggtcggtaagcccccccaaaacggtaaggtgaaccctggttggaacccattagggttgcgtcgagagggggttacacgaccctaaactctatatatcagtacccgccgccatctttaagtttttgggttttgcttaaattaatctgtcgagatcatttttgccgctagatcggtttgtaagaccccaactcgtgagcttaatcattcatctgcaattttggttattttctatctcgttcttgtttgtgttcttcgattggcaaatagggattagccttctcggcgaggtcatctgtgtttcggcacgggtgataaccagaggagacgtggtgctgcgattgcggggctcaagagcgtgcgcgttcaagaagcctgatcgatttatgtcgcgactccacccaaatcgttgtttatcagaacctttcggaagatcgggaaccctagtgcacatcagctaagtggaagaagaaatagaaagcactcaattcctatacttctagtatacattcaaatcctaatttacatctgctaatttacaatcatgtggccaatatcccctcacagtgtcctcctggtactacaagggaccaccccgggttgccaagtttcttacgacaacctatcatggccgtccaaccggggctaaatacggaggagtaccctccccaggaatttgtcttcggaatatatactaatatggaggaatactcgtactgagctgtcaccatcagcagcccacctctactgtcctgaagtatatatgtccaattaatgatactaaataatctaagcaccatgctcacattattaaatactactctatacccgcgcgcccgacatagagtaactgataaatcagacattaaacccgcaccattacacttctctggggtaggctacacacacaattaacataatgcagatataaagtaaggccagtactcaaactaagtaaagtagcgaagatatataaagaagagtatttcattaaatcgtaaagtattacggaagagattacaaaagctgctagggccataccgaaaactcttccgaagactccgaggacttccgaacactattctatgctactccacttagcactatactactaatactaatttatgaagaggaattgagcttgcttgagtgtgttaagaagtgaagtgagctcctccttttatagggccggtatgacggttactctcatgcgaaatgtacattttacccttgtaactgccatcagcaacgcatcttggacgtccacgtgtaagggggaacggagccggcttgcccctggttcggcctggctccaaccgacctcccctttggtacaatggctgacacatgggtcccattgttggttttgacagttaaggctattacggacggttacacctgacatgtgggcccccttatccaattgcttgcttaggagtaaggttttctccactttctctttattttatttgataaattcctacaacatgttattctccaagtacaagtggaaatatattatttggaaataaacatgcattgtaagcatagctacttctccaatattttagttatattgacggtcgaaatttgtcggcaacaaccgtcaacagtcggcagagtggggccagaggagggtgtcgacggtcgttatcgatcagtttcgccatcaatattactgaaataaaggagaactagttatgtttgcaatgcatcttcttgttaaaataatatatattccactagcactaggattactaacctcttgcagaaaataagcataagatggaggagaaccgacatcaaaatagacgatcaatcaatcgaacgatgtcgagaatcggacttatggaaagacgggccaagaactaagaattgacacgatcgaattgggccaaaattcacaagtctgaagatagaagaggtcaaggaggaagcctgccaggaacagctccgttggatccagggctttgagggaacggtggagattcactccctatgatggttggagggtattgttggtatttgttaacgacattactagaaatatcattcccagcaatggcgcagaaatactcctggtatattatggttacagagttcatccgcaaagcgcacggatataccattgtagcatttcacccgagagtattccaagggtatcgtatttatttaatcccgtgggaagatcatagtagagagaacctgactaataatttgtatgtttgtaacatacccgaaatttcaggacttaaaatttcttgtcaaaatagttagaggttaacttctccaattttgagagccaaaaatttccgttttaatttaggtgatgaccaacttaaaccattgcatgattgaaatttgagaacaaaataaaatcttttcattcccaatattagactagaaatatcatcaagcatttgagcatgcatgtgcataatgcatgcctaggcttgagtccattgtgtatttggtttttggtatcgcttttcataataggtctcatgagcataaactaaaagggttaaaattactaaacaaaactacagttaatatagggtgataacatgtggacttaatattaaattctaatatctttttcacagcccaaaagaagtttaatgtaatccttataataatattaggtgcagttatgaagtaggaacacatatacaaagaaaggttattcttattctttaaaataatttatgcaagatgaaatcatggaaaaatttatgtaaactatgtttagcataagcaattcattataatattggtgcaacttaataactaagtttaataccacaaattaatcagtcaaagcagaaaaactaaaagaaatcaaattaaattttaatcggctaaatccatacttcatccaaaagtacatttaactgcacataagtgaacatggaaaataatttattcaaatactagattatttatcatgcctaaatattatttttctagaattttcctcctctgtttaggcttcctaaaaattcaatctacctttctaatagcccatctttgtttaatttctgtgagcaatctatccattatttttaagtgcaaccaaagaaaatgaaatctaggtgtaatcatttacctccagtaaaatcaacactaattaatttggtccacacattaagttatgaatctacaaagttaggggagagaaaataatctaaaaattgaactaaaaccgtgttcacccagaatcttacccacacctctctcttccacctagagcacttcatcctgagcccacttggcagcctctccagctcgccctttctctgtgcctcaccctcagccgaccaagaacacagagagggagagatcgagcgagccgacgcgtggccacaacgtgtcgacgacctcgggctttccttttctcgctctcttctcctccagtctgagtcgccattcctcactcatcactcagagacgaagaagccgaggggagcaggtcctctgcctctccgtcaccaggtgacctcaccaccggccatggaggtgaagaccatcgccatctccgtttgagtcaaggtcacctctatctctttcgcgttcctatctctccacacaatgccgaaccacttctctgttgaccacctcccgttttgtgcatcacagccaccggaacgtgaccacgccaacaacgccctgaagcacgcactggagcgccaccgcttcgacatcattgtcgaccggccattctcgtccatctcgaagcaagccgctgtgccaagaatctcgcctcgactacctcttcaagacgcctcgagaaccccagccggagacgtgaaggacttggagaacgcatcttttcttcccggcgtcgatctaggatcgcctccgccatcatcgtcgattaccgctgcctcggtgagccattgttcgattcctcgcgcatacaccatctccataacctcacgaacctcttggacacgcatgcatggcaggtccttgagttgttcgagccgtcgccgttcacctgaggaggagcgccgccgtcgaacctttccaaccgaaaccgctgctatccaagcttcggtgatttcttcctacagcttggtgagcctcctggacctcttaggaaacacatgcatggatgcatctagcaaaatcaaagcccgtaggcaacatgcagtaacagctcatgtataccttccgctcaccctccaatgtctcctagccaagaaaactagaggaatggaatcgtgagagcattctcttcattttatattttgacctcattcccaatcgagccaccaatcgtcgccgacgaggtcgccaaagccatggccaagctcctagtccatcgggctgctggaggttgaagatgaggactttgtcctgtaaatgataaaaaacatagggttcaaactataaaacttcagtcgtttacatgtggacccacggacctaaatgcagttcatataaagcccagggacctttttgtatattggttcagccaccgattagtggacccatgtgtataaaaatctgaaaatgcaaaggaaaaataactaaaacattaaatgtttaacaggaaaacacccaaacttctaaaatccatataaaattaaatgtaactcattttgagatgattccagttgctgtagattcttaaagttatgaactctattttagaaatataaaacttgacactcactgtacaaataatgtctctaaaatttatctaagataggtcatacataaaacatgtacaaacttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagtttagataagctaaactttagaaattcatgtagaacccaatttagcttcaatttgagtaaacttaagttctgtaggatcatcaaaacatgtatttccatgttatgaaataagattatatacttattgtgtagtaaaagtctctaaatattcatataaggatttactaacatagagcaccctttaatttgtaaaacttgtagaaaattcatttttagtccaaatgaaatgaacaaagtttctatagaaccagcaaatagttagcttcaacatagtaaaataaaatttggcacctattgtagagaacatagatcaaaaccttaacttagtgaaataagaatttaaacatatagtgttgtttaagtaatacataaacatgtataagtatatatacactttaggtctaattaaacctaaataaaaacttgattgaccagtgaagccatatatagttccatttccatccactaaaacttagaagaacttagctcatataacaatttctaggttaatataatatattgctagtttagattagagcatctctagtttataaaatatgaaccatagtaataaagaccataaacatgtgaactaaaaatgttttagttaaccaaattattccttttattcaacttaaataggaagtagcatgttctgaacctacaacttgagagtcatgcagatataaaacactatatgcctaaaacacgttgcaacttgtaaaatctataagaaaatcattataactccaaaaattgtgaaaccaaatgtgttagtcttagaaaacacatctccacacccctgtgaagtctaatataataaaaatcactttacaaaagtattttataacactacctaagactatactactataaaccgataaaacttctaaaattcataactccctaatggaataagataaaataaaatttctttcacctaaattcattttagaccagtacctaatcactgtgcattaatcatgcattttagaacattttggattttcagctcttttggtgtttaattgcataacgtgcgtgtcctttatctagataattgcataatcggtgaaggagtggattaggtgctaacatttctctgatcaaggcaagttttctcctcccatactttgaacacattgaatcccatgatttgaggaatgaaaatatttgtttgcaaagttgcatgtgaacttagactatatcggtatttgaaattgggttaaggtagttatgacctatttgctgcatatcccaccttgaataatggatcctcttgctgtttgaacccctagaaatggttagagtacactctttatgctcaaatgggtttatatatgctctttgtgcaactacttgcttagccatgcttagaactatgcaaatgctcattccatctataattaaaatgtgattttgattcatgaacctttgcttgaataaaatgaatatgatgggtatttgtgaactaaaatgtgtaaaatgtgattttatacttgggcggcaagtggtgtgcatatggtgttagttgcataccgatagggggagtgtttgcccaagtccataaggaccgaacttgtgtcacccatttaaagttactaggtgaaaccccgcgcattgctgcgggaatttagtatgataacaataaaaaattaacatgtaagatagctagataatatcagattaagtaaattaatgtggtttatgataatttaaatttaaatagtatgtagaatggtgattcaaacgtaaaaagtaaggtggtatgactttatggaagaagaaaagtagggagataatttggaccgtagattaatcatctaaaggctaaaaacaattgatgtgatatgacttaattagaggaaaaaaaggagaaagataatttggaccatagattaatcatttaagcactaactaagtgaggatgaactatataagtatataggatatcataaaacataataaagatatacattgaaacattatgtgaattatgttggataataatttaatatgtttgtatttgaaaagctcttaaattataaaaactataaagatataagcatgtttgcatgatgtttaaatgtgatgattgttaatggaagatgatgtggcatctttgcatgttaagcttaaggagttagtgggggataactttatagtaagatatgattcgtacatccacatgtgctagtatgggatggcctaagctgattaatatatttaggactagccttgcattctggtaggccggtgtgtatgaattagtcgataattctgaggaattagtcgatgattcagaggagcttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagctgtgctcgcggttctaagtagtgttctaggcatattccaagtatgcctaggatggaggaacacgtatcgtgctggtggcaaggctaggttctaagtagtgtaaaggctccgttatgacctctagatcacattcaacatgaagagtgtggtggagtccttgcaaactcaaaacaaactagagagttcatatcatgtgggtaaagctgtacaaactctgcagagttttttaaactaatcgattagtcgtgctcacggtcatgagcgctttggtgatgtgtcatgagtatagactttatgttttaaaatgtgatcatgtgacattggtttgaaattgataaatgtgttgagttgtgtgtgtgaggtgatatattatgatttgttgtcaaaggatgacaacaagagattgattatgatggaattatgatgaacttaatattgaaacttaaaatttgttttgttaattgaagcatcaactcctttacaaaagaattacgaaacaaaatttgctttatactgaaattgaactacatattgccttcctttgaatatatgccttacatgtagtatggtaggattgacttgtgcttgccagtacattaacttgtttaatgtactgactcttgctgttgatataaccttttgtttgcaggtttagacttattctttgagtgatgcgggttccgattgcttcttctaggatgagaacttaatggggtaaacccctagtcggtgtgcttgtgattgggtagtcaagcttccgctgttctctaatatgtctatttggccagtcgacctatgtaattattaagttgttgaaagtcttaagtttctttcatcgtagttgtgtttgctatgtataatcatgcttaagatgaaagtgtggatctagtgcacatcctggaaactagattcacatgagtatgagttaggaatagttgagaggttttagatctttagccatttttgtcaagtcttctgaatgtgtaacacatctggtcgccgccttcgagtggtttgacgggcacatctcaggctgaagttgactggcaggctaagggcccagcaatgtctccaatattcctctctcgaggcatcagatgtttcattatacttgtttgatgacttaaattattcacttgatctctcaaatataatggaaggaccgaagagcctacgacaatgttacttgtaataatcatagtctaagcacgggttaagataatccaagggtagagtgacacacaagcagggagctactcattctcatataaattatctaagctaagtggaaagaaaagagaaagagaatctattcctatacttctaatatacaaagtatacatacatcctaattatctgatatactagtttataccctctatccgatgccctcctggtacttcaagaagccacccctgactgccgagttccttacggcagcccgtcatgaccatacaaccggggctaaatacgaaggagtacccgtactgagttgtcaccatcagcggcccacctctcatccgcagcatataaccccaaataatgatatcccgtaatctagacaccacgcctaaactaccagatactactctaatatcatcgtcatgacatagagtaattgtataagcaaacactatacccataccgatgcatctcctagataagctagcaatataatcagtataacatgaacataatgtaaaggttgcattcatatactcggaaagtattttaataccataaatgtataaagaagagtattctaataaaagtacaatgcttataaaagagaagagaagagctactagagccatacccgaactcttccgatggcttccggaccccaatttatactctattcctattccactagcttaagaacactaaactaaacttgagagaatatgagagagctttgcttgaggcatgtctagagagtgaggaggtgaattccttttatagcctcccaatgacggttatgacagttgaaatggtcggaaatgccctctaaccatcatttgggagcaatcctggacgtccacgccaaaccctacatccaacggagcagatgggggttcggccaaaccccctggttcgaccgaaccatgtgctggtccaatccagcccattttcggctggtggcctcctggacttctcctctttgcagacatgtgaattttggcccaattcatcgtgtcaattctaagttcatggccattcatacataagtctgattctcgacatcgtccgattgatttatcgtctgatttaatgtcgattctccttcactttatgattattctctgcaaaatgttagtgaaccaaatactagtggaatattattattctaatatgaatatgcattgcaagtataactagttctcctctatttttgtaatattgacggtctaaaataatcgctaacgaccgtcaacaggtatccctatgacagttggagggtattaccgacctttccaaccgtcataaccatcattctcaagctataaaaggccctcactccctccattttaagacacacctcaagcaagaagattcatacatttctcaagtttagtatagtctctagagtatagtggaatagaaatagaatataatcttcagtccttggagtcttcgaaagagttcgggtgtggctcttatagctttttcttcttttgtcagacttgtactatttatagaatattcttctcaatatatttacggtactttacttcactctgatcatttgagtaccgactttatgaaatattattcgagttataatttcatagttagcttactcgagagatgcaatggtgtgggtataatgttcatttgtatgaatgctctaagtcaggacggtgattgtagagtagtatttggtagcataagtgaggtgcttaacctattgaatatcattatttggggttatatgctgtggatacgtcgagttgggccgctgatggtgacatctcagtatgggtattcctccgcgcatgtattaatcctaagtacaatttcctaggaagggtactcctccgtatttagccccggttggatggccaagacgggttgtcgtaagaaactctaggggtggtctctcaaaacaccaggagggcatcataagggggattttggctatgttattatatagtagataatattaactaaggttgtatgtatgtactccctccgtccgctatataagggattttgacattttgcttacactgtttaaccactcgtcttattccaaaaatttgtgcaaatataaaaaacaaaaagttgtgcttaaagtactttggataataaagtaagtcacaaataaaataaataataattccaaatttttttgaataagacgaatggtcaaacagtgcaagcaaaatatcaaaatcccttatattaggggacggagggagtatattagaagtataggaaatgattctttctttattctttccacttagtatagaattagtatgtatgagaatattgaatgcttctgcttagtgtcactctacccttttaaatttcattaacccttgtttagactttgattattacaagtaacatataaattattagtatggttttctctattataatcttcccatgggattaaacaaatataatgcccttggaatactctcgggtgaaatgctataatggtatatccgtgcgcttgcggatgaactctgtaaccataatataccaagagtatttctgcgccattgttggggattatatttctagcaatgtctttaagaaataccaccatgcatttctgacgccgttgccgaggaagattcataaaagagattaccaagactaatactttatatttacctctgtataatcaatgtcctttgcaggctaaccttggttgttttccgcttttactgtggaaatagggtagtgtatgactggtttcaaattgccgaaaaatttcatagaaaatccagaagttttctttcggagcatcaagccgcgagtcgttgcgccgtagaaaactcatccgacaaagaaaccagccattctagtgccaccaaccttcaagactacggctaacaagaccatccgcaagttcgctgctccctcagctgacaacgtggccactgggccgcaaatcaacatgggagacgtggactttgatttgaagtccagcctcatcatgatggcgtaggctagcctgttccgtggcaagccaaacgaggatgccaatgcacatctgcagcagttcctggaaatctgcagcacgtacacaatgaagggcgtcagtcctgaccccgtcaggctccgactattcccattttctctctagggaaagctaagcagtggttctatgccaaccatgatatgatcaacacctaggacaaatgctcaatggcaatcctatcaaagttcttcccaatgggcaaaaccaacgccctacgcgggagaatttcaagtttacagcagacgagagatgagtctattcccgaggcgtgggaatcactacaggagtacatggccgcctgttctcatcatgggatggacaactggctgatcctgtagaacttctataatggactcactcccacatcccgtgaccacctggacgcggcagctgcaggagctttcttttctaagacggttaaaggagccgtcgatcttatagaaaagatggtctccaatttgggctggagcgaggaacgactccggacctgttagcgaggaatgcacaccgtcaaggagatgaaaatgctcgctgcaaagctagacctctgttaacaaccaaatttggtaattcaagtatcggagatgaagataaaaccgaagcgaaatccaagatggagatcgttctggaaacagagcaagaatcggctaaagtccgaatcggctacgattagaatcggcagagttcaaatcggacaaggttagccgattaagccggttccgacaatatgactcgatacatgacatcgggttaggttaaagtgcttcacatggattgccatgcacagattgagtcctgaaaaggcaattgtatctattaattaggatattttatgtaatttccttagagatatgttcgggcaaaagtctgcagtaaagacttatggtatcttagagtttgttagaaataagagtcgtgtccgatatggacatattatgtaatctcgggtataaatagaccccgagtcccatgtaatcgataacacatgttcaataacaatctcggcgcatcgccacccttttactttcgttttgtttcgacgagttcttgctttcgggttgagctgcatcggtttcgatcttcaactagaggaaaaacttgttatggcggcctgcgttctcgggattagtgcttccatctttatgatactctaatattggctatgtaagttgtcgagttatcatatattctatataatacctgacaatattgttatctaaccttcaatcggctaacatctatcattgaaaggtagccgattaggttaagtaacaacgttggcctagattatataggatatctaccactctatgaaacatccaacggtttgattgtccagatattgttcttcttttcatacttatagctgcatccgttgagtttgaccttataagtcgtgattagaaccatgatctctagcctgcttttggttgccgattagggtagtgtcggggtttcagccgatcttacctgatttagctttatatttcatgtgcttaattgatatgctagatctgccctttatgttaagatcttactacaacaaagtatgttaggcttctgtttgatatattttacttgctttaatatcttaaaacagagtggtatcggagtattagccgatacatgctagatctatctgatcggctatgctataaacgtttataatcctattgttaatatatatttcgatgtaagtgatttatactgtctcggcatggcgaccgatctatcccaatcacttgatttaagtatatatcgacatatggattacatactgttaatatctacagccgatcgaatagatttagttctttcttacttatttatatccgtcgatcgattcaaatatgacatcggctcaaagataaatgatatgtcatcggcgattggctgatcggctatcatttatggatttaactgctattttcctgtctttatttcttgttgattgcaggatctaatcaactggcacgctcacgaacctaaaggcaagatttttggacctacactggagttaagcagatctcccaggcctcgtgtttttcgcatcaacaacctcctcatgaaacgattggccttggactttagagtaccaagctccacatatcaactttagagtaggaatcaaaaaggaaaatttggtgaggaattcatattcatacactttgagagatcaagtgaatcatttaacataagcgatgtgcttaggctattgaatatcattatttggggttatatgctgcggatacgtagaggtgggccgctgatggtgacagctcagtacgggtattccttcgcgcgtgtatataatcctaattacaatttcctggggagggtactcctccatatttagccccggttggatggtcatggcgggttgtcgtaaggaactcggcaaccaggggtggtctctcgaaacaccaggagggcatcgtaagggggttttggctatgtgattatatagtagataatattgactaaggttgtatgtatgtatattagaagtataggaaatgattctttctttattctttccacttaggctagaattagtatgtatgagaatattgaatgcttctgcttagtgtcactctacccactttgaattgcattaaccccttcttagactttgattattacaagtaacatataaattattagtatggttctctctactacaatcttcccacgggattaaacaaatacgatacccttggaatactctcaggtgaaatgctacaatggtatatccgtacgcttgcggatgaaatctgtaaccataatataccaagagtatttctatgccatagctggggattatatttctagcaatgtcgttaagaaatacaaacagaggggagccgattcagacttggtttgggggagggacagcgggcggcaggagggggagtggagcggtggccgagtgggagggggagagcgggaggaaaaatagggatagggagaataggattaggactttcccaaattggaaaataaatgtggtgccattttaggcaaagaacgaaaacggaacctgcgaacgaaaacggacacggctcatcatgcaaaacgaaaccgcggacagagagaggagtgaatcgggaacgattcacggccaaaggcgggagagaaaaattattattaactcaaatattaacaatttaaattaacaagattaaatccgatgctctgaatattccactttatgtcctgttaatgattttagagcaaagagaattcaaaaaatattctcattgacatttccggttattaaatacattgttaatttgggttttctcctggttaacgaaagcaatttctatagatgatttattggtgaactagaaactacggaaaatgggaaacttcgagtggtgacacaacatcaacctcttcgcccataacttcattatccaagaaggcatcaacctctggatcaatatcagctagctcatcatcttgtgaggttttcttcttcttggctgatggtttttgatttgttttcttgcgcttgccagtatttctcttcttgggatctctatgatcggctcagtacttgaactatctagcaaagatgttacctttggggcattgaggccaattagaggaggaagcagtttggtccctgaaagtgatagtgcggggatatatacaatcggatgattgctcacacttactatgggggcaggctattctggagctgcagtgagacatatatggtgatgaggacatcactccttcagatatacacaacaatccttcgccggtgattcaagaaccaaccacaagagctcgcgcgtgacaattgaatttagatgtgagttcgttcctatgttcttctttatatgattttgagaatagattgctacctaatgattatattatgattaggaacaatggagaggacaaggagacacttaaagagggacttagaggcgtggaggaccagcaaaggcgtccaagtcaagatggaggcccaaaccaagtcgacttcgagtacgtttcggagtccaggactagtttgctctaaaacggacgcgcaggtcatatacgtgtttggattggggcattctttatatggatggaaagctaagaatataaaatttccaatggttctggtcccatgtccaaattctttccgagtcatcgggaatcgaccgaacaaattgacgtccagaatctgtttcggtgctgcgtcgccgtattttgccctttgggccgtgcatcgtgttggagcccattagggttgcgtcaaggggtgttgcacgaccctaagactctatatattagtagccgccacaatctttaaggtttgggttttgcttaaattaatctgtcaataacagttttgccgatccttcggtttgtgagaccccaacttgtgagcttaatcattcatatgcaatttggttgtattctttcttgttcttgtttgtgttcttcgactcgcaagcagtgattagccttctcgacgaggtcaaccgggtttcgacacagttgataacaggaggagacatggtgctgcgatcgcagggctcaagagcgtgtttgttcataagtcggatcgacttgtgtcgcgactccaccaaatcgaccgtttatcataacaaaagatagggaactcttatccacatcatatggtcgggttgataaggatgaaagaagatagaactaaagagaagatggtatcaacttacattaatcctgatcttttcgtccacaatggtaaggcagaagtttgatgacatggaaaaaaaggtgtttcttccattctacccaccattgatcaaatgacggatgcctaaaaaggtgaaggtggatttcattgcaagtaccaagaacaggtccttcaagtgttaaccatttttgcatgatcagagctgatggtactgtatctctagcttgaaccatcctgatgaagtacaaactgatgggaagttgtccaagtccaaattcgaaagatgatataggatgatagaattcgaaagatggcttggcagtttttccttgagaaatatcagttgggagtatgcaaggagttatggctgctataacgttttctctggatcttgggtcaattggatctttcaagtcatttaatctcaaatcggcaaccaaaccctggcagctaaggcaaatccaccataaaatcgataaaatcaatccttgaagccatcaactgactgattctctctggaatatactatagctgcttctccaaaggacatgcttcttctagtgcttatatgttcattatcggcataatcagttggcaaagccgatagagctagtgatggactgtcaagtgccaagatggtatgcatattgatccaaagttgcaagaaccaccaaggacctccataattgatcacttcatctttcacaatgttacaagcggcagagtgaagcatctgataaactgagcaagcagatactttcccaaaggaatgtgcttcttctggaccaggaactgagcgaaatgttgatagttgactgttggcccacaagttgaaccgcagaatacatctctctccaaccacttggccaagaatgcaacatgttccctttcagaaacagatcctgtgcctttatgttttgctatgtatcctttccaacctccatggatctgttttgtcttaagagtatgatcacacttgatgtctagctgaaagggatagatggaagtcgtgatgtccaggcatattagcatcttcacatctggcagagttggggtgataggaccttgccgaaacaagtagttgagggtattcgaccagaaatatgcagcaaccgatagcattggctcattcttcttgatatcggctaaagactaggacaagcactgagctattcccatttcctcccaatgattctgtttggcagccgatactctcttacaccaggttttgtatcctttaagaggagatggccatgacctgaatgttgacttccacttgaccaaatctggattggtctgcctgtatgggatcctatttgtttcggcattgataaactctattgggtcagggttacccatcggtccaaggaaaaagtttgtgggatcttgagaagaggggatatgaatctagcctttaagatgctggtgagaagattgataaaacaaggtcaaaatgctgaaaggattaaaaacgcaagagattaaaacgcagggacatggggaaagttgatcaggaagattgttggtatttcttacgaccacagataaatccgctagcgcacggaataccgctgtagcacttcaccttcgggtgaccccacaaggatatcgaactcagggaacgtgtgtaatctatctaaggctaagacaatccaaggacaacaactatgggtaggctggctcggctagagaggaatttctatgtgttttaattatctatgctaagcaaaggtaatttcttatctgttgcttcgggcaccgacccctactggtctgctagcgcggttccggctatagctctatgatgtatccgaacgttgaggattactaggatgggattcagggctgtcgccacctgccacctacctctgacaaatccgtgagatacacaacaaacaaaggtaatctctaacctagacatcacgtgtaagttattaattagtactttaatacatgcgcacgaacttactcctctatccagagtcctagtactagagcacttagtatgaatactaaacaatgaacccgcaaagaaggaaatctatcttacttacactaagtaattaaaaaacaaagaaaggatcccgaatgcttacttaatagaagaactttctccgaatccggagcagagtataccgatagctccggtactcctccagaactcctcctaaaaagctaaactcgtcgaggtagaagtcggatgagcgccaatcttccgggcactcctccagagcttcccctcactctccacctatttctaatgtacaaaagatacaatagagcatcttgtaattcagctcaaagttgtgtgtgagtgaagtgagggagaggagctctatttatagcctccatatgacggttacagctatgagaaacgaccaaaacgccctcaaccgtcattgggaatgcatcagtagcgtacacgtggaaggctaggatcaaaggagccggtggcggttcggccgaaccccctagttcggccgaaccctgggccccacctcctggcctctcctttggccaggagactgactggtgggcacttatggcaattatggtagttatgacctgttccatggcggttccacctaatttgtgggccctccaatccgtgtgcttgcgtttgattggccaaaggtgtgtttcctcgtatgacaggtgtgttttctccttaaaatacctgcatacacatatttcaccaacactagtggaattgattagtaataatccctatcactaagttggataccatgttttatttcattatatgcaggtattgacggtcaaatattatgatttaaggaccgtcaacaaagattgataaatatacctcaaggattggtaccgtgtgcgccatttatgcgaatctgcgcaggctgcttgtgaacagaggaatctgctaccggagagctggatcgccggagaaggttgccggaggattagggatttctacaatgaagagcttgtcgaggacatagccggacaaaggtgttttgaaggaatgggcctctacttatgagctaaaagttaaaacagaaaaccctaaatttttgcgggttcaacaagagcaaattccactgtattatataatacatgcctgctgggggaatgtatagtatcccccgaaattttgcattagattcggagaaaaagaagaaagatcaaagcggatttggtgtggaatcaagttgatttccaagtcggactgtgcatcgactgagtatcgtatcggctgaaaaccggacagaggcttgacttgatcaatatggcaagcagccgatatagtataacttgggctcgatatgggcctaaattaagataaccgtcactgtcaattagagatagagctcgaataaggcaattgtatctattaattaggatatttaagtcgattttgctagatttggcaagatacccccatatatggtcttgtttgtatgttatctttaggaaagtttgaattgtgaccataatggactaagtttgtactcggggtataaataagaaccctataccactgtaatacgggagacaatccaatacaactttggtgcatcacaacccttttttttcttcttttcggcaagttctctcgataagaggtaacccgtctcgatggtgtgtgccagggttgacgttaccactggtaaccgtgcggttaccaggcttaccgcgggggtacggtaatataaataccatggtaacctccttaaattcaaataaatttaaaaaataatttgaatttttgataaattttgcatggttttgtacggtttttcacggttactgcggtaaccgtgcttaccgccggggcgcggtaaccccggcctcggcggtttgggaaacactggtgtgtgctatctgggctatcatgtcgttttatatgttttagtccttttatcatgaccatctgttatcatatatgtcttagttaatctagccctagtatctcaatttagccctatcggctggttctcgttttagggttcctgctggtatcggctaaattgccttactagattagattaactaaggcatctaccatcttgaaaagctgttaattccttgattgcttagactttaggtttctctacttactttgagatgcatcatccctagtcttgtttagaaccctgaaaactaacctggaattaatcataattagagaaagtatcggagttttagccgatcttacctaatatacatgcttcttttctggttttatgtatatttgccacttatatagacagatcatcctatataatcgtatcaagtttgatcagtatcgtctcggctatttgaatttctaactgatcatgatttgatatgctcatatagattgatttgtttatataagtttgtactagagtattagctactactttatcgttatctacatattcagctctaaatatttttccattggctattttcataatattgtcttaaatcttctttcttaaacctaataggcagtgttacagccgatgaggcatgtttagggtcttttattccctgatctatcccgtccatagccgatttggtctaactacatcggctgagaccaccaatgatacgctatcggccatcgactgactaattatgcttttgtctttcttgttgattgcatgatcaaatcagctggcacgcctttgacacactcgaggctatccttggacctgcactggagttaagtagatctcccagtgtaacgccccgattttcgttcgggattaaaaatcatttaatatattcatagcatagccgatcagatagatctagcatgtatcggttaatactccgatactactttatataaagatgttaaagcaagtagaatataccaaacagaagcccaatatacttaaatgcaacaaaatcttaatgtaaagggcagatttaacatatcgatcaatgtgggacacccaatttaggcttggtgccccgaaaatccactcgtgatcgtctaggatttcgatcacgtacaaattgatatacagaacagctttcgattaattatacaaatttggttatacaagctaattatacaattgttaaaaggtgaaaagatccaaactaatatatccttatttgaaatacaagaaaatccatagtactaaactactaaactcctaagctcttcaactactaaaactacagccaataaactgcaaagaattcaaagaactccataggcaaaagctcgagtgtagactagtctagacaaacttgtcgatgccgtagatctcgcttccttctaatctccttgttagcatgttttctctatatgtcaaattatgcaagggtgagtacttatgtactcagcaagacatattataaataattaaatgtgaagagatatgaataaataaaacaataataaagtaaaggaataataaaaaccataaatcatctttatcctcaacattttaattttaaaaatacttatacttcaggagtaggaatcaccctgatgacacaactccagaaccgggagtacggcacattcgaatgatttaattcacctctgcagagactgtccagttttaaccgcacgatgcccacagctagctaggctgagaacaacagagccgtttgaaggtcccacttactactagtaagtctaggtctgtccccattctagaagctgcggtcgtactcgttcgtttgacataagtacttggtaaacttatatcgaccaagacagtactagccacccggaaatcaaccaattcctgcgtactgtcccaatctaagttcattgtatttttatgcagtctaactaggcagggctaagcaaaagctagcatataactggtttgctatatgttcagattatgcattcaaaatcatgaatggctaatgcatagaatagaatgtagaatataggataattatgctcaaaggggaggaataataacttgccttgctccaacgcaaataaatacgagataggcaacctgattatccgattctcgaaataccataggttgccatccaaaagacaataaactctactgagaaagaggaagaaccaaatttaataaaagccataaaataataagaaaacgataaacggctaaaagggctagggtttaaggtataacctatctcttttatagggtatagggattatggggctagtatttgctagcggtaggtttaggtagtataatagctagggttcagttatatgggagttgattgtggagtaggatagtatattggttaggctctatattttatgtggaggctctcgtggtttggacgataggaaatatactagatagttgatatggttaaataggcatgtggctaatatgggtccaggttggctttgatagaatagtggttaggatttagttgtttaggccgatatcgaggtaggataaatatcggctagggttttaggtgtttgctagtcgtcgctagagttggacatcatgacgactaggtttagtatcatttctagccgtgtcgatagacaacatatcggctagaagaataggaggtgggtgcaggtttagtggggcggaagtgttactccgacaaccgtgagtggcggcggagcggcttggatcacacagagcccgagagctaactgtgcggcgtgcaatggaggtcgaggggatagtgaagctccgaccgctatacgcatcaaggcgtggggtgccaggagcagcacttcaaccttgggtttggtttatgccgagctttacaaccaacggtccgacgttgaggttcgtagaccgcgcaaacgtccccatggaaggcgtaaagttctaaccggcggctttttagtggctacagggtattttggaaataaaagaaaatatttggaaagcaaatataagtttaagttgtaaattcaattaaaagattaaatcaaattttattcaaatggcatttgaataaattaaagaaattcaaataaaatcttaaaatagcaaatttgatatcaaaatgaatagtttgaatttatatgaatttaggtccaaatttcactggaatcggatctacggtttaggagatataggcttctaaaaattgggatttgaattaaatctaaaaaatacaaaaagttactgttgatgggcccacctgtcaatctccttttctttttctctctccttctctcgtcgtcgtcttcttctcttctctgttccagagagagagagccgagagaagagagaggagaaggcgagcggggcggcggctctccggtggctggagggcggcgacgtcggcgtccacgcgtgttcccgagcaagacatacccggggagggcggtggctggcggagagagtgaaggagttggccggaacggcgcagtcaagagcttgtcttcggcggcaaagagaggtggcggtggtggttgctatggggtgggggagaaggggaaaacgggaaaaatggaatcaactcgtcgaggcgaactcgatggcgcgatggtttggcttgcgaagctccggtgagggagatcgggtggtggcggccatggggaggagagagaactggaactcgattttgtatggaatagaggaggggtggccggctatttataggggtgagaggcggtggtgagaggcggttcggaggaggagatcgagaagacacggcgacggtagcgtgaagaaaagaatgacggcggccggcttcgtttgcttagcggcgacggaagaggagttggcggcggcatgcgccgtgcacggcacgcgcaccaggaggaggaggcggctcggctggtggtgtgggctggtttgggccggcttggcttagctgggccggcagcccaagaaggaggaggaaaatagaaaataaaagaaaagggattgggccaaaagaaagaaagaatggagtttcggcccgatgacaaaaagaaagaagtctaatctgaatacttgatttggataactaggttttgcaaaggatttgaattcggagagaattcacaaaagagatttcttaagttatttgagtgcaatatttacagatggagtttgaggaaatttatttggaagcactcaaataggaagggaaattaataatattcctcaaatatttttggaatatagaagggaattagttgaaggcaataaataggatttgaactctaaaattggtattatgtatatttgtggctaaaaggggaaattgagtgaagaatataaattggaattttcttagcacaagagctattattcataatatttgtaataatacaattcttatgccgaagaggaaaatcaagccacaacgattaaattggtggctagatcaaaaggaggaaaatggatatttggatcgagaatcaaaggatgggtttaagatcaaaggatggattagcaattaattccaatgagattggaattactttggtctaggttcaaggacgaaattggaggatttcttggaccataattcataatagtaaaaatggttttcaaactaaatttgaataaaagagttttaatcgaaagaaggtttaatattcgaaaatagaattccaacaagaaataccaaatatgtttttaaatgaaaaacacaaaagggattaaataccagagaggttttatgcaagttaattttaggaagtcccgctaagtatattttcctaggtttaaaaggttattaagaacataagaatcagcatgatgcaagattagaaaatgacatattttcaggatgttacagcaaggtatctatatcgtcacactttcatgaatcccactgttgtgaaacactgctgcccaaactccttacgcaagttcaccccaaaaccgctcatagagccacccaacagtctttcatatagtgggacaatgtactaggctaagttacttgatcgtgcggatggacgcaactatgtcatttcccatgggataagggggtaattataatccggttaaaccacccaaaactttccaaactccccacaccaacatcacaaacttcatcattcatcaacattcataatcacaactcaataatgcccattttaaccggattcctaagtttgtaaagatatttaaataataaaccacataaaatgatgtccaatgcatctttctatgatttcatgtggcagtgctcggaagcattaataattaccacaatgttattctgaagtataacatctacccatgagatgttaaaagagtaattatcatgcatcaaatttaaatatgaagattatctccaaggtttctatatgattaaaatttttagttatgtcttgccttgcgccttaagattccccggcggtttcagcgtgccattctggggtccaccggtccagttccttggatgtcgacaggacttggtggtacggtcctaacggtaccgaatacgaaaacctaggcaaataaaagccctattaagcaaatggctaccaagaaacgataaagccaaggaataaaattggagcgaggcgagaggacaagggaatgggtttaaaataagttttaatttgaaaaataaagagaggtgttctacaggttggagattgaataaaatcaaataaagaataaatttggataggtggggtctattggtggattggtttctagtcggtgctagaatagggcagcacgacggctagatatgtggagttggttagccgatgctaagatgggtagcatacagctaaatgtttggctcgtctagtcgatgctacagttaagcagcacaacggctagagtcgggaaaatttgtgggggtttgcaagatggaaagtgttactccattgccgtgagtggcagcagagcggctaggatcgcatagagctcggaagctagtgtgctgtggaggtcgagggagaagtgaagctccgaccactatacgcgtcgaggcgtggggtgcgaagagcaacacttcgaccttaggattagattataccgggttttatgaccaacggtttgacgtcggggtttgagaccacacgaacgtctccatggaaggcgtaaagtttccacagcagttttttggtggctaaaggatggtatatgagtggtttaaaaagaagtattttaaataaatcaaaggaatttaaattcaaaaaggggttttaaataaattgaaaaaataaaatttaaaatggtattttaaaagaaataaagaaaaggtaattaaataaataaaagatatttaaagaaattaaaagataatttaatttaaaagtttttttaaataaagcaataaatttaaaattaaagggatttaagataaataaaataggtttaaattaaaaaatatttaaataaataaatttaaataaaattttaaaataggaaatttggtatcaaaagagagggtttgaaattagatgaatttagatcaaaagttttctggaattggatcatcggttggtgagatatggatgtctaaagtttgaaattgaataaaaagaaaaaggattactttataaaaggtgggggccactgtcatagcctcttctccttcttctacctcttcttcttctgttcctgtttttgccgaacaggtagagaggagagggaggaggggcgctagagctccggtggctggggatcggcgacgttggcggcaacgtgtgttcccggacgacgcgcatctggcaaggatggtggccggcagaggtagatgaggagttagccggaacggcgagcacaattgcatgaaccggagagagagagagaaagctccggtgaggctcgattcgaaaggaaaaagaagggggaaaggggtaaaatgggttcaccagagggaggcaaagccgatggtgcaaggaaactaggagggaagctataggggaggagatcgaccgatggcggcgtcggccggacttggcaggagagagagagctcgaggagctcggctatggggaaggaaacggggtctcactggctatatataggccaggagaggcggtggagtaggtcggttccaatggagaatagcgaaggatgcacggcaacggcgacgtggggaaaaagaagtacggcgccggctctgtccgttgattggccggtgatggcggttcggctcggcggcgtgacgtcgcagctgacgttggtgatagatccttcgcgtcgacggcaagacaacggcagcggcgcaaagctgcgggcgacggcagcacaaagccacggcgacggtggcggcggtgtgccacgcgcgcccacagagaagagaaaggagccggcttagctggggctgggtcggcttgggctgaggagggagatgggccgaggggagaagaaaaaggaatttcggcccgatttgaataggaacctttgggaatttttgtgtagaggattttaaatggaatttaaaggagatgaaatctataagaagaatgtttgtggactttttgaatttgactagaattcaaaggggaaaaaattctaaaggaagatatttgtgaaccttttgaactttggacaaggaatttaaatagagttaaaggaattttaaactagaggaattttgaaaggcagggttttaaataaattaataaattttaaaggagataaaatttaaaagaggaatgtttaagggtctcttaaactttataaaaggatttgaaataataaagggttttgaaaaagttcaaaagaaaggagttaaaatacttataaaataaaatccagatattattttttgagatataatttgaaaaggataaacattaagatgctccaattttaaaagaattcaataagaaccaaatataaaacttatcacaaagatttttctttaaaaattaaattaatcaaatgggaaggaaaggaaataatttaatttctaactttggataaatttgggatggtggcaaaaatagatggaggtaaataactaggattttagcctccaaaatatgtggtatggattctcggtgaattatttgtggctaaaggaagttggattttgagtagaagggattggaaataagtttcttagcacaagagcaatcattcaaatatttgtgataatattattctttgtgccaagaatgtgatcaagttataggaatcgaattggtgcatggatcaaaataggaacttaaccacgggatattttggaccgattaaaaggagacaaatgtttttggggataggtttagataggggttgatccaaaataaattccaacggaaagggagttatactggtttagccccaaagataaaaatggttattaggatataacagagaatcgggtcaatcggggaaatattggcctaagctaaatagtagactttgaaatcttgaatggataatttagatgaacgagatttcaaaggggaaatatttgtgggagtatagaactggattcggaagtatatgtggatgggaatctttataggaacgaaattggtggtatgttgataaactctaaaggatgggtatgttgactcaaaggggaattgaaaaggatattttatggactatgggaatatttaggtggagatccaaaggaaaggtattggttctgggggaaaaaataagaattggtatttcatgtgttcgggtagagatcaaaggggaagtatttgatggaagataaaaatggatttggtggtagtatggtaagctctagagagattgatattttatgtgctcaagagatggttgaatgggaattgaaagggtattggttcgaggtgttcgggaatggattccaaggaaatataatttagagccaaagttagagattacagaaaataaatggaaaggttttataaaatttaaaagagagcgattaactttgcaaataaagtttaaatccaagttaaaagaaattaacagaaggcaagatcacttcagaagaatcgagaagagtgcaactaaaatatttcgcaaaaatttttcccaaaattttgagtccgttacaatcaagcatgtaagataaaagaagttagatcaggtaagatcggctgaaagtccgatactactctaatcggcaaccagaaagcagactagggattgaa

SEQ ID NO: 11397 - DNA, 498 bp, Oryza sativa
  unsure (1)..(498): unsure at all n locations
ctttccaaactccccacaccaacatcacaaacttcatcattcatcaacattcataatcacaactcaataatgcccattttaaccggattcctaagtttgtaaagatatttaaataataaaccacataaaatgatgtccaatgcatctttctatgatttcatgtggcagtgctcggaagcattaataattaccacaatgttattctgaagtataacatctacccatgagatgttaaaagagtaattatcatgcatcaaatttaaatatgaagattatctcaaggtttctatatgattaaaattttagttatgtcttgccttgcgccttaagatttcccgcggcttcagcgtagccatctgggtccacgtcagttccttggatgtcgacaggacttgttgtacggtctaacgtacgaatacgaaaacatagcaaatnnnnnnnnnnnnnnnnnnnnnnnnnnnnnnnnnnnnnnnnnnnnnnnnnnnnnnnnnnnnnnnn

SEQ ID NO: 11398 - DNA, 720 bp, Oryza sativa
  unsure (1)..(720): unsure at all n locations
nnnnnnnnnnnnnnnnnnnnnnnnnnnnnnnnnnnnnnnnnnnnnnnnnnnnnnnnnnnnctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatacgtagcaaaggaatagcaaatgctcaaatcagataatgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttcttttttttttccttttcttttctgatttttttttggtgcggctttttttttcttttttttttgcacctttcttgccttttttttctcacttttttttttaatttttttaacaaaaactgacttaaggaccttaatgtaagaatacagggacctcaacataaatattaaatttat

SEQ ID NO: 11399 - DNA, 607 bp, Oryza sativa
  unsure (1)..(607): unsure at all n locations
nnnnnnnnnnnnnnnnnnnnnnnnnnnnnnnnnnnnnnnnnnnnnnnnnnnnnnnnnnncaatgcccgcctggttgattttcagtccacactggagcttgctggtcgttggggaggtggagaagtggcatcagctgacggcatgcgctttgtcacaccagtgaagaccatcaactcaggatctaacagaaaatattttggttctggacgaggcatcacctggtataacttcgtatctgatcagtactctgggttccatggcattgtggtacccggtacattacgggattcgatttttgtactggaaggacttcttgagcagcagacagggctgaatccagttgaaatcatgacagacactgcgggtagcagcgatattattttcggtctgttctggctactggggtatcagttttccccccggcttgccgatgcaggtgaggcggtgttctggcgggtgaataaatcggcaaactacggagtactggataagttggcccgaggatatgcagatctgtcaaaagcggagagtcagtgggatgagatgatgcgaaccgctggttcgctgaagttgggtacaattcatgcgtcagaactcattcgctctt

SEQ ID NO: 11400 - DNA, 631 bp, Oryza sativa
  unsure (1)..(631): unsure at all n locations
nnnnnnnnnnnnnnnnnnnnnnnnnnnnnnnnnnnnnnnnnnnnnnnnnnnnnnnnnatccgagctaagatgaataagttatgaatttttaaagattaaatcggattaaatcatttatatagattttaattgaattatgatgcaataatgaataattttttaaaaggaaaaggggattattgcgtcagtggctcgggttcacggtggaccgggtgcacagcggcggtctacggaaacgaacggccgggatcaaccctatccaaaacagacggccgagatctaatcggtctaccgcggctcacgggaaacgacgacgatgacgtcggcgatgacgtcaccaccggcggcggctcgggcgcgcatgctcgccggcgaacaacggcgcggtggcgcaaacggagggcctctatgcgtagtggacgatgcagcgatccttaccgaggcacgaacggcggcggacggcgacgaggaaaaagcggcggcgacggtcggcttgacaacgacggcggtcttcccgcgatcctcggcgacgacggaggggtggacgaggacggcgacgggttggtgaacccgcgttgtccttcccaagcgacgatgacgacccgagcgacggcgtcgcacggctggactt

SEQ ID NO: 11401 - DNA, 850 bp, Oryza sativa
  unsure (1)..(850): unsure at all n locations
nnnnnnnnnnnnnnnnnnnnnnnnnnnnnnnnnnnnnnnnnnnnnnnnnnnnnnnnnnnnagaagaagatactacaagcaaagcattggctcctttatctgatgacgtgaagaaaactcaaggaagtattttggatcggctagaggcatcatcactagacagcttagtagttgactgtggctcaatcaggctcggctgcatgagattcaagccttaatcccggatgagttagccgacatccttactccagctgtttaccttgagcaacaccaattcaagctggagaaagccaagttaagattagtcgaacggcgagaatgtaagaacattgaagccactatccaagccagccgacaacttgtgcatgaagagaaatccaagcttgaccaattatctgaaggcccaatcaagtctaacattgatcggcttgaggctcacaagattgacctcttagcacaacttgaagaatgtaacgccgagctggatatggagcgcaagaagctagccgatctccccaagtctattgaagaacagaaagcaagacttaaatcggctatcaagcatgttgctgaactgaccaagtccctaaaagttatccctcgaaccgatgctcaagatgcccaagccatagaagaagtagagcagattaggcagaaggctatttcggccatctagcgatacttatctcagtagtctttatgtaataatacttaagacttttgtaatcggctaaaacattctgatactttattgtcttaacaaccctttgcgccgattaatatgactttgaaatttgctcaaaaaattttggtactgcatactgcattttggatatatatatgccccccta

SEQ ID NO: 11402 - DNA, 595 bp, Oryza sativa
  unsure (1)..(595): unsure at all n locations
nnnnnnnnnnnnnnnnnnnnnnnnnnnnnnnnnnnnnnnnnnnnnnnnnnnnnnncgtccaatgaagttccaaagctgtatcaaagaataatatcatttactttagttgtctgtttctagtgataggcttttcactttttgttgaagtggcagggttgtgttgcatgtgcgataaatttttgcatgcttgtcaatgaagttccaaagctgtatcggaaaaaaaaaacatcatctattttagctgactttttcctgatacataactgacatgtgatctgtgtcagtgtccaatgatgtagctgcaactactttatgctgcacccgacttatatatatatttggttatatatgactatgacagttattgctgatggtttctcaacctttccaggtttcattcatgccgcattcacattagggtatgaagcagggatccataagggtgggattgatggaaatctagttccacctggtgctcttatcactatcgtgcagaaaggcctccaatacatagaactagaagcaaatacggatgaagtaagtttgtttgacttctagtgttcattaccttttctgatgcatgctacatcatgct

SEQ ID NO: 11403 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnnnnnnnnnaatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagatgaagccccgctaggatcgcccttttccgctgctgctgctttcgtttcggtgcgaggactaagtgcctcttttgtaagtattttacgctttatttacgtttggaactgtatattacttggtcgtttgtgtaccctggctggtcctggacagtgatttaatacacaaaatagtctagaaatttggactaaatttctgggcgtgacagtattccaagggtatcgtatttatttaatcctgcgggaagattataacagagagaactatactaataatttatatattacttgtaataatcaaagtataagcaggggttaagattataaatagggtagaatgacacacagcaagagaattatatactctcataataaattatctaagctaagtggg

SEQ ID NO: 11404 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnnnnnnnnnnnnnngctgtggtgatctgattgttgggtgtgacccctaggaggcacattagtagtgccttggcctccttgaccatcgtcgtcgccgtcatctgtttcagttcttgagctactatcattggactcttggtactctgggcttccttgggtctcttcatcgctatcaacactagtcgatcgtggacccttgccctttacctttttagatggacgtgcttttggcggctttcgagtcttccttttcccaatatgagtgtcacctacattcgtatcagcccactcagcaatactagaagctcccgtggtccttcgcaggtcatccaagttgactaggtcagacacaagttgactaggcaggggagcgtcactctcagctgaatcttcatctagttcggggcaagcattagagcgagcattgtccatccaggcactgatatgattgttagtttcatagaatgagaggtccgctaatctttgaaggggatcatcgtcctccaccctaatttgggcatttgcttgctgaattcgaaggcgaaggttgtagttcacgtacactagcttgttgagcttcttgtgggtaagtctattacggaccttcgtatgtacgaatgcgaatgtgctccaattcctttcacatccactagaggagcaacattgaccaaccaaacgcaacgcaagcttg

SEQ ID NO: 11405 - DNA, 1365 bp, Oryza sativa
  unsure (1)..(1365): unsure at all n locations
nnnnnnnnnnnnnnnnnnnnnnnnnnnnnnnnnnnnnnnnnnnnnnnnnnnnnnnnnnnnnnnnatagtctcatttgcataaatagcatttaataaatatttcagaatttaataaaacagtcagagtattaaattaaacaatattaatccaacgctatacaacataccctgttgcataggcccaaccattctgaacaaccaacctcggctgcacagttctatctccaagccaggaatataccattccaaaccaggagttaaacaagttattaaacagcatcatttaatatggtaagaagtgtgagactaatcacgaaagacattgttagacccgaccataaccgcgggcacggctattcgaatagttttaactctagccagaggtgtaccactgtacccacaagacacaacctcaacatcatgtcaaccaagcgtcgcgatacttaacaagtacccgaatagagattgtgacaataccctctatataatacaatttaaagcagtgcaccgttcctggatcataatcacccccttataaacaaggcatggactccccagcgacccccgtgggcttatctccaccacttcacagcctggtgctctacaatgaaccatactatacagaaagtaaagccgttgctcacgctggcttgtggttggcatggttaatgtttcacaaccgaaaatcgtgaaccggtccttatttttcatgagcacgaccatcaaaaccatgtgctcacaacccaccattatcaggttttagttggcaaattaattaattaaccaatcacgattaaccatcgtgagctatcattaagccatcattaaataatagtgaatcataagttatcctaatagtgtgctaatgtttctaagcatggctaagcaattatgtctaatatctagctgaaccaatatataaagctcaactagtcaaattataataacccaaagtattaaggaatagagtaatcaagaacaaaagggctataacaaggcaataggttatttccacccaatgacattcaaaaataaatgcaatagttgaatagaaacaataactttaaacgggatcaacatgctcaaaggattgtttggaatctgtgtgacttgccttgctcgccttggaattcctcaaagtcttctcctgcaaaatcggactctccgggaacatcggaatctaaagagaaaagagcaaaaacactaaaacagcacataaacaagcataaaaagtacatgtggatatttttaacatgtagatctcaattttagaaaaatttagagacttgaaccaactaaatnnnnnnnnnnnnnnnnnnnnnnnnnnnnnnnnnnnnnnnnnnnnnnnnnnnnnnnnnnnnnnnn

SEQ ID NO: 11406 - DNA, 1969 bp, Oryza sativa
attatctctaacaaactttaagataccataagtcattacggcagacttttgccccacacttatctataaggaatttacataaaatatcctaattaatagatacaattgccttcccaggactctatccatgcgtggcaatcatcttgaagtacattaaattgaacccgatgtcgcgtacaagtcgtattgtcggaatcggctacatcgacttacccaacacgactcatacccagccgatcttatcgtagccgatctggattttagccgattcctgctctgctttcaaacccgatttccgcttccgactttgcttcgatctactcttctctcccgacgctgatgttaccaaattcggttgttaacacatgccccccaagtccggaatatttggtaatgtttcggatttgctgtaaatcgactccgagcaagtttcgcactttaccgttttccgaccgttactgccgtgctttaaatactaaccgtcacccccgagaaacctcacaccgtgacacccgttttcaccgctcaagcagaacttattccccttccttctccggcgactcttccgacgcaaaggcgattcccaggcaacctctccttcgacgagatctccgcccgcggccatgtcatcctccgccagcccgtctggtgcgccaatagccgagtacgccgaggtaagttctcatcggctaaatcccctttccttagcaatagattgattttctctcatctcatacctcccctctcttttcgattgctttggattcgtaacatctttcccaccaagtcgcaattccaagcctttcacaccagaaccactacttccttggcccaatcggcaatctcgaccccaccgatttcatcactggtgagaccaaccggattccctttaggctatccaaccctaacctaggtcattggaagaacacctttaaatcctggccatctctcgaaaaacccacacccgacaggagttggtccacttggtatcaacgtgtatcggctagtaagaaagttcactgggatgagattggaatcggccaagcactagccctcaccatagccaattctgccaaagacgaacctctgatggctgccgccacctacttctggtcaaacaccatcaacgctttcctgttcaaccaagggccgatgactccaaccttaattgacatcactatgatcaccggactagatgtaacttcatcggccaaccccatgagcatgaataccaagaaccaattcgatttcaaaaccaagagcataggttgttggtccggctatgtggcagcatatatgggtcaaggatccgttacccctcgagagcacgtagcctttttgctcatgtggctggaaaagttccttttctgtggatccagttgtggccctacaaccaactggcagttcgtagccgaagccctggagtcaaagaaagaattccctttgggcaaaatccttctcggctatctgtaccagatgttgaacaacacatcggctagaatagccgtcggctcggcagttggagcaggtggaccctggtggctactgcaaacttggttaaacctgatggttatgaaggttgtcaatcggccttctgtaacagaagctgagttcccactgccagagccgattgtgggtgacgacggagaagaatgtactcatcgcaggtgcacatgatatggggaatatgcatccacaccaaccgatgctggagcaaagttatcggctgagctgcttaaggactggttctgcagcttctatgagggctttaagaaagatacccggatctggttcccttatgaagaatcagcagacctcgaacttccatcagattttagattcgaagatattaaccatgagatccagaaatccagagaagttttatagccgcaatcagcccttgcattcttcctgtcggcattcaccaagggagaaacatccaagtctcctacgagttttatcacccaat

SEQ ID NO: 11407 - DNA, 4410 bp, Oryza sativa
  unsure (1)..(4410): unsure at all n locations
nnnnnnnnnnnnnnnnnnnnnnnnnnnnnnnnnnnnnnnnnnnnnnnnnnnnnnnnnnnnnnntggggtgaatagaagctacatctgtttcatcaatcagccacgatgtatatgacagatctgtcccccgacgtcataccctaggtaaacattgttactatcaaattgcgtagtcaattaatcgatttattacttaaccaatcttttgctcctgctttgcagacaacagagtcctcccctcctcaccaaagcaatagtggcaagaacattgagtatgcttcgggcttaattccaaatggaggtgggctatctccccctgttattggctactatgcccccaagacctcaactctccttcacggcctaactagagaaccagccgatgcaggcccaaaaaggaaaaccagatcctcggctgtgagcacttcaatcttggctccaaagaaaaaggccaagttcaagaaaaccaaaccgactgacaagccggccgatgatctgcccaccttggatccatctattgaacaagccttagatgaagagataattgaagacgaagttgatcaggccgcagctgaagtaagcgatactgaaagaacaccatcggcttcgcctaagcaaacccttccaactccttctgccccagtccacttctcaagggtaagtgtttctcgttaatccttttagtgattattttgtcttatagccgatcattcccaagtcttataattgcagaaaaagaagactgcggtgaagaagaaatcggctgcaacaacatctaaaccagctccaccagtaagatagatttaactttcattagttaatttttagccgattctatctgacacttgtctccctttcagccttcacctcctccttctccttttattcaacaatcatcaagtgatcagaccccttcagctgcagggagtcatcacgtcgaggaagaagaacaaccaactgctcctgctatcttagtaagtttcttttatcacaacaggcattcaaatcggctataatcgtttaacctctaatctgcttctaaattgttattgcaggcattggccgatcttttctctttcaatatcagagactatcttgatgaaggagaagaagatactacaagcaaagcattggctcctttatctgatgacgtgaagaaaactcaaggaagtattttggatcggctagaggcatcatcactagacagcttagtagttgactgtggctcaatcaggctcggctgcatgagattcaagccttaatcccggatgagttagccgacatccttactccagctgtttaccttgagcaacaccaattcaagctggagaaagccaagttaagattagtcgaacggcgagaatgtaagaacattgaagccactatccaagccagccgacaacttgtgcatgaagagaaatccaagcttgaccaattatctgaaggcccaatcaagtctaacattgatcggcttgaggctcacaagattgacctcttagcacaacttgaagaatgtaacgccgagctggatatggagcgcaagaagctagccgatctccccaagtctattgaagaacagaaagcaagacttaaatcggctatcaagcatgttgctgaactgaccaagtccctaaaagttatccctcgaaccgatgctcaagatgcccaagccatagaagaagtagagcagattaggcagaaggctatttcggccatctagcgatacttatctcagtagtctttatgtaataatacttaagacttttgtaatcggctaaaacattctgatactttattgtcttaacaaccctttgcgccgattaatatgactttgaaatttgctcaaaaaattttgtactgcatactgcattttgatatatatatgcccccctagttttacaatgtcaagagcattgataaaattataaaacagctaagggcgatataacaatatcggccattttacatcggcaaaccacaaccgattacattataaaaaaaactaagggcgatataacaatatcggccattgtacatcggcaaaccacaaccgattacattataaaaacaactaagggcgatataacaatatcggccatctcaaggcgatgtaaacacatcggctgtcacgcatcggcagtagtagccgatcatgcgttaacccacacacttgggtaatatttcttcaagtatttgccattgagcgctcgcccgtaaacttcaccatcaagcccttgcaacatatatgcccccttagacacaaacttatgaatttggaacggtccctcccaattcggcaaccacttgctaaatttactatcatgagtaccaatcggcaaaatcagcttccatacaagttcaccttccgaaaaatctttaggtacaactttcttattataatgccgagcaacacgttccttatccttagtaaccttcgcaagggctcgcaatcgtgactgaaccaaatcctccctctcatcagccataagattgtaatactcatctgctgtgaaatcgttttgcaactccgttcgtcgagagccgattctaacttcccatggtaaaacagcctcatgtccataaacaggtttgtaaggaggaacttggatcgatccatgacaagccatcctataagaccataatgcttcggccaatcgagtatgccattgccgaggataatcagaaatcttccgcttgatcaacttaatcaaactcttattagatgcctcggcttgcccattagcttgtgcataataaggtgaagaattcaacaacttgatacccacgctatcggcaaactgaataaactcatcggacacgaagattgaaccttgatccatagtgatagtttgaggaagaccaaatcgatagattatatgctcttgaacaaattgaatagcatcccccgaatcaactttcttcaaaggaatcgcttctacccacttggtgaaataatcagttgccaccaatataaatttatgccctttactcgatggtgggtttatcataccgataatgtcaatcccctaacctctaaattgccatggtttaataataggattcatagccgacgccggtgctcgctgaattgctccaaacttctgacaatcctgacaccccttataatatctgaataaatcttccagcattgtcggccaaaagtaccctgcacgccgaagcaaccacttcatcttgtgagccgattgatgagtaccacagatcccttcatgaacttcaccgattgcaaccttggcctgatcggcactcaagcacttaagtaataccccatcaatcgtccgataataaagctcatcatccaacagtgtatagttcaatgccttatatcgtaatttcctagaagccgattgagatggattactcaaatactgatgcacatcatacctccaatcatcggctgacattgctgcaatctcaactttaacatctttgatcatcggcttataccccgatgccccttgggccaaatcattagcttcaagattttgttctcgagatacatgcttcaaagtaaccagccaaaactctttcattagttccaggcacttctcattataaaccatcaatgtatcattcttgcattcatattctccagccaattggctgattactagataagaatcccccatgatttcaatagtatcgtgatatgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaactgatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacgnnnnnnnnnnnnnnnnnnnnnnnnnnnnnnnnnnnnnnnnnnnnnnnnnnnnnnnnnnnnnn

SEQ ID NO: 11408 - DNA, 4544 bp, Oryza sativa
acggatacatccgttgctcacatcatggatgaacaacaagatatcaagttcgagtttttcaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgtttttgtaccacagtcgtcgctgccaccgtgtctctgttgttgtcgggacctacgaaaacggaatcggctcgctgccacggttctatttttgtagttttcagaagtttctgtcggttagttttggagttattgagttgcatctagagtttgccgatccttgtgtgtgtttgttttggccgtgcctgtgtcgtgcacaagaggaggaaggtgaattaccatatctgattttggaagtagtcaagtttgttttggaaagatatagtagattggattggttaaaaatcagtttccgttttatcccatacaccaaattcggctgccatccactccacctccttgccgagtcccactcgcccctttggccgagtctgaccccctccctcaattccacggttccgagttgtgtcaaacaccttggcgaatttttgtttggtgtcggtttcgagatctgtttggaaaaacggaaccggcataaattcagcattccatttttttgtataattttaattttgggtttagacttttacatttgagtccctataaattttatatttatgtttgagtccctgtaatcttacattaaggtccttaagtcagtttttgttaaaaaaaataaaaaaaaaagtgagaaaaaaaagggcagaaaggtgcaaaaaaaaaagaaaaaaaaagccgcaccaaaaaaaaatcagaaaagaaaaggaaaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcattatctgatttgagcatttgctattcctttgctacgtatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaactatatttcagatatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggatatgaaaaagaaacacgctatgtctttgcctccaattactaactatttgcaggaagtgcgtaatcacgaaaaggaggagagagacatgaaagagccaccaattccattgttcacacccaagttcgagacacctccatcatctaaagaggacatccaaggtaaagtaaatgatactgaaattaatcaaggtgagtgcattgttaacgaagtaaatttgtccacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcacattgctaatgaagttgaggaacgtaaattgctatcttctttaaatactttgggctatgttcagtttaatgatttttgtgagctcgataatttgaaggagaaattattttctaagtctgatttgccaagtccaactaatgctatttttcatatctttggcaaatataatgatagaggaatatatttggtgcatagagttttcatttgttcggatttagagaaacatgttattgctaatcacactacttcgagtttctctagttttgattggatgaaacaggttattttgaatggactatataaagaacaccatatggaaaaaccgaggacggttttccgtgaagaaggggaggatgatatgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggtgcaacacaacgtctcgtacggttgtagtcggatcgtcaacgtttctcccaaatcgtagttatcacaactcaccgaaagatcgggccaacaacagccttgagtgtcgagaggaactcagggttcatcatatcggcttcaacctccttgagtaattgcaaccccttaagcactgcttcatattcagcttgattattagtcgcatacggtttgatagtataagcgaactcgaaagatgcccccctaggggaaattataactaagccgatgcccaccatgagtgcacaccgatccatcaaagaatataaagtccatggtactat

SEQ ID NO: 11409 - DNA, 4687 bp, Oryza sativa
cccctaagcactgcttcatattcagcttgattattagtcgcatacggtttgatagtataagcgaactcgaaagatgcccccctaggggaaattataactaagccgatgccacaaccatgagtgcacaccgatccatcaaagaatataaagtccatggtactatctccaccgagccgattgaatcgtcatgatgttccacaataaaatcagctatagcttgtcccttaatcgccttcggtgattcataccgaagatcaaactcagtcaaagaaaatatccatttcccaactcgtccctttaatattggagccgacagcatgtaactgactacatcggctttgcatataacagtgcactcgttagataataaataatgcctcaaccttgtacacgaaaaatacaggcacaagcacaacttttccacaggagaataccgagtctcagcatccaagagccgtcgactgagatagaacacaactcgctccttcccttccaattcttgaatcagaaccgagccgattgacctctcgccagccgataaatataacctaaacagtattcctttctgtggagggatcaaaacaggaggagagctgagatactccttgatattatccaaagctttttgctgctctgctccccaagtgaattgttgatcggcctttaacctcaataagggtgtaaaaggttccaaccttccagacaaattagaaatgaaccttctaacaaaatttatcttgccgatcatctcttgtagctccgtcttattttctgggggcttaattttcttgatcgcattaacgctcctttggttcacctcaatccccctttcatgaacaagaaatcccaaaaactggccagccgacacaccaaaagcacattttgttggattcatcttcaagccatacttcctggttctctcgaaaactttccttaaatcggctatgtggtcctccacttctttagacttaacaaccacatcgtcaatatagacttcaaccaaccagccgattaaatcatgatatatatagttcatggccctttgataagttgctccagcactctttaagccgaaagtcatgacaacccattcaaataagccgattgcaccaggacatctaaaagccgtcttatggatatctccctcggccataaagatctgattatatcctgcattcccatccataaaactcaaaaatttgttccctgacgcggcatcaaccagctgatcggctaccggcattggatattcgtcctttggtgtagctttattcaagtctcgaaaatcaatgcacaccctgaccttgccattctttttaataactggaactatgctagaaacccattcagcatatcggcagggacgaataaaaccagcatcatacaatcgtttaatctcagctttaacaggttcgagcatatcggctttacatctcctcggaggttgctgacgtggtctaacccctggccgatgttcaacgatcgatcggctaagtccgggcatctcatagtactcccaagcaaagcaatctctaaactcttttaggaactctatcagcttggttctaaactctggagacaaatttttgctaataaatatcggccttggccgatcgcctggacctatgtctatttcttccaaatcattggccgacataaaaccttgaccttgcttgtcattgagatcatctactgtatccttagcgtagacattcgaaccctccacaacgccctcaaagtaatagcttgggttctccatcttcgattggctgtatatcagaatcggacacttttagaaaatctccatcccagaattttccagataaacaatcaaggccatccatctcccaaagggctaaatcggcactggcaacattaactgacctgtcggctggcacgatctctatcttgttgccttgccattgaatcaagcattgatgcatagtcgaagggatgcaacagttggcatgaatccaatccctttcgagcaacaagttgtactaacccttcccatcgatgacaaaaaacgtggtaggaatagtcttgctgccgactgttagttccacatttggaacacctttggtctctgatggattaccaccaaagtctttgagcaccatatttatcttcataagatcctcggcgttcctacccagcttcctgaacgtagcataaggtatcaaattcaccgcggccccaccatcgaccatcatcttagacatcggcttcccgttgatgtagccatttacatacaatggtttaagatgccgattctctgtcccctcgggtttctcgaatactgcctgttctggtgacaagaccaacttagccgattcctcttccacctcatcaacatcggcctgatcgatccagaattcaggtggcaatgtaaagaccatattaatcggtgccgctataacactctttccttttgccaacttcttcacttcattggctgcagcatcatcggctacgggaacctgattcttgacacgccactcctgtcttggctttggtttcctcagccaatggttgatttcctcttcaacctcctgaaaacgttccctgctcctcaatctctggaccctccttttctgattcttcgtgaaaataccagaaggacaccattgattcttcctgatcacctcatcctcttggccacgatcttgattcatcggacccaacctttgatgaacagggagtcttgtctgtctcagccgatcatccctattacgtggtcggcttgagctctcgatgatatcactgcacccaggacagttttcaatagatggcaacctcatcccttcattccagcagaatctgaagaactcgcaaccccaatgaggatcaaaaccatcatcgtactcctcataacgcctctcctgctgcttatcatacttcctctgatacttgttgataatcttagccgaatttacttgaaaaccctttgcatggtccctatcggttgcttgaccagctgtatgcaccatattaacgggaaaaggattcccatcgaccttcatcggcttcttggaatcatcaaacttaatctttcccccctcaatggcaacctggatttgctgtctaaagaccttacaatcattggtagaatgagacctggaattatgccatttgcaatatctcttcttgcctaattcctcagccgatgggatcgtatgaccagcaggaagctgaatctgcttttctcggagtagcaaatcgaaaatcttgtcagctttggtgatatcaaaatcatacttctcctctttcccaggactttttacccattggcatggtataacctttttgctcctcacccattcggctgcagctatctcagaatcatcttcttcgtcatccgacccatacatatatggacaaacgtgattaactttcttagagcttttcctgacttccgctgacctatgctcatgcaaggtcaccttctgtatcaggtgcgataagctatcgaagtcttcggatgagaatttctccctgattggagggacataccctggaaagccaaatcggctaactgagcatcggtcaaactcaagctaaagcacttgttcctcatctttctgaacctttgaatatactcgtgcatgggttcatcatgccgctgcttgatcgctgtcaagtcggacaacttcatctcatggaccccgctgtagaaatagctgtggaattgcttctccaaatcggcccaactattgatcgacccatacggcaaagaagaaaaccaagtaaaagctgatccggacagagataaccgaaacaaccaaactctcaaggcgtctacagccgatgcttcaccccactgagcaaggaatcggctgatgtgctcataagttgacacgccctcttgtcccaaaaacttggagaaatctggaactttaaaccgattgggaagaggaactctttcaaaccactcagggtaaggctgccgatacaaacttctagtttcttttggtttaagtccaaactgctccctcatcacatcggcaatcacatcggcccatggtcattgctgagctgctccttgcggttgttgctgcatgggctcgaattgaccaaactgaggtgcgaactggggctgagccaatccccctggctgatattgggcttgcggggaaggaggctgatactgatagctcaagttacccccttggtaattatgaagattcggctggatgttgcgtaccaagtgctcagggaccatctgaggcaccacagtgccatccggctgtgcatggtgaaccaaatgctctgagacaacttggtttacaaattgctgcgcaggttgcccaccaggtgctgcgaacccagctgatgcattggccgaccccgggtgctgaatcagctgaacgatctgctgtcgcacctgagtctgttggatcggctgaagccgctgccttggcagtgtttgctgaatcggttggataggctgctgtgttgatggtgtttgctgagctggttgtacgacctattgttggatcggctgtacaactggctggattggtagtgtctgctgaatcggctgctgctgcactggatcaacaataggtggaggtggcaaaaacatggcagcaacctgatcatgggtcggcggattcgcgatctgcccagtaggctgtggatgctccctcattaacaaccgaggggggtaccgagctcgaattcgccc

SEQ ID NO: 11410 - DNA, 2198 bp, Oryza sativa
  unsure (1)..(2198): unsure at all n locations
nnnnnnnnnnnnnnnnnnnnnnnnnnnnnnnnnnnnnnnnnnnnnnnnnnnnnnnnnnnnnnnnnnnntgaaccaaatgctctgagacaacttggtttacaaattgctgcgcaggttgcccaccaggtgctgcgaacccagctgatgcattggccgaccccgggtgctgaatcagctgaacgatctgctgtcgcacctgagtctgttggatcggctgaagccgctgccttggcagtgtttgctgaatcggttggataggctgctgtgttgatggtgtttgctgagctggttgtacgacctattgttggatcggctgtacaactggctggattggtagtgtctgctgaatcggctgctgctgcactggatcaacaataggtggaggtggcaaaaacatggcagcaacctgatcatgggtcggcggattcgcgatctgcccagtaggctgtggatgctccctcattaacaaccgagggttcatcggctggcctagcgccatagctgatgtagcgggcaagggagttgatgttggcgccgttggctgagttgtgggtgcaatagagggaaccgcttgcacagctggttgaacatcgatgaccagagatcgataattcgggaagacacctccttgcaagtaaaccgggcccgtagcctgatgcttagctatcgaaccatcggctattgtcttcatcatgtttgacaatgtattgactaaaaccccggactgattgatcagagcatgatgcacagtgtaatcaacccgatcttgaaagttgttgaaaaagtcttgtgctagctcattattctgattaagatttcctccttgcgacccttgagcagcatcaccttgagctccgtgcactccttgagggttgtcgccttgatttcctagagaaccatcagtagcacctttgttgctcggctgagccgagccttctggagcttgcttcacctctccatctttagaagaaccggttccaggactatcagcaaccacatttatcttatacttctgaacaagcgttcccttgcgggtttgcatgaacgagctcagatactgatcccgtgcttgctgcatcattgcttcaaactcctgcttctgctcaggcgtgaatttctctggattgattggcatgacattgtcatcaatgatgtcagtcaatcctggcttcaatgccttgcctttaatggaacctgggcttgatggtggtggtgcttgtttctcggccatgaggaagaactgacgtctgacttctaatcaagtcccactgggcgtgccaaaagcgtgttgacagaaaacacgtggcctgggagatctgcttaactccagtgcaggtccaaaactcgccttcggatgtattagcgtgccagttgatttgattctgtaatcaacaagaaataaaagcaacgaaaccgtggttaaatctataaatgatagccgatcggctagatgccgatgacatatcatttatctttgggccgatgtcatctgtgtatcgatcggcagtcatgaataagtaaataaacactaaatctactcgatcggctgtagatgttaacgatatatactccttatattggtatatacttaaatcgagtgattggcatagatcggacaccatgctgagacagtataaatcacttagatcgaaatatatatcaataacaggattatatatgtttatagcgtagccgatcagatagatctagcgtgtatcggctaatactccgatactacctcatatcaggatattaaagcaggtataatatatcaaacaaagccctaacatatttagatgcagcaatatcttgatagcaagggcagatttagcatatcgatgagacatgtagaataaatatggctaaatcagatacgatcggctgaaaccccgatgctattcttatcggcaactagaaggcaggccagagatcgatattctaaacacgacttaatagatcaaactcaactgatgcagcattaagtatgaaaagaagaaccatatctagacaatcaagccgctagcagtttcatagaatggtagatatcttatataatctagatcaacatcaagatctaacctaatcggctgccttctgcatacagatattgaccgatagtagtttagatggcgatatcgttagannnnnnnnnnnnnnnnnnnnnnnnnnnnnnnnnnnnnnnnnnnnnnnnnnnnnnn

SEQ ID NO: 11411 - DNA, 3770 bp, Oryza sativa
  unsure (1)..(3770): unsure at all n locations
nnnnnnnnnnnnnnnnnnnnnnnnnnnnnnnnnnnnnnnnnnnnnnnnnnnnnnntatcggctaatactccgatactacctcatatcaggatattaaagcaggtataatatatcaaacaaagccctaacatatttagatgcagcaatatcttgatagcaagggcagatttagcatatcgatgagacatgtagaataaatatggctaaatcagatacgatcggctgaaaccccgatgctattcttatcggcaactagaaggcaggccagagatcgatattctaaacacgacttaatagatcaaactcaactgatgcagcattaagtatgaaaagaagaaccatatctagacaatcaagccgctagcagtttcatagaatggtagatatcttatataatctagatcaacatcaagatctaacctaatcggctgccttctgcatacagatattgaccgatagtagtttagatggcgatatcgttagagattatataaggtatatgataacttgatgaattacataaacaggactagagtgtcatgaggatggaagcactaatcctaagaacgcaatccatcacgacgaatgttacctcttgttgtagatcgaaatcgatgcagctcaacctgaaagcaagaactcgtcgaaataaaactaaagcaaaaggatggcgatgtgcagagattgtattgaacatgtgtattaaaaattacatagggctcggggtctatttatacccgaggattacaagatatgcccataccggacacgactattatctctaacaaactctaagataccataagtctttacggcagacttttgtctataaggaatttacataaaatatcctaattaatagatacaattgccttcccaggactctatccatgcgtggcaatcatcttgaagtacattaacttgaacccgatgtcgcgtacaagtcgtattgtcggaatcggctacatcgacttacccaacacgactcagacccagccgatcttatcgtagccgatctggatttcagccgattcctgctctgctttcaaacccgatttcctcttccgactttgcttcaatctactcttctctcccgacgctgatgttacccaaattcggttgttaacaggaacgcacacgtggaaggccaggatcaaaggcgccggtggtggttcggccaaaccttgggccccacctcctggccttccctttggccaggagactgactggtgggccctgatggcggttatgacagttatgacgcattccatggcggtttcacctgacttatgggcccttcaatccgtgtacttgcgtctaattggccagaggtgtgtttccttgcatgactggtgtgttttctcattaaaatacccgcatacacatatttcaccaacactagtggaattgggtagtaataatccctaccactaagttgaataccatattttatttcattattttatttcattatatgcaggtattgacggtcaaatattatgatttaaagaccatcaacatttggcctaatttgtggtcccatcaatccgtgtgctcacacgtgattcgctggtggtgtgtttctttgcatgccagcttcatttctcattcactttggtgtataatctccgcattcatgttaattctcttagtctagtacaactacattatttattattgatatacgtataagaaatgttaattttccctttattcattgtatacgtatgtcacgcccagaagttcttctccttagcaaaaattcaattaataaattgttgcaagaaattatttgtttaaaggcaagagagaaaccctaaattaataaatgcatttaataatcggaatcggcatgtgaaatttttcttagattctacatgctctactacattaacaggatttttagtggaattttcagagccttggaaataattttaaccaattaaaataagcaaagtgcaatattaaatccctgggaaaatcctttttcccttttctcttttctttttcctcctttttccttttcttgggccgtcggcccattccttcccgcgccggcccgcttctcccctccccgaagtcctccctccctccctctctccttcgggcgccgacaggtggggcccacctgtcggtcgtcttcctcctctagccgttggagccgtagctccaaccgccggcgccccacctcctccactccgcatctgcgccccaccccacacccacgtcgccggctcgccgcccgcttccccctcctctcccgcacgcgcgagccccgcaagggcgggattcggtttcaatcccccccccccaaactctctctccccactcccccacgtcggcgagaaatccggcctcctcccggcctcgtccgtccctcccgagcccatataaaccatccccgcattctcctcctccatgtcctttatccatcagccgctccgtagctctccatcgctcccgcaccgatacaccagccgccgccgccttttccactcctccggccaccgctcaccattgctagcaccgccgtcgggttcgcacggctgaggtccacctcgtccgccgctcccccgtccaattccgtcaccggagcccgcatctcctcgcactccggcgagcttccaccattgccgccgccttcggccctagttttcgctcgccgcggacctcccttctccctctaatctctcttattttgacaactaggtggttccggacctcgttcggcacttgccgccatctcccggtcgttcgccatcgccgttcgtcgtcccttcttcccgcgccggccaaccccatggtgagaactccctgtcctccctctttctctccctcccgtgtccactgccatccaccgcgtgcgcgccattgccttcggccgacgccgacgccttccgcgccgttcgccgccgccggttgccatcgccggcgaccgtgcaccgccgccgctcgctgtagccggccggccggcttggagccgagccgagcccggcagacgtcgcccctccccctttttggagccgcggccggtggggcccgcctgctagtaccccctccctctcccttgtgcctccgacccttgggtcccgcctgtcggcgccgccccaccccttggatgatgtcagccctaggatgctttattgcacaataaatcaataaggcttttctttaatagtaaaaacacaaataatcttctaaaaatcatatctaattcatccgagctccgtttaaatccattcaagtcttagtaaattcataaaaatgcatagaatccattaaaaatggttttgtttcctgtttcagtagacttatagcatgttttgcttgtgtgctttgtttgttgcgtagatttcggtcgttccgtcgatccgcggtttctcgaagacgttgctgtggtctcatcagtgcgagagcaaggcaagtcatgcattagattgatcatattgtacccaatttacaagtgtcccgcatttctattaaatgttgcattgttttacaatatcatgtgggatgggtcctaccactcagccatatcttgtttaccttatgccattgatgataacttgggtatttgttgatagaaaacacgtggcctgggagatctgcttaactccagtgcaggtccaaagctcgccttcggatgtgttagcgtgccagttgatttgatcctgtaatcaacaagaaatagaagcaaagaaaccgcggttaaatctataaatgatagccgatcggctagatgccgatgacatatcatttatctttgagcc

SEQ ID NO: 11412 - DNA, 782 bp, Oryza sativa
attatgtttctagggtatcctctagactttcgctctacaagttacatctctagagctatgggtttgtttggaaagagactacttgcaggaggttgatgctatccctggtcgtgttctgtgcaggcatattttgatggtgttgatttggtccaaggaagaattgttcttaaatagattcctaatcatggtggtcaaggggaatcgcggacctttggagtgcttaacttaaataataagtttgctaatccacaaccgcaagatgaagatttgccccctattggtgtacgccaccatcaccaggccccactcaacatcaaggtgcagcttgggatgatattaatgagcagcaagaggatgtagggggatgggataactaggatcaacaggctaagaatcaggggactggtcagtctggtataagctcacatggaggaagtgaaaatatgcagatcataatgttggctgacaatactaaatattttccacagttttctataacacctgagatgcaggagaagattgatgagttccttttgagggtgaaacttttgagctctttgcaaaatagagcccccatcccaatgcccattcaaatagctgctcttttcaatccgctcctttccctaaaaggaaagctatcactgactgttctccacctgttattaaaagggacaacgtgggtgaggcctcaagttgggccatggaaaaaaagtctattagtggctgatgatgtcatgcatgctttaggggatctaatgatttcctcttagttcccctggcta

SEQ ID NO: 11413 - DNA, 670 bp, Oryza sativa
  unsure (1)..(670): unsure at all n locations
ccacaagagctcgcgcgtgacaattgaatttagatgtgagttcgttcctatgttcttctttatatgattttgagaatagattgctacctaatgattatattatgattaggaacaatggagaggacaaggagacacttaaagagggacttagaggcgtggaggaccagcaaaggcgtccaagtcaagatggaggcccaaaccaagtcgacttcgagtacgtttcggagtccaggactagtttgctctaaaacggacgcgcaggtcatatacgtgtttggattggggcattctttatatggatggaaagctaagaatataaaatttccaatggttctggtcccatgtccaaattctttccgagtcatcgggaatcgaccgaacaaattgacgtccagaatctgtttcggtgctgcgtcgccgtattttgccctttgggccgtgcatcgtgttggagcccattagggttgcgtcaaggggtgttgcacgaccctaagactctatatattagtagccgccacaatctttaaggtttgggttttgcttaaattaatctgtcaataacagttttgccgatccttcggtttgtgagaccccaacttgtgagcttannnnnnnnnnnnnnnnnnnnnnnnnnnnnnnnnnnnnnnnnnnnnnnnnnnnnnnnnnnnnn

SEQ ID NO: 11414 - DNA, 642 bp, Oryza sativa
agctcctctaccgactgttccggccacatcccacactctctctgccggccaccacccttcctgggtgcgccaccctcaggaacacgtttggccgccggcgtcgcaaccacccagccaccggagcaccggcgccccgctcctctcctcctggtctcgggtctacctgtgaagaacgaaacagagaagaaagaagacgagaggaaggatgaaaaataaaaataaaaagaatagaatattccctgacaagtatagatggacataagacccgaggccaaaaggaccggcccacggcacggtattttggctcggcccaagcacggcatggctcaacttgggtcgggtccatgccgacccggcttgaccgcagggccgtgcttgggcctccccaccgacatgctgggctggcccggcacggtcgggcagaaaggccaggcccggcacacaaagtataaaaaaaggggtaaaaccctttaagaaacaaaaaatagacatataaactaaaaatcggtgcgcctgttggcgcccctgaatttttcgcccatatacgtctataaacaaaaatatatgtaattaataatattttaaatttctaatttttggtgttaccaaatagtaggtgtagtgtttatccgaacatttata

SEQ ID NO: 11415 - DNA, 692 bp, Oryza sativa
attcattacaatgcagaaacatcagagactggcatgcataaatcagacaaaacaatgtggctgtagtattgttcctttgtatctgcccggtacgagtagctaataatactcgtgtctcgcacatgcacaaatgtaagtgtagtactaatcaagctaatcaaatgatcaatttgtaaccatcctattggcccaagaacaatggcagtctgaggaacaaactatctggtcctaatgcagaaagagcaaagattgcaaactacagtagtatgacaaaattcagaaattgatgcactgaccaacaggatcggaagacacgctgccttctgcttggaatgccttggcagtgctctgcaggttcctcttcaaaagataatcatggatgtacacgtccaacctgcttccaagaacagacatggataagttcagtgcggggatatataataagtaaaaaaggaaacatgggggtttgcatgcaagcacagcagcaacaggaaggaggggatcgaaagttttcatgagaaaataaaaaggtaaaatgcagattaaagtgtgaaagagcaaaataatttcgagaaatgaaaaggcagttgccatgcaaggtaaaaggaaaggcagttgaaaagctagcaagcaataaaccaaactagtactgtattcgagaaaaataaagggacaagagggacaagaaaaaa

SEQ ID NO: 11416 - DNA, 18888 bp, Oryza sativa
cctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgacttaaacattgtcctaaacgacttcctttgcgagtacggagggaatatccttttaggattcaatttttttccaaaatatttgtactctaaaatattacctctgtttcaggttataagaacggaggaactatttatcctatccatcttcttatattaaatttctccttgttataccctccaattgccactccgattctaaccatatcatttacagaaaagagaatattgagaagatacgcaaaacgatgtgagccattagtgcatgattagttgagtattaactattttaaacttcaaaaatggataaatatgactttttaaaacaactttcttatataaatttttttataaaaatacacgtcgtttaatagtttgggtagcgtgcgcgcgaaaaacaagttgttttctctctcgatctcccagcaaggaacgcaaccttagtgaagagtagtatagtattttaacttaaaccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctttattaaagatatgttggtgcaatctctgaaggtgctctatgcacaagtgtacatataagtgcatgcatctgtcatgtgttaaaaaaaagctcagagatgatgagatatgttcattacattaccaaaacaaagcataacaatgaattaagtaccagataaatcttggcaattgggctcttgaaaacctggtgcacagtctcatcatctctactgttctacagaatcacctcccttatcttacctgcatgacaaatgcctcgagaaaaaaaatatagccacgatggcagtagcgaaatatcgtgcaaaaggaggggcagtttcgaccgaggagctacagtgagccgcaagtacgcttttttctgcaggctcatcaatccatgcacactcattattagccctagaactgtagcatcatttcacatttattttctttctctctctctcggccttaatcgcatataacgataattgatatggataattggattggattatatgcagctgtatcacaaattcacaatcccacaatctcattttcttttttactcggtgaaccactaaaacagtgtgaaatgggcagctgtttggcgttttcaagaaagaaaatattgttaaactgaccttttttgacagtcatcttcagttttttttttttgtttaagcccttcctctcctcactcacactgccctgttcatctctttcttttttattcgattcctctattccattccacacgcattgccgctggtagtagaagtatagtatctctccgcgaccgaagattttaaaaaggaagcaatttgcctcttttttttttttggcgcacctcgattagtagtagattttagaggcgaatgtgagcggtcaaatccttcttttttagcttgtgcgcgttgtgttttgtgctctccttttgtcagttcctgaggcgctctctcctgtgcctttgtgtttagcgtgcgtgaccgcgagcgaggtcgaggagtgagagggagtgaggcggcggcggcggcggccatggcgcagcagcagcagcagcagagtgcgtgggaagcggagaagatgtgagctttctcctatctctcttctgttcttcgttgcttcatcattccttagtttgttattgcgatcagattggtttgatgttcttcgcacattcttttttcccttttttttatgttggtgaaatgttctccgttttgtcttgagatttttttgtcattccatttggttctcttggtgtccgcatggttatctttccccaagattagtttcttgttttcctctgggaggggtttcggattcgtttcttggcggtttagatcgtctttttttctggtgatttttgcaagaatcttgtccttcatcttcccttgttgttgtatttcagagggctgcagacgcttgagattctgtttgagttccctgaaatttctgcattttccgttctgcattttggtttctccttttgcaaaagccatgcctcttttttttttcttgttcctcttgttccttttatttttctcggatacagtactagtttggtttattgcttgctagcttttcaactgccttttccttttaccttgcattgcaactgccttttcatttctcgaaatttatttgctctttcacactttaatctgcattttacctttttattttctcatgaaaactttcgatcccctccttcctgttgctgctgtgcttgcatgcaaacccccatgtttccttttttacttattatatatccccgcactgaacttatccatgtctgttcttggaagcaggttggacgtgtacatccatgattatcttttgaagaggaacctgcagagcactgccaaggcattccaagcagaaggcagcgtgtcttccgatcctgttggtcagtgcatcaatttctgaattttgtcatactactgtagtttgcaatctttgctctttctgcattaggaccagatagtttgttcctcagactgccattgttcttgggccaataggatggttacaaattgatcatttgattagcttgattagtactacacttacatttgtgcatgtgcgagacacgagtattattagctactcgtaccgggcagatacaaaggaacaatactacagccacattgttttgtctgatttatgcatgccagtctctgatgtttctgcattgtaatgaatgcgattttaatcttcttgtactgaaagatgtcagcttttgttttgcaaaaaaagcaattgatgccccagggggtttcctcttggagtggtggtctgtcttctgggacatcttcattgcaaggacgaacgagaagcactctgatgttgctgcttcgtacattgaggttcttgtagcacatgcatcttggttattacttgtccttgttgtttgcttgcactcacttggtacagtggtttactgcttatcttacaataaacatgtgtaaatgcttgaattgtgtcagtcatagagatcatgttcactgtaaaaggatttagttttttgcctaaagcaaatggatttaaattccacacaaacattgaaaaccaaattcaagaactttccatgtcactcttgaaaaaaaagaagaaaatgcctaattcatctatgtaggaaaaacttgttatggtggatatttttttttaaaaaaaaaatcaaatgtttccccatatttccaaacaaaacatgctgcatcatatcacacaattatagaagaacatgtgtcttaatcattttagaaggtacagaatgcaaaacactttctcgtagaatacatactatgttgtctccagctattatcatctttaaaattcaagtaaaatttcaaagtcaacattttattatcaatatgattaattactttgaaggcaatggtcccttccctttgtagtaggccgtagctaatacctgttcattttctggtgattactcatttgaaactagccatttcttggtatatgatgcgtcaatcttattgcaaaatgctattttcatgttcctgatgttgttacacataaattttgtaacccagacacagtcaattaaagctcgagagcagcagccatcacagctgcagcagcaagaggctcattcccagcagtcatcacagcagatccaaatgcaacaactcctactacagaggcatgcacagcagcagcagcagcagcagagtcagcaacaaccacagcaacaacgccgccagcagaagcaacaacagcgtagtgaaagcagtcatttgccgacaagtgcacataatggtttggtttctgctgatcctccaacacgacaaagcacttcagctgcaagttctttgtctgcaaagatgtacgaggagagggtgaagaattctgttcaaagggacaccttagatgaagcacctgcaaaggtagtttcttcatggcaatgtgtattgttgctttcatgatctaaactctcataatatgaaatgcatatctttatactgcagcaaaggtttacagaaaatattggacaactgctggaatcaaactcatcatctatgctgaagtccgttgcaataacagctcaggcttcagggtaccaactgctcaataatgcttgctaatcatttacttctcttttttttttttttgggggggggggggagtgtggggtgggaatggaaggtttggagcgcaaaataaataccatatcagtcttaaatacagcctataatgtgtgatctaataggatttcctaccatgcttgaattgtgtttaccgcctttgtttttacctaactattttgcggtcttcaaattgcaactttgaccattaattcttattgtacactaaaatgtgctaataaaaactattatattactttcatattattcacaataaatctatccagcatgtagtagctgtttgactaaatttccgtaatcaatgctatcttgatggttcatactgtaatggctgtttaacggcaattatctctagcttctgttttcctgttagcgtgtgtgtattgatttgctttgatcaattgtttttaggcaaattttccatggatcaactggtggcgtgtcaggtactttgcaacaggttcaggcccggaaccaacaactccaggcatcaacacaggtagtcttatttcagatgtataatctcatgcattattgtctataactagacgagtcaaatttgtttcaggaaataaaggtagacacaaatgctgctgtacacatgagagctgcaggggcagatggatcattaattggagtaccaggtttttttgctttgaactctactaatttttgttgtttctggctgctaactggaaattcttagacctgctgtactgtttattcatgtacttagtgccattgtttgataccctgttgtctggcaggcgctaacccagcagggaacaatttgacgttgaaagggtggcctcttactgtgagttcttcacatcattccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttcatttaaatttatcatgcttgttcttgttatgttatgttgccaagtttgcataacacagtaccatttactttctactatagcatagtgattaaatcatgaaaatatcggtcttggtccttgtgtaatataatcttttgaacagaggaactcatactatttggatttcataatgatctagctgctattaatacatgctcacatgttttctgaagctacctttttcaagataacttctacatctttggttttcgaccttaacacctcgtcattatatgtagtagaagatagcagctatacagcagcaccagcaaagcagcaatcagcaacagctccttcagcattctttacttagccagcaaccaccaatctctaatcaccttccaggccagcaggaaaaaatgggagctggaagtgttactattgatggaagcctgtctaattcattccgtggaagtgaacaggtttcacttccttctacatatattcaacattaccaccttgatttgttactgtgcctatccttttgttaagacttgtatccatcataaatatattgttttgcaggtttccaagaatcaaaatgggcgaaaacgcaaacagccaatctcatcgtctggtccagccaatagttctggcactggaaacaccgcggtcccctcctcagaaccctcaactccttcatcgcaaagcccaggagacacaatttcaatgccctcgctgcaccacaatgctagcttatcaaaggctttagttgtttacggtaccagtacagcagggacaatgggatcaccatcaaatcaacttgtaagttacaactggttctaaatccaaacagctatggccctattacgtggatatattatgcatgcaacatagtttggaaatgtttcattgcactgatggtctgtttgatgcctgacttctgaacatctgataactcacactgcaggctgacatggatcgttttgtggaggatggctgcttggaagatcatgtggattcgttcctgtcgcatgatgatgcagatcgaagagatggcagtcgtatggaatctactaaaggtgtgataaggctaactgttttgtaacttatggctagttgaagttgaatggttggctttgacatattaacatcattggcagtggttaccctggccagtttagtcttgaatgtaattatggctggtgtaaatagtaccaacaagctgaactcacttaggtgaatttagcttggaaattgagcagttggtgcggttcaggctatggtcctgtgagaggggaaattatctaatatgtcatgtggtaacatatattggttcagtgggttagatttatgatgtattttgtagggaagtctaacatgaatttgtgttctgtagagctttgattctgtttatatgtcttaagcaggattcatcttccgagaggtctcttctgtacaagcaagcacgaacaaggttgtatgctgccacttctcatcagatggaaagctacttgctactgggggtcatgataagaaggtaagtgcacatgcctgggcttgttaagatgctcagcctagttgatactcttggaagtgggcaggcatatctttgacttcatggtgatattgaaatagatacttgcaatgtttcaatgcaggtggtattgtggcatgctgaaactttaaaacagaagtcagtattggaggaacattctcttttgataactgatgtacgattcagtccaagcattccacgccttgctacctcctcatttgataaaactgtcagggtctgggatgctgacaatgtaagtacataactgtttagttcttttttcctaccatctatttgcctcggtgattgcctctgtgttatgttgcaaaaacctgccaactagcactgaaaccatatcaaattgccatttgtatatttagccagatttttttaccttttgaactgccctttatgtagaaacaacatcataaagttaagtaggctataaattctcaaagaatacagtaagcaatgtccatctcaaggtcatatgtcgtgaatgatctacaacatcaattttgagattcataggcatggcatggattcattttgtagaagtggaacttgtttgttctctaggggatataagcatgatacttctgaactttcagattcctgggtaatgtcagtacttgtaattttaaaagctgcaaggcaagcaaagtactgttgtgttttactgctcatcatattctaatgctgtcattgtacttttgcagcaaggctattcaattcgaacgttcactgggcactcagcatctgttatgtcactggatttccacccaaacaaggatgacctcatttgttcttgtgatggggataatgaaattcgattctggagtatcaacaatggaaacatcgtccggatatttaaggttactcagtttttcttattcagcattctgtcaatctggaagtgctgctttattgtgaacaatcctaacatttccttgacaaagcactccaacgtatacttgtagacttttctctttatagaaaatgtgcatgatgaatgtcaatctgttgaaaacatcctaaaattacgtaaaagaaaacatcctagatgttttccatacctacttgttaattggtttcaatcactgtcataacccctttgtagttaatgggctgttattaggtgtctccatccataatcaacaactggtctcaaaaggagatgccttgtaggatacactgtttcttgatttatttgtttccaatccctttgtagggaggatcaagccagctgagatttcaaccacgtcatgggggatatcttgcagtagcttcggagaatgctgtctctatacttgatgtggagactcaagcttgccttaggagatttgaggtttgtagagactttctaccttgcagttggcacgtgcattctgatcttctaaattcactgaggttccagtaacatatataccgaccaacaaatctatgtgcaaggatgtatttacttttcaaatctcgtttttagagtgagttttggatactgcaaatctatctatttattttgtaattagctttgtggtgttcatttcccttgatggttagttgtccttgcttggttgtttacatattttcaaagtcgcatcgtgctagctgtagccagtgttcacttccatgttaatctttagagtttccgagtgatggtaaccaatcactttaatctgtcctctttattgggaactgcagggccacacaaagcatgtcgattcagtatgctgggatcccagtggcgaatatgttgtatctgtcagtgaagacacggtgaaggtgtggtctgtgaatgctgggagcgatgatcgctgcgtgcaagagcttagctgtaccgggagcaagtttcactcgtgtgctttccacccttcatattcatctatgcttatcattgggtgttaccaggcaagtactttatattcgtggatctcttttatgctcatgcgtcacgattcattcaaaactaatctgcactgatcatcctaattcctaagtagctggttaaaaatgactttttctagatcaactcatgactactcactcacactgaggatcattccacaacttgaatttcagtacatcattacacatatatcaagttcctcaaatattccttcatgatacacatgcaattattttgaagatttactgcaatgaaatacttttcctatttaagaacaagcattcggccatagagaccacttatgttttcaccgcggttcatgtttacaatgcctgtagtacgcttacctctggttttgtgtttgaatgccgcagtctcttgagctgtgggacatgtcggagaacagaacgatgacgctcgcagctcatgacagcctcatcacagccctggcgtcgtcaagctccggtttggtcgcttccacgagccacgacaagttcgtcaagctgtggaaatgatgtgctttcaagctagccgcgccctctaaccctcttctaaggatgggcctttttcttcctcattttttggtcacaccatcagctctgaagagctattgtgtgatgatggtataaacactctatatggtataatatcccccacaaagtagctggctactgaatgactgatgaaaatattgctatcctagtataccttttgctgaccctgggaaagtagcattttgtacagaacatgaactatgctttagtattaatcatagtctatctgaactactgaagtgtttatggtctgaattctaagaagttattctgctgcatctctgctatgaatatgaagaatgtgatgaatgtggcattctcgtaggaatttcaagggactttttttgtaagaagtatgctcaattccagcaagaaattggaaattttcttactgaattttacaaacgtggtttcgtcacggatgcttggtgtctggggaaagcaatgaatcggcatctctggcctgcaataaacgaatgtatttgccctgtttgcatgttcagtctttgcacggctcttagattccccagcctgtccaaaaatacccatgacacggtttgatcgatcgattgcaacacaaatctgtgaacagatcattggttcctgatcagagatgttcagttacttctctgaacattgatttttcttcttatcagatagggaatgtgcatctttctctctgatcttcagtttggaagaacactgcatcctgtagggctttcacaatgatagctacacctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacaagaactttttatcggttttgagtagcggaaatgcctatccgtataattatcaggaggaaagcggcaaattccactctacattatttaagatcttgaaggtgtttggtacatcgctctagctaataaaatcttggagtagtagtgccaaactgttcttaggcggcattcgggaggaggggttgtgaacccttcatcctcaacaggcaaaacgaaaaatacgtattattgtatgattaattaagtattaacttttttttaaaaatgattaatatgattttttaaaacagctttcttatataattttttttaaaatacactgtttagcagtttgaaaagcgtgcgcgtggagaacgggagaggtgagttgggtatactggggaagaacacagactttgcaaaaaaaaaagtccccggtgtaattgggaaaaaaaatcattagggatagatggatgtatcattttgtttcacatatttatccctggttactattataagccgtgttgatattttatagccaatcctttttgagtttgatcaagtttataaaaaaatatagcaacattttcaaaacaaaacaaatatattatcataatatattaaatattagttttagtgaaactaatttggttttctttataaacttaatcaaacttaatgaaacttgattagaaaaaaacaaaatataatatcaaacaaagaagtactccctccgtcctataatataaggaattttgagtttttgctcgtagtgtttgaccactcgttttattaaaaaaatttatgtaaatataaaaaacgaaaagttgtgcttaaagtactttggataataatgtaaatcaaaaaaataaataatagttctaaaattttttgaataagatgagtggttaaacagtgcaagtaaaatcttaaaatcctttatattatgggacagaggggtagtatttgtgccttttctgaaagaaaatctaaaaacaagacaataaatgcgccggcaaaagccaaactaacccccgtgtttaaatcgcctcccgtacaagtctcctgcccctaccaataccaacttaacccctcttcttccatctctaatctaatcactcctccccttttccaccctccccccacctcgtcgcctcgccgtctccacccccaaaaccctagccgccgccgcgctccttcttctccgccgccggccggcgccgcccggggccatggatctcctccgctcgcacctccacaaggtccgcatcccggagcccggcagccgcatccacaaggacgagtgctgcgtctccttcgacaccccggtaaaccaaccaaccacccacccacccacccacgccttgtcccccccttcgctctggtttcctagggttagggttttgacgccgatttcgccgtgcagaggtcggagggtgggctgtacgtcgacatgacctcgttcctggggttcgggagggagcacgtggcgtggaactacgagaagagtgggaaccccgtgtacctccacatcgtgcagcgccggaagccggagcccgacgacgaggcggatcgcccgctgaagaagcccacgctactcgccatcggtatgagtgacagcgctttcccactgatcaccatcgtgtatttcatactgttaaaattgtgaacgcatgaatcgcgttagggtatgtgattgtgtttggatgatgtgatcgttttcctattgcgacttgtttttaccctatgatcaacatcgtatttcatactgttgaaaatctgtatccccattatctgttcccctttgtggtagagacttaccaaactatggtagttatcatatatcttgtgttctgtttgatctgttgagctactgtgctgtagagaaaaaatatggtagtgcattgctttgtttgctaatctggaaacagagaccaacatatggtggccatgttggtgaattgtttgttatgtgatatctgtatgctagttatttgtaattagaatagttgcctatgtcctggatttagatctatatagttgtattttctctgttctgtattcccatgatggcaaatagatgaatgcgttgaccatctttactaatccgggttttctacaatttataggagtggagggaggtttcactgatcaagaacccgaatacgatgaggcttttgaaattgttatcttgcctgaatttacttctctcccttttccatcaattgacttgccagagaaggtaactgtgcttgacataagagattgtacttacttactacatagtagttacttactactctacaactccacaggttaggattgcagttgacaaagttatacttgccgaaagtgctgatcgaaaacaacaattggcttcttgggttgctgacaagaaaaaagtcagtgcacatgctatggatctgaagcagctagacaatggtgtcattgtgccacctacaggatggaagtgcagcaagtgtgataaaactgagaatctctggttaaatttaactgatggcatgatcctatgtgggaggcggctttgggatggaagtggggggaataatcatgctattgaacactacgaacagactaaatatcctcttgcggtaaagcttggaacaattactgctgatttagaagcagcaggtaatgctactcgtggaccttttacatatttaggcttcctcttctattatcgaatacaacttacggtgacattgggttgtcgcctgtgaaaaattgaactaaaccccttttaacctctcacaaactgtatcctttgtaatatctaaattaaaagtgtcatatatatgatgctcaacttggaatgcacttttagaatactatactccctctagttttaaatatacaaaacggtggaccttttaaattcgtttgactatttgtcttctctagaaatatttgtgcaaataaacaaacatataaggcactcttaaagtacatttgatgaccactttacttaactaagtaattgaataaacattgttggtcaacgtttgagaaaagaagtggatggtgtcatatatttaaaaccagaggtaatacttaaatagcttttagagatatgtttgttataaatacttgtctttattcagaggcacaaaaagttggaaaatgttaatgattttgtgattggagggagtatattgcaattattattgaatattcactttaatcagtaagactcgttcttaaattccagagttgttccctggatacatactgctcgtacttcataatttataacacacagcccaattagctactataaaagtaatttacactgatattttaaccttccattgaaatattttgctttcgtcttattttagttttaacaaagaatattcttaaagtcctaaagcaaccttcctatcaagggcatgtgctgctgaagttactgttgttttatatttaaatatacctattcatacaagcttttctgtgacagctcagacgttttctcatacccagaagatgatagcgttgaagatccactattagcgcagcatttgtcacattttggtattgatttttcttcactccaaaaggtgagtagtatcattttcgatgacatttatgagcgataatttagctctgctcaatatgacttgctttttttattgtgatagtaacagattagtactttttcatgggaataatatattctgtagcatctcatgttcatactgtgttttcccctttatatgcttgtctatctgtctagtttagaggctatttgatgtgacccttttgttgtgcagaccgagatgactactgctgaaagagagcttgatcacaacacaaattatgactggaatagaatacaagaaagtggcaaagatgccgaacttttatacggccctggttatactggccttgtaaatcttggaaataggtagctttggttcattggttgacgtcatgaattttcttttgtaataatttctcttatgtaatgcatgcgtttccttctttgcagttgctatatggcctcagtaatgcaagttatgttttcaactcatccttttatatcacggttggttctactttctcaattgatacttcagcacttcttgtctagagttgcattttttcctttttagtagcacatgctcttgcatttatttcttgcatcatttcagctactttgagaagcagagcttgaaagctgcatttgcaattgccccagctgatccaacattggacttgaacatgcaaatgtaagtgtacaccagctgatctgtgtttttgcgtgtattggtattggattagtcactattctgaggtagttggtgtgagatgcagtgttaccttcttctaatgctaaatgtaaggataatacataaagcagttttttggccatttatcctgtatggttgtatgtgaagaaaccgtaattcgggtacaattacttttttaaacacttgcaatcacaaacaaagtgattctttctaggatctttttttttttggtgaatcagcactttcttgtttctttgctcgcgcttggtagctgctggagggaattcatcctgggtgctgtagtggtccagtgtgttagactcatagcaaatgctgtaatcaaacatatatcatgctgtccaagtgtccattgaaggctttgcattttgtttctaagtgaacgttttcctcaattcagtgctactgtggtatgataaaagaaatctagaaagaatctatttttatggaagaagttttagtaaaaaatatttccgctcttatactcatcacttgacattttcaggacaaagttggctcatggaatgctctctggcaaatactctgtgccaaatcaggaggtaagaatttgtttgtatatttgcctgttgttacgctttgtgttgttggtagttacctacttaccttagcaattttgtttgtttcagtaatggttcaatcttcgagtagactgctttcttgttttattttggatatgtgcacaaattacagcttcttaattctctgacaaatatggtccctatttgggtgggcaagtcctctcaagtctcaactgatatacaaaacctgcctgcatttaactgtgtgcgagaacttggaagttggaatattccttttctgtagcataaattgtgactcaagtcaaattctaaggaagctttaattcctaaatgtgctacacacagcttcctgctatcaaacatggtgtaaacatggaatcctacccacatgtttggaagtttaatactattgtggatttcaactcagccaatattcactgattggatgcacaaattctttaacttctattccttcaattctatgcaattttaaccactggtcactttcaatatgaatcgagaccctgtctggaataatggaattactcacgatatagttcaatcctatggaatctgaaaatgtttggcgttcctaacagggcccaaggtcgggagtaccatatacttactatacctgctaagttttctgatacataatgtgatcagcagatctcattttgatcctattctcattttttgatacttacagcctgaatagaacttttggacac

SEQ ID NO: 11417 - DNA, 12855 bp, Oryza sativa
ttttacagggttcaaattcttcattgaggagcgtcttcaatgcccttctggaaaagtctcctataacaaacgttctgactacattctttctttgaacataccgttacatgaagctactaacaaaggtgactttaaaacctttttccctgttgtattataaagttagtgcatatatccttgacacctgtgagatatgcagagcagctagaagcatttcatgagaagaaagctgcaatggatttggatggaaaggaagtgtaagttgttcatagctcatgcactgtctaatgagcacgacttatgtttcactttgcttccataaaacaggtctaatgaggaaattgtgaggcctagagtcccactggaggcatgcttagcaagtttttcaggcgcggaggaagtgcctgaattttacagcactgcattgaattcaaagacaacagcaattaagtatgcatatcttcattgccatttggttctattatatacatggaaatgtggtacagccttattgattgaataagaaatatttcaaaatgcaagcaaactcatatctgtggcatgttcagtttgtaaaagactgaatctctcaaacttgccttatatgtaacttggctagctgtaattcaactcaatatagcagatgaaatgtaatgcctgagcaattcaacattaacacattactgtgactgggtgtactgctataatttagtcgtactatcttaagaccattaccgagacacttaatagggaacttccagtccttgtttttttaatttctcagtgtgaggtgtcatgaccttggtttttatttttgaacatgattcctctgcttatttagtctcctggatcattcacaatgttttgtttcaacattgtccttgtgtgcaaatagtaaaatggtatgttcattatagttttagtataggtctgtttaatgatgtggaaacaggagatggcttcttactaacacattatataacttgttggttttcaggactgctggctttaaaacatttcctgattacctggtgttgcagatgcgcaagtttgtaatggaagcaggatgggtgccaaagaaactaggtaatgtccctatcaagtgtcagttgtctctcatgtgtgctgactctagattcgaatagttgccccaaactgtatggcggactgatttcctgaaagaactagcactctagcagtacctatccatatgatgacctatattcttcgtattttctggcccagtaaactttttatcccataattcatgttgatagaagttgattggaatgaggctttattaccagcgaatgatattccctccattttttaatagatgatgccgttgacttttgaacacatgtttgatcattcgtcttattcaaaaattttatgcaaatatataatatataaaccatgcttaatgtactttgagtgataaaacaactcacaacgaaataaattataatggtcaaacgtgtaacaaaaagtcaacggcttcatctatttaaaaagggaggtagtgtgatgtaacacatcgcattgtttgatgtactctgtctccaacaaacaataattttgaagtaatcctataatttggcaggaataacaactaggctttacttctaagttcttagtatttcacttctcctgtttgagaaattttggaacctgagctggtttcgtggtgcatacactccctccatcccaaaatataacaacttctagccttcaatatttgtcccaaatataacaacttctccacctacattctcttctcaaccagccacaatcttccaccattcaaattctctacctacctcctcttctcaaccaatcacagccttctcccatttagttccactttcataataaccgagtccaacgtactccttatattttgggacgtaggtagtaactaagtttccatgtagacagtaattcagtttcttttcaccatatttggtcatttgttgtcttgagtcttgacattgaatttcccctcagatgtatacgtagatgtgccagatataattgatatctcgcacatgcgcagcaaaggcatacagcctggtgaagagctactacctgaaggaggttagactgttgtttattagattttcaacttgatcagattttcccgattgactttgctgactgcaacatattcttgcagcttctggtgataacaaagctgaacctgttcatcctgttgccagtgaggacattgtatctcagctggcaagcatggggttcaattatcttcattgccagaaagctgctattagtacatcaaacacaggagttgaggaggcgatgaattggcttctctcacacatggatgatccaggtcagtatacaaacagaaatgttacatattacttctttgtcatcatgaaaggatgattggccgtcttgtaatttgtaacttgaccgctacaaactttaatcacctttctgctatacagatatcaacgatccaatatctaaagattcacaggctgctgaacaaactgttgatgaaactagcgttcaaactcttgtttccttcggatttcaagaagatgttgctcgaaaggccttggcagcttctgtaataatcttctgtttttaatttcatccatgatagttgatcttttacattttcttgtacagttcgcaatgttgaatacctctcagaaagttgatatttgcttattttcatataatgacctttcaaaactgtcttagggtgttcctttcccgttgtctgcaaccaacctttttgatcggaggcttatgttttgtacttctaatgtgatagggtggaaatatcgagagagcaacagactggatttttagccaccctgaggcttttagctcagtacctactgattcttcaacaagcaatatggaagatgatgatgcacacataccagatggaagtggcagtaagtttttctaccccttctgttttactgtttctagtgccaagcttccaatctcatgagctaatttcattaacattctgaactgttaatgttgaatttgtagtttgcaacatttgaaagatgactttgtacatgccctgagcatttctgaataacgatggcacattatcgtcaagaaatggatgtggatttacaattatatgacccatgtcccatctaagtttccaagaaaacttacttttttaatttttttttcttttaagatatatgtaaagaaatccatggtagtgaatgattagccaaaccatataaaagtaagctccaaacttgtctcagactgtaggtgtttccaaaccattgggttcaatacttctagatggttgattatctatcttcagtatgtgtgtgtgttttgcagttcttggtttattaacattgctctatgctctgcaggatacaaattgatggcgtttgtgagccatatgggcacctctacccattgtgggcactacgttgcccatgtcctcaaagacgggaggtgggtaatattcaatgatagtaaggttgctgcctctgtcgacttgcccaaggatatgggatacctgtatttctttcaaaggatataaagcattagcagctgaaagacttcacaggcaagaaatacattcgctcgctgacttgagtcttagttatgggcacctatgatcaaaagcacggcggatagtcggtgaacttgcatgcagatggacttagagcgagtgttggtcacatcctgtcgtgctgactttagactgatcgatcagctgggatatcactttgttccatggcattatgcattggcacattcaattcttctttgtcgatctatcatcttagcgttaacattctgccatgaaaactttggactggctcaactttttacatatgaaatggaaaacaaaaggcaagggacggtccctgatgccgcatatatattttgcacattgtagcagagcgctgggtgttaaaagattggtcctggacaccaacaccaagcatccccttcgccatctctccttgccccttgcccttcttacctggtgagtttttcattatacccttgtgtcctctgctatatcatatgcgtatacaacatacttgtagaagatactcctaagagatgagcactgctggtgtctggttggctggctgttctacttgtctgtccccgcccattttgatttgacggcgtggccgatcgagaggcagtgctgggcgacacgatcgcgcacatgccggggggccatttggcacggttggctgtcccctgcgccggcgacgcccacaccatgtctctgtcgccggccggggcccgggccctcccacatcggctggcggcggggcagcagccacctcatgccgtgcacacgccgctgtcagaatcgcaccccctctatctcatctcatctcatcttgggcccagctcatctctgtcttgggcctcctgtctcgtgctgcttcttgtcgcctgccttcttgcctacccatgcatccatgccttctccaaaccaaaagcgtatactcccttttcgtaaaattagacttcgtgcgacgttggaactcttgcccaattaaaaccttccgcttcacattgtccacaacctcaccacattgtaattctcacagcctcttcatcatggtaattccaatgagagtcactcgcctatacgtaattcgttggtgacgatgtcttctctgccaagggttagccgagtttggggatatggtcgcacgcctcacattacacgtgctcaatgcaagccaccgacgcatttgcgatacacatcaccttggtcacccctcacccgttaaaattgagataggcaagagccacggctttaattgcaccggctagttgttcacttgttcgggccggcgtctacatgtcatctgtctccatcaacgttgtcgtcgcagcagtgggttcatgtcacggtcactcgcctggatgcgtgctagtgactgcaatcacatgcacaccttgcgtcatgctttacaaaaccgtacggtaaccttttcagtttttaaaatcatggtataccgtgtggttaccgtgataaccgccaaaccgtggcgtggcgtggcggtaaccccaccctaaacaatttggtaaaccttggcttgtgtcatctgtctcaaaatatatcaacttcgagcgttaagaatttattttaaaatataacaatttcatgctcttatttcaactaatcacagtagtctcttatttaatttcccggttttgaccaatttcaatgtctcttatttaatttcgcatattttgttaatacaagtacaaaacaaatatgcaagtacaaaacaattgtacattagaaatgcggatattttgggaaggagggaccgagggagtagtactggtaattaaaatcttcgggttgcttgggctgtcatcgttgcgacccagctgctagttgtcatctgaagcaacccttttttcccagcattccgtgcctgtccagcttcagctttccaaccgccatgggcctcacgctgttcgatcgacaaacataatgtagatggagacgtacatatatctgtttgacgaagactaattaacactagttgacccaggcttaagctaatcaaccacccaatcagttcaaaacacgcaagccacatacgtgtggtgtctgatccgagcacgtagtagctgctgctgctgctgctgctgcaactttagacatattaatgctgacaatgctgggtaactgaagcttttgttcgatgtttttggtttgtccaacgctattagcatgtgcttaattaatcgtgtagtcagccagtaggctacgtgtccatgtcgttggctcgatctgcctgcgtgtgtgtaccaacactaggacaaaccaacactaggacgattaattctaaggtgtgttttggtcctttttgagacagcttcctttatgaggtccatctgaaggctgccaactgtagtcagccattgtttttttttctttttttttttaaaaaaacttgtagtcagtcgtgattcgaatttaagacctctaggcttgatatgcatctggctgacacaaaataattgcagttttcacgtcagctgtagtattgtattgaaatataagtgaattgctcgtcttttcttgtcatcttaatattcaagatgaactagatcggtacatgcaactctataatttgcaaactcattattgtgcagtcaccctgctagaaacaagtagagcagcaggtaggaaccactctagtatgtgtccattgcattgcatgcatgcagtgacctacagtatgatgcaagttcatctttttggaatttgtgtcagttccatttgtatgcatacactgttttctttctgccactgataagcactgctcgttgaaaagtacatcccaaattataagaatcttttttatacgtcttcaattatatattttgattattaatttattttattttatgctctccacgaatatgaaattagtatcacatgaaaatattttaaaatatgaatatagtgatataacattcataatacttagcctatatatgattagtatgcttactagttaaaagttgtcaaaaattatcaagtttgattttccttaaaaagagtgtcttataatttgggatggatggagtagtagtattgtgcagtactccctacatactcgtaaaagaagtcgtttaggacagcgacacgagtctccaaaacataactttgacttcttttttctataaaaatatttattgaaaagtgatatatgtatacttttatgaaagtatttttcaagacaaatctattcatataatttttatattttcaaactcaacaactttattcatgatttatattccaaggtttgacttaaacattgtcctaaacggctttatttatgagtatgctttagagcacccgcaatggtaaagtaaggtgttatctataaaacatgtacatctcagcaatagactagattaatagtaaatcatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatatagagcctatagataaccattgtgggtacccttatgagtatgcagggagtactcctgcatgagaggcgaacacaataatgattcactgcatgtctctgcatccattccaaggagggtagataacccaatactgtatcgggcattgtcattggattgcattgctttgctactagctagcatagcaagcccagccccagccctgcaacattcagatgttcagaacggcatctgcatctgcattacatgcatgatgcagctttccccagtgcaatggagttgatgatggctctcgaccagccagctatcagcagcagctgcagctagcagcatccggcactgttccttccatcgctaaccacctgactgttcatctatggatgatcatatccgatccccatcttgtttggaatgtacagtttgtatatctgaatctgatagattgatctggagccaaaaccaacatacagtagctgtagcattacacatcaacaccactgtccccctgcagtagcactgttgcttagcctagctagctgcagctgccggtgccccccaacctgactgattaaacatcgatgatattatccctgtccctcccggccaacccttctgcagtgaaaaggccatgccatggattctagctagagtacctcgctagctaccaagatcaagccattcatgcatgctgtctgcattatggagtggattgaataatactattagttttcgaggatttttgtcggaatcgaactggttcatgtgaaaatcctgtaagattcctgaaggagaggctttagtctatcacatccttttgtttctttggagaggatcgatgttatcctgggaattaaacgctggaccaggttggtggatcaacattaatcagaagttcagaacagaggagcattatggagtggatcatcatgtatgcactcagcatatgccaattcagataatttcagagaccattacgcttttgccgtgctgggtgatcgatcgaaatcatggttgtgtgtgtcatctgccatatgatcgtgccagaaaaccctgatcctgggtggtcctctttggggtcgcagctcatcttgttcatggccaaaggtagaagaaagaggagagatctagagttattattactgcgtcgccattaactgcgcgtggtgattaagaagaaatcaatgtgcctcgtttgtcctcccgtcttaattgtgaaatttacggccgtatttacacaccggcaatgtgtatgtattgctgactgtcatggtcagtcacacacacacacacacaaagaacagtagacaacgacgatggcatcaaagtggcagcaacttcttttactgtttctgaaccaccatccttttacagcttgaaaaggagaataattcaacgtgaaaccatctctccctgtttcattccagctagcagtctgtctgccgttgtatttgcatcgtggtttttagtgagatgtcaaataccgctggacgatgcttgggagaggtcaaatcccagcctctgcatcgcgagatgcacataaccagccagtagttagattcgttcgggctctaaaagttatttttggctccgttatactaaagccaaccaatagatatcaaatacttaatgcagttagatttatctgggctctaaaagtttactcggttctgtcacgacaaccagcgtcatatcgtttcgatcgtttgtagttagatttatccgggctctaaaagttcactcggttttgccacaacaactagcgttatgtcgtttgtagttagatttgtccggactctaaaagtttactcggttttgccaccataactaacgttatatcatcttgtagttagatttgtccgggctctaaaatctttctaggttccgccacgacagccagtgccatgtcgtcgcgcctggctgtcgttggcggagtagagctcactccatctccagcatcctatcctacccttctactggttttgagctttgaggcagggttgagttgcgtgtgctcgaggcggccggccggccatcgttatcctccatgtggtgtcacaccatgaaaccaagcagcaatccaaattcccaatccggcacaaacaccttcatgcgaaaaacgggatagctactactacttgctactaatggtaggagactatgatcttttccagggagtaattaattgcacgtttgtacgagtgccatattgtggatttttttaaaaggtttatatatatattcaggcccggattggttggttccagatgaggttcagtaaagatcagaaagcgaagattaacctgcaaagaaatcatcatatatccggtttttcacccatatccatcttgccttacacatggttgcacctcctccttacaagtgttccaacctagctcccttccatacctctagctttcaccatggcacctgaactacaactacatgcatataaatccagccacgcgactctccgcgtggcggatccaggaattttctagagcctagacaaatactacacgcggattccggtttacggatagtgttagataatgaagcccggaaaaatacaggccatatatcacagtggcgcgactcgctggcgagcctagttggcatgcctactctgcaagaagataacaacaaatcgttgtctgaaaaaagatgataaaaaaaatggagatgaggagatgaaaaatgaggtggcaatggcaaaatgccgcgggcgccgtcggtgtccggggctccggctcgcccggccggcgtactgtggaggtcgcggtgcctgtccgggctccgggtagacagaaaggccccaatggagcccgccgtatctgctctgctacacctacccatccatgtcaccatccatagatagacgatggcgacgaagacggtgagctctttattatataattttatttatgttttcttgaggggagaagtttgattgatccaaatttgatcgaaaaccgacggttttttaatttctttgctgtgcagggatgcgtgcggatcaaaaataaaaaatcggtggcattaattcttggaattgattcactggacggacagtgaatattgcatgcaacaactgatcatcccctgcaatggcttaatattgccctgtgttcagtgacttggctgccgtgctgcatgccagctatggagggagagagatgaaatgaaatgatctcaatgggaggaagagaatgatgccgagaaattaaaatctctcttgtgttcatgcattcaatttgcttctgcacatgctcattcactcatccagtcagtcgctcactcactcactgggctcagtgacctagctttgctactactagctcactcatcattctctttgcttccttcaccaaacttcagatttccagtcccctggattggcttcctctgcaaccatcacataaatttcctctgcctccatgtctgtactgactgcctctctaactactcagcttttgtgtgtgtgatggagatagagatggcatctgatttggcattggcactagtagtactttgtactagatttgcttgcaagttgcagcctctgaaaatctgaatgttagttgaggaggcctggccctgtgtcctaactcctaatgcacatatgcatggcatcttctctggttttgcatcattcattcatgcatgcatgcatgcaaatgagggggtagtagtcagtagatcatagatgtgtccaggctgaaatgcaaaaagtaaaaagggatccctgcagagatctccaatttctttcactctttcagaacaaaaggggctcccttgtggccttgtgcttgcaggaaaagcccaaaccctgcatctttcaggctcttgccccacatgtattatgtacatgattcgtaaacacacagctagcacatagtgttcccggcataaaaaaaagaaaaaaaaagaaaaaaagaaaaaaaaagaagctagcacatagtgtagccctgtttcgaggagcttctcggagccatggcttctctcgaaatcttcgactccctcaaacagaatcctaattaattctttaacaaaattccaagaatttatagttgtaaaatctaaaaaaataaactagaaatcaggaaatacaaaatccagtttagttttactttttcagattcattcattcatacaaaatccagctagctactcatcttagctgcttctcagaatttcgagcttccctgaacatataaccatgtactatttcttgcttgttcttctcttcttctacatcttgcattgtatccgtgtggatcatgcatgcattgtctggcccatctggtttgttaacttgttgagagcatgcttgcttgcacaacagtacaaagccagatgtgtcctacaaagttgcagacttgtagctgcactagcttacacatccatggcctattccactgtaggaatataaatatacatacacacacacatctatacaaatacatgtctagctatactagctagtggttctcatcacttgcatatatacatacatgccagtacaggatcaggttcaattgcttaaattgtacaagttcctatcattgaccagcctggctatagcttagctcgagccaaaatgccaaacagattagtttaatcaattagatgcataactaactaataatcagtaacgacaagcttgcagcaacaaaacaaagcacttaatcagcagccagggtacaactagaagagacaacacagcatgtccttttcgttttcttttccttcttcttcgatcctcttctctcttgcttgaagatcttgattctttttctacatctagataaaattaagcctaaccaataattaattaaccacactttttttttcagttctgaaatcagaataataatcttaattattgcatgcttaattagattaattaattaattaattatctccatctagctgtctgcttctctgctcttgtaattcttgcagctgcagatgctagctttgcatgcatgcatgcaaaccattttgcatggaggaaaccttaaacacaagtaccaccattttctcttctttttttttttgctctattaattgtttctttttttttttgcgtgagatcgaggtagctagtagctatagcttatgcgtggacgtcggcggcggcggcgacgtcgtcgtgttcgtcggcggcggccgcggcgtcggtgaagaccatcttgagggcggagccgccggtggcgaaggccttcttgcggacggccatgtactccggccacgtgacagcgcggtaggcggggctccggccggccggcacggcctccggcagcggcgccacctcggcgtccggcggcgggccgaggaagtagccgagcgagacccggtcgcggtcgcggttcacgacggcgcggtggtagacgctgtggaagcggccgttggtgaggatgtggaagaggtcaccgacgttgacgacgaaggcccccgccaccgccggcaccgccacccaccggtcgggccctcgacggaacagctgcagccccgggacgaggctctggagcacgaaggtgaagaagcccgagtccgtgtgcgcgatgagccccagcgctcgccgcggctccgggcacctcgggtaccagttgaggtgcaccgtcgccgtcatcctctcgccgatcctcctctccgcctcgactccggcgacctcctcgccggtgagccccagcgccctcaagaacaacctcagcaactcgtcggctagccgccgcatctccttgtgaaactcctc

SEQ ID NO: 11418 - DNA, 3203 bp, Oryza sativa
  unsure (1)..(3203): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgccgatgttcgcccacgtgtgatatgaacatgtacagttgtctcctactacttttggttccttgatgatgctgagttgagaaaaaggttgtagtttcgttactcgtctgtagtctctccatatatagataatgaagcactgaagcttgaaatatacacctacagtttgtctctttatgaataagaccatatacgcaaaaaaaccgatgttctttgctgcggctcgcgtgtcgtcaggctatatgcagttttttgtcgcaccataggcgatggacatctctggccttatactttcgtaaaaatcttatcatgttaagcgatggtcttgctttggagttcatagttctgtgctctatgatgtgcaatcagcttggtgttcatctatatataatcttttgctgctgtattctggttattgtactaagttgtaactgacgaaatgatctcttggatgttagtgtcttcgctgattgatatgagctcgtatctattgctgctgcattctggtttctgtaacgaacaaaatagtttgttggtgaggctgaaaaacgttattggaatgttcagtgttttactctgaatcatatgtgaacatatcagatgtgttagtctgaaaaaagagcaataattgttcagttgaaaaaggatgatggattcatggatgagcttaccctaccccgggccatgttcttccatggacgctttggacagaaaagaagaacagataagatcagatcatcgaacgacaggtcaccgtcgtcgttaaggacggcggcgaggtcgctgtcaaaactcgcctgctttttccacaagatgggccatggcgtgacctcaccggccggagatggtcgccggcggcggcgacggatcgacgactacggttgctcaattttctttgctattttttgtgcatgggtgagaagaaaacgacctctctgatccatgtcggcctatactgcggcggcaaccgtcgtttcttcatttgttttctgcttcgagaaagcgatgctacatggacttgtggtggtataaaattagaaattataaatctgatcttaattatttaagttgttgcgagagggcatatatacacctgcatagcacttcaagatttcgagtttaaatcttatatcttgatggatatggagaatttcaaattgagttatttgagagagtaagttaccactttaaatggctgtatatattcaattcgatgtagaggataggtaaaaaataccattgtttataaaaaataaaaaagttatgagttgttaactgcaggctccgttatttggaacttggtcctgaacattagtctctttgataaacatagtatttgacgtttaggataaaattcggacacttttacaatccaaccatcattaattccttatattttagttttttaaaaaatattatgcggagaactgttttgaaaagcactctcgtaatgtcataaacttattaatattcgtacaatccttttagtataaaattgattgttagaaatcttaaagtttgactaaatattactctaaacatcaaatttttatgactaatgctgaatcttttttattgcgtgatactcaatggtttaaaagttctgtatcttttcaccttggggcgaagaaaagtttggaggacttcatgcttactcaagctacagtttattagaggagatgattagggatttggaatgtccatggtcaaacatacccatcatttgattagagagaaaacaatgaacgaattgaccacaatttctcatcaagtggatatttcatatttgcgcggaggaaaaaacatgatctaactattttacgtggagcaccatctatgataggttaattgtttctctatctggattctatggcaacgctacataccctctgtttccctccacaaataatgtccttcaaatttaccatcagaatctactgctctctctgtttaaaaaagaaaccaatttagatgggatgtgattctacccaaaactttttatccagattcgttattttatgtagagtcatactccttccagcctaaaaaaaaactaatctagttgggggatgtgatccttaataggagaatgaatcttgactatcttaggttgagtttttttttgaaacggaggaagtacacatctatgggtgtgtttagttcacgccaaaattgaaagtttgattgaaattgaaacgatgtgacggaaaagttgaaagtttatgtgtgtaggaaagttgatgttataaaaaagttagaagtttgaagaaaaagtttggaactaaacacggcctatattattttttctaataccgagggattacaatgcagcaacgaatttaaaacacgaattaaactacacgaaacggaaatgacacgacatttctcgaccgttacacccgatttcccaattatcccctcccaaaacggaagcaataaaaaaaaagaaagagagagaaaaaaaagccgtaacatccaacggctacgattccccggtccccatgatcggacggccgagatgatccggcgcgcaacgcgcatgcgcgttgccagtgaccaccaccccccgtcctctccaaaacgccaaaaatttttcccccactgctccccactgctttcccctcctcctccccgcgagatcccatccatggtggccgcctcccgcccccggatctggccctgacgaggccgccattgccggatatttttggccctcctgccatttcctgaggtgtcctgtcgtttcccctttttcttttttcttttttggcccatttcttgtgaggtgctttctttgggttgggttcttgatccgtcgcatttcgcgcctggcactcggcgatccgttcttgcgatcccccgcacgttgcaagcgcggatttgttgtaaatattaaaatttttttttgttgtgatttgcggcgtcgtgttcttggtgctggctggcaatggtggtttgat

SEQ ID NO: 11419 - DNA, 23676 bp, Oryza sativa
  unsure (1)..(23676): unsure at all n locations
gccgccggccgccgcgggcgccgaggggaggtccagggagcaggcattcgtccagaacgtgaacatctgctgcgcggtgttcgacttctccgcccgcgggaaggacaccaccgagaaggagcggaagcggcaggtgctcatgtcgctcgtcgactgcgtcggcgccgccgaggagcccctcacggaggcgatgatcgcggcgagcgtgcgcatgttcgccgccaacctcttccgggtgttcccgcccaaggcgaggtcgggccccgcggcgtcggagacggaggaggacgagccgttcttcgacccctcgtggtaccacctccaagtcgtgtatgaattgctcctccggttcgtgacgtcgccgatggtggacgcgaaggcggcccggaagtatgtcgacagctcgttcatctcgcggctgctggatctcttcgattccgatgaccccagagagagggacagcttgaagacagtgttgcataggatatacggcaagttcatggggaatcggccgttcattcgtaaggccgtcagcaatatcttctataggttcgtgttcgagacggaatcatcacaacgggatagcggagctgttggaggtgtttggcagtgtgataagcgggtttgcgaagccattgaaggaagagcacaagttgttcctatggaaagcgttgatcccgcttcacaagccaaagacggtgggtgtgtatcttccgcagctgacgtactgcatcacacagttcatcgagaaggaaaccaagcttgcagggactgtaatcagaggcctgctgaagtactggccagttacaaacagtcagaaggagatgatgttcttgggggagttggaggaggtgctcgagttgaccgacatggctgagtttcagaaatgcatggtaccgctgttccgcaggattgcaagttgcctgaatagctctcactttcaagtaagttcctttccaaattcagaactttaatttgaattaggtatcgattaatgtttgttcatgaattgtttctcttctgtgtatcacgctctgcatttatgtttgcaactatcctgtcctaaacatctgaattgcttcatgaagtagttgcaaagctgtttatcagtggaatctaattcttattttaatccgagaatcgctttgggatctctttcctttttctctgtgctttttctagtatattagtgttacctacacggtccccttcacctttttatgacagtcattattgagaagatatctcagcagtaggtaaactttctctgtgttggctaaagtgagaccatacacacttcttgttcactcaagcacaattggtggcctctaacacttccctttggtaggcttcagaccattgttaattaagtatacaactggagctgaaagtagtttaaattatatagttctgctgtgcatcttggctcatgaaccatgacaagaatcaattaggttaggtacaattctaattcccattgtcattccatttgatttatggaacaactaatgacagtcactctccccattatggaccctaattttctattatctactgatattctatttttctggcatatgctgttagagctgataaaacctttcatcggtaagttaaacgtttttacttcttgaataagagagggcccttaggagttaggactgaaacatgaccagagctgtgatagcactgcagtctgcggtcttcatcttttaattcttgaccatgttaaaatttctcttcccgaaaaagaagttgcccaggaaactaaagatctgattttaattatgggcaggttgctgagagagccttattcttgtggaacaacgagcacttgttcgatatgatctcccaaaatcgtcaggtgatcctaccgatcatatatccagctctggagaggaacacccgttggcactggaatcagtcggtcctcaatgttaccctgaatgtcaagaaaatgttcttggacatggacgagagattgctcctggcctgccagaacaacttccaagcggaagaagagaagcgagccgcgaccgaggagcggcgaaggctgatgtgggagcagctggagcggaatgccgctgcggcatgccatccacatccagtgatcaccactactgactcaagctttccttcacccccttcatcaactcctctggtagctcccactgtgacatgacatgtggatcaaatatactccatttccacttatttgttagctagctagatgatgatgaagttgcttgcttctcctgggactatacagaaggcattttgttaccttcgtaaggcccccccatgtcaaagtctgtaattaatagttgatggtttgaggacaaaatgacacttgattttttcttctttttttgtggtgtattctcgagtaatgggcattgctttctaggcaaaatctttgattggttcatcctgagtgagtgatctgtcaaagtgtggacaacaatgatttttgtgtgagagaaatgacaagtttgcagccgttctttgtggctaagaacttctgtctatttttaacaggcacatttttagctacagtgtaataatatcagatgcacttgtatagaaacaaaaagggcttcgggaacagcttaaacaaattgatttgttatttctgttcaatggactatatctggatggattctatggagaagaaaacaagagtagctgagatttcagaagaaataaaaaacatctctttcaacatttgttgtaggttatctgcctggtcttttcaagtacttttctttgctaaaccacatgagaagcatctcttcaaaaagaggactaactgaaacattgacaaaacaagatttgttgctcaaatcaaacctaaaacaaataatagaagaaaatgatggcaaggacaagtatactccctgacgtcaaactaacacatacataatcttctggaaattatctaggcccatctctgatgcgcctacacttgaacttttttaagattggaaatggtttataatcctacacttgaatgctgtacattagcagcctaacggattgatacatctggttacaaatgtgcactacatattgtgttattcaaagcacggattcagtcgtcctgtctccttgagtatggataccacgctgctggaattcaagtaagaattccttgacaagtgtgtaccagacgctgttaaataaatatttagcacccacaattatgcttaggtggataaactgctcgaatctcgattacctgcctagtggccgcaattattggcccttaattgtgaggttaatccgtggccattttgacagcttgagtttcacaaaaaaatagcactaccggttttaattgttaacttaagaaataatatttgatcattcgtctatataagtactatttattttagtgttactttttctattatcaaatgcactttaagcataacttatattttacattttatgctaaatttttaaacaaaatgaattgtcaaacgtcattatctaaaaatcaatatcgtcatatatttaaagacataataagagtatagtttttaaaaggatttgaagaaattccagcgttccaaacagagattcatcagtggagttatctaccagtgttcatgtctactagggaaggtcgcagtttgacgtgtttccaagtgatatgttttcagttcagacctgagctgagtttccttataaaaggaagcctcaagctgggcatcatgtgacccatgctctgttagtgccttctgtctatctatcccccttgctggtttcttcctcctcttctgcgtcgtcgacttcgtctccggcggccgcggcacgggcggcgatgtacaaccctccggcggcgcaggagatgtcctactccgaccatgtcaagaagcgccatgaggacaaaggctgcctctatgcatggtgatcctcttcttctgtcatgctcttctaatctttcagagaagctgttgatgctattttatgttgcttattaatttggatgtcatctaaactaggttatattctctagattaggatgtgatctaaggtatttttcaaagtagaaattaggacatgtttgttcatcttggatgcactgttcaacatttctcaaatcatcagatagttcatctagtttcttcagacaagctgatttctgcatcatgtgagcattgaacacactcctaaagtcctactagattcagagatggatgagctgaagtagttagtggtcattttcatgtccaagaaaaccaaagatcatgtgagattttgccctgatcaagagggcttcttcaccatttgacaccttttttcctctgtttacctgtgatctctttccctttttgttgcagcctgttcaccctctgctgctgcttctgctgctacgagacctgcgagtgctgcctcgaatgcctctgctgctgctgatctccttatctcatttcagcagtcaaaataatgatgatgatatatcatatatagtcaggaataaaagatataatatgccgtttgaaatgcaggaatttatttttccgatttcaaaccatagtttgttgttgtatgtgtactggtgacaatatcatggtagatgaaactttctgaaaatttggtaggtatcagcaagatttgatctttttagttgtgctcccatctataaaatgaataaatatatttaagctgcctgccgagataaaattattaatcagaccgtaacaagcatccaactaatataacaatgggataacgtatattgtacaaatgggatgttcatgacaaagcgcacacatttctgatacaaagaaagatttctctattcaatgcgacatctgtattaagatcactagagctgaatctatccatacaaaaattggattctgtgtgaaaaattgctaaaacaacagttgcaactattgttaggaatgcccagaaagaagcaactgtcataagattttctgtctgaatttcatcagttgtattgtatgagaacctgtgatgtgttgctactgcctctaccactactctacacaactaagacctcagaagatgtatacgcacgccaatgcagtgatcagagtagtcaagaacacagaaactacattgacaccattgttgtccagtatattccgtcctgaaatcctggtgaccgtcggaccgtctactccaaccacctgcataaacaaaattcagaagcaataaaaagaaaaaatcaacttctgattcaaaggcaactagggtatatagacatctaataacatcaattgcagaaagcaccatacctttttacgaagactacagtacccactgtactggagtgttgcgcccagcaacgaatcgatcagacttccacataggccagctgctgtagctaagggtataaccagcagctgcctccagaatacatcagaagaacactgagtggttaagaatcctagtagcacaaatgtaagcccaatcgagaatccagcagccgctgctgcgagaagtccatcaatggttaccccgccattggtacccttccgtactctctggtgaagttccatgtcaaaagcaacagtgattatatgtactgatatttctctaattggtaaaagaggaaaatgcaatgtttaccttgaatgttgtgataattcgtggttccgctttgctgagaatgccgagctcagaagaccatgtatcaccattgcagcaagcataatgtccaataacaccaccaatgagggcagttacaagactagattctctcgtatccaagcacctatcgctccctcctgtgacaagtgctatcaaaactaccaagacacttgcaatgccactgtttgacaaaacttgcttcctgccaataagagtggtgtgcacctgcattagaaagattcagaagggtactttctgaaactgaaaggcatcttattcatctcaataacggtgacaacagtccttaaactttggatcccttttaaataggtgattctttttcctttgaaaaatgcctcttggataaatttgggagaaaatacaacaagacaaacttcatgaaaaatgggattgcgttccgagttgaatcttgaaaggaagtaggcatacctcaagttaataaggacaatttgaacagtttaaacagtttcaaatgttgtcaaactacatacttcatcatcaaatcgagctcatttttatttttcacaatttaaactataccgagccagcgaacatggtagctgtacacactacagaaacatcacatgaatcacttaaatctaactcaacgaaccccaactttttatcatatagcagcactatgaggccctcaattcccttgttgcacaaataaatcgcatatatgttctaccagatagctattttgcctttctagagatttaccacattcccctactctactacaatcagaaccaaaatctgaagcttccactctgaatgtaaacctgccaattataccaaaagccacagcgcaatctcaaacatgtccgaggcctctctgatctctacgatattaatttcagatttcacatcattctctatttttcttggtcaccatcggaacaagaaaagaagaagaagaagaagaacagagaccatcttcttactcaccagttgcgctgccctccttccttgaagtcgggatcaagcgcgcgcttcctcttctcgccgaccctcgtcatccgcgacgccgtgaagaagaacaccagcagcatccccgcgaacctacgatgatgattcgtctcaaaaaaatcacatcagaaacaggatttttttatcaataatattttttttaaaaaaaagagaaattagccgccctttcacctgtacccagcgacggtgtgggccaccatggccggaacgccgacgaacaccgcggtggagtcgacggacttgcgccgcaccgcgcgcgccgcgatggcgccgcccgccgccaccgccaccgccgcccggatccaaactcctccgcctcctccgccgccgtgatccattgccggcgacctccacctcaccaaaccggatcgcgcacagcagcgaagaacaccaaaaaggaatcgatcaaaccactcgcgaacggaacggatatggatctcctcctctcctcctccaactccaagccagtgcagccgacacacgctactactactactgacgcccgcaaaagatacgaagcctttttccgcctcgaggcgaaggcgcgtgctccggtgtagaaattggcggccgaccagatgcttcgggaggatcgccggcgagccggcggcggtgggctcgccggaatcgcgcaggtgaaggtgaagcggaggtaggagagaagaaataagcgtgagatctgacgaaagcttgatgcttttctctcacgcgagtcgcgagagacttgtatttgtaagcgtgttgcatcgaatcgatgggcctgatcctacccgttcatctcctgaggacgcatcacagccgtacaaacatttttcgtgcacccatccaacggtccaggtcggggcagaatcccaatcctgatggtaagatagtcttgtaattcttttttttttgagaggtgatagtcttgtaattctagattatattctgcttaaaaaaacactaataatgttcagaatttcaaaaaaaaaaataaagaagaaataaggttgcgttgggcaaatcccaatcctgatagtaagatagtctggtaattctaaatcatattcttattaaaaaaacactaataatgttctgaatttcaaaaaaggaaaaatgtaaggttgtgtttggcagggctctagatctcatatttatggtacatttgaagtttgtatattaaattatattgttttaaaattttaaatttcatctaaaataggaacaaaatgatttatccaaatgttatcaacgagatcacaggtctagatctataaatttgtggagttaggaataccaagctcaaaaaaaaaaaaaagaatccatagctatgtcaaaaaagggcctaatcatatgctgattccatgcatctgtgaacaaaaaactaaaaatctatccaggatagtgtacagtacatgttgtttctgaattgagacattagcttttagctaagcatcatctgaagggaaccagaggaaagaacatgacttggtctaccacaactgctattgccactgccattggatgtttggattgggctaaaatcttcccctgcctcgccctcgccctcgtcctcggccccttcctctcccccgtcctcgccctcgaaaatctcttctcccgcctcccgtttcttcaggaccgctgaagctgaacatgctcatccgcaaacgatctgcgtctgaactctctggcactccctgcaaaatagcacaatgccatgggaatcaacattcttggaatggcggtaatggaagttttgaaacacaaaggggttctgatcagggaagttgaaccgacataggagtcttcaagatctagttgctcctggagctgccttgccagctcctcgtctcggctggtatcgtcgatgtagctttgtgctgtggacttcaaaccagcggattttcgcttctcccattcatcgagggtaaatactggagtatcttcttgcctgcctttacccttgaatctatggccccgaccatatctgtcttcgggcgcagcctgggtcattttctgcagaagcttctgtgcagtggcttggttttgaacaggaatagcttcactgactgcaacgccaaagcaaaaggtttgtaaccaactgccaccaatatactatatatataaatattttgaatggaagccaaccctcttttggtctgccatctgaaatagattgtttgggttcaactgcagactctttgttctcatcacttgaactctcattgactggtttgccactggaactaactgacacattctgacgaccgacttccggtttcctagccttattatctgctatgacataagaaaggagtccaagtggaccacaagtcacggaaacaagcaatatgaactccatatatacacaaaaaaaggaagtaatttgtatgtcaaaaacacattcacttgctaatccaaatatattgtcagcataataaccagatgcagatcaggttttccaactaaagtcatgcaaaagtgcagttcagctccatgtttttcagaataaagagtattttttatccaaataatgttatttgtttaattttgcaggacttgacaataatctccagtcagattccaacacagggaaaatcttactagtgagtaacacaactgataatcacccatattgcacccaaaaggaacaccctcgtttagaggaaatagttctgaacatcttaattcatgcatatagatttcaccaggagaatcgaattcaaacccttggtacctttatatatataacaactgccacgcataaatgccaactttacagtggacataactaagggtaaggggtgtgtgtgtgtgtgtgtgtgtgtgagagagagagagagagagagagagagaggacagaacaattaccagaataggtttgagaacgggatgtcctactaggacgtgcttcaacatctaacttctcaaatggtggaggtccaactccatcatcattttgagacaacctcaaggatgaacgagataaccctgagaatttctggttcatctgccactcttcatacaatgattggacaactccccccatgatacttatattcttcgcacttaagcacaatatgccattatgtattggaatcttgttctcaagacaaatctacatgagtcgtaaagaaggagaaaatacatgacgatgtaaaacagtcagtaaatagcaaaagcatttaggtctgaatcacggatttcaatattgtttatttgacaaggtatatattgtgtaaataatcactaagaaaatattctactgttctgtatcaaaactatgctgcagtttgctcataagcaatgattaaggatgaaactcaatagactgtaggacagagacagacagacaaacagtgggaattaggaatgctatctcccaaccccatcctgatgatgcaatataaatacaccatctctacaggtagctcttacacaaacctcatgcagcatttactaaggaggatttcagattcaatgttatcaaggagcattcttgcattttgttttccaaacattattcatgtgggatgtgtggaatagaaacacaccattgatcaatgagctatctgagcatctctccttctatttatctagttccggtgacatgggaactcaatactgaactagttaggagcctaagatgaaattcagacaaagatgaaactatgtgcagagactctgactatgtcctctaacctaaaataaagcagaatgacaaatatcagtgcacatctagaacctagatcaagaacatggtggactaaccttagtacctggagcaatatcttcaatgataaacgggattgggaaaaactctatcgctactgcttcagaaattccatcagtcagaacaaagcgcagaaggcggtgttgctgtgggttcttaaaggacgcatcaatgatgcttctatatatatctcttactgatactacctgcaaacaagtttgcattaagcagggatcaaacagtaaaaaaaaaaatccaaaacacaaggacaacagttcagctccacaaacactagatgtaggttcaatcatgatcaggaaagacaagcccatgtttcaccattgagatagacaactagacatcattgttccacagaggacgttcagatagccaccctggaacagccaagaacatctttttcatctgctcggatacaaaacccgacccatccacaaactgagaatgatacaacgcaagccccagccacatgattgaaacgatcttaagtaaggccattccctagcatccagacacaaattctcaaccttatgtccagccaagaacaccatcgtttcacaaaggcctgacacatatccatacaagaacagccaagaacatcttttcgtcagtctactcggctacaaactctggccgcttccacaatctggatacaatccccagccacagaatcaatagcagactaagaactgttcctaaatgaggcatttctttcccttattttttttaccaggaataaaattaattagaattactgagctaatatcgaaacaaaagaggggtgtcatcggaacctgtaggacgatggggccatggaggtaggaaagccgcctccccgtggcggcggcggcggcgcggtcagggagcgacttgccgccgaagagcctcaggtccacgtcgacgagctcggtctccacggcctccggcgacggcgagggggaggcgtggagtagctcctggatgatctcgttgctggggtcacggaagcaccacccgcgggcggagagggattgaaggagcctctcctgatgaggggaggccgacgaccccggcgtttccgccgccgccgccatcgcagtcggggggcgaagtgttctccggcgaggtctgggagagtgctagggtaggagacgtgaaggcgggttttgtggtatacgccatagcagttggaaagcggacatttgtggtgcttactgcttagggctttgttgtttagactaattataagtcagcttaagaaccgaaaagtctaaatctaaacaaaatattttttctggttgaatctattaatttttgataatttcagtagtgtcgtatgaatgtttggtttgatgtcaaatttcaccaacactaataccaaattgtcttgaaatcaaattagccccaaagctcaagtggatcatcaaacctggagtatcgttcagtgtcaacgtttggcagattcaaagaaaaaaaaagaaacggcatatttgtaaataaaatataatttgtgaataaaacttttatatatgtgttcttaactattaaaaacaaatgctagaaaatcttataaattcaaattttagtttataaacataaactctaaaattaaagttataaatttaaattttagtccataagcatagcgaaatgatgaatgtgaactcggaaggctgaacacagggacatgcagccgcgggcaacaagccaacaagtgctcctgcagcagggtgtgaaaaaccgccggtaaccgcgcggttaccgcggttaccgcccgtaccgcgggggtacggttacccgtaccgcgcggtacggtttaataaaattcatccaaattcaaaaatttaaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgtgcggtaaccgcgccaaaccgcgcagtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgtcctgcagtcctgctcatctgccttcactcctcctcatcgtctttttttttttttttaactccttatcgtcgtagagccctagattcgcacgaggctgaggtcccgcagcgcgagcgatccaaagatatccgaggtgacgccgtgtcatccctagttagccgagccaatttttgtttatagctgtggattacaaaatcctcttctcatctgaaacgttctcatctactatactatcttcaggttcaggttcggcctcgcttttgagcagaaagcccaaaaggtttcagcttgggaagagcaaaatgcggtgagaccagaataatagatggactgtttctactcactccgtttttctcaatgtaaattattctagcatttttaatatttatattgatgttatgaatgtggaaaatattagaataacttacaatatgaaatgaagggagtagtaaacttcatttacaaatcccattttaagacgaaatatttattttatttattttttgacaacgaatttaattcggtcaccacgaataccgcatcaatattgtgctctctgtcagatcatcagacgcaatattgtgctctctgtcctggaatctctcggccatcagttattcagttggcaggttggcagtaattttgacgaaattcgttgaagaatgatagcggtggggttaaaaacgaaatcttttcgtcctctcaccataataaagtttctctttttatttgttggtcaagccctttttgatctttttttttctgtctcatgcttatcctccaacttcgcggcgcaccctccgcaaacgtaagccaaaaagatcaggaaaagagacagaaaaatcggaataaaagagtgatagatagatagatagatactccgtagatactagatcagcagcgatttttttttcagtttttgttttttcatttcttcctctgtcttgtttagatgttggggttggtgagcccttggggggaatcagttggtgactgactcgagaagttcagaggttgttgtctccgaattctttaaccccaacctctcctcttctcttctcttctctcctcttcttccttatactgcttcttgggctcgccgctgcgctgttctttggtcttcttggatctctgaccctaacatcgtatccaacttctccagttcttgttcttggaggggtgaggaagaggaggaggaggaggtgagatgggtagcttcgggaggctggcgaggagggccgtggagacggaagcgccggtcatggtcaaggtgatggagaagaagctccctgcctcgtcgaaatcgcatctttcccttctgatttctttggtcttgattgatgagttctatctctcttgtgccttgtgctcttttttcagatgcaggaattgcttcgagggaacaaggatgtgatgtcgcttgcgcaggtatcggatcgcaatttctttcggttatctgtccaatgattgtgtgtgtgtgtgtgtgttttcatgagagtaccaatgagtttgtgttgttgttggtacttggtcacaggcattttgatgtttgcatttgattgggaagagtgttcgaaatggattagtgaaatgatcatttgtattgttcctttactgtttgggtcaattgtctcagtaaactgttcacgttgtaaggtgaatcaggagagtttagtacatctgataacatattgtgctttgtataacacaactatttatcaagcatggaatttggaaactaaaatggttgtattcctgcttagttcctgaaaatggcgtttaactgcttatgctagccaaataagatatccaaatatatatattagtggcagtggtgtgtgtgctggcctcctattactgccaacagaacatgtgatatttactggaaattatttgctttcttttaaactaatgtaaatcttggatgcagggagttgtttattggcagcctcctgaggcagctatgaataagattaaagaaattgtatgggaaccatcaatcagtaaatatggctctgatgatggtcttcctgaactccgagaagcacttctcgagaaggtaatttttcaattgggatttgttagataatggtttccatggcccatgttatcaagccttcccagttatcacaaagcaattaccatgtgagacaaatgcacttggttgcctactgctaagcctttatcatgtgagacaaaggaacctgtgtgcctactactaagcctttgtcatgtgagaaattgattctggaattttttttacctcgatactgagagagtgagagtaaggccattcccaacccaaaacattagacatagtttccataaactccacatcatcaagaaataagtactagacactactcttccaatgcaaacactactatttcatacttaaatttaatgctacttatctcacataatgtcttggatgttgtgtagaaaccatgtctcatgcaagacatagtttcctcctctttcctcatttattcacttgccacatcagttttcatcctatgtgacagcttatttaatgctatggacactatcctagtcattgggttgggaatagcctaatatcaggaatcacatgctatccttacaaaattttatcaacgagaaagtttcagaaagtatctctcagcttctgtgggggcttgggggggagggaagctaagggcccctttgaatcgtaggattgagaaaacatagtaatagaaaaaacgtaggattttgataggaatgtaagtgtaaaatagaggattacaaaacgcaggaaaaacacaggaatgaccgtttgattgaaccgcaggaaaaacgcaggatttggatgagagagatagactcaaagaaaagttactaagaggttgaagctcttgcttaatttcctccaaaatttctataggattgttcattccataggaattttaaaggattggataggattcaatcctttgattcaaaggacttcataggaaattttcctataggattgaaatcctccaaaattcctatgtttttcctccaaatcaaaggggccctaagctctgttgagagctataatagttcaatgctaccatgtaacagtgcagtagcacagttctgagacattgcccttggtactaccgatgccccctcatgtagagatgggtgttatattcactgatttctcttactgcgataatattttattgaaaaactaataatatgaatggtaattattataaacatgttcgttgccttccctctattttcttcctgaaatttttagcatacattttgcagctgcgcagagagaataagctaaccaagtcgtcaattatggttacctctggtgcaaatcaggtaatgcacatgctttccagtttccacctgatttattacagctttgtcatcttattccggttttcctctgtgtattttgccttgtttagctagactataggatgccaatttgtttttcttcttcagttctatgagatgctttcttacttttctgtatgactgcttcacctaaaccttgtttaccaactaggttagccaaataaaagtcaaataaagtgatgtcttctatcaaattttggcaggcctttgtaaatgtggtcctcaccctttgtgatgctggggatgcagttgtcatgtttgcaccatattacttcaattcctacatgtcattccagatgacaggagttactgacatattagttggtgcaagcaatcctgagactcttcatcctgatgtcggtaagatagttcttccctttttctttttgttggagaaattggttagatgtctattatcaacagtcaattataaactagttgccactttttttccgcttctgagatcttccactttgtaagttgataagttctatcacttgatacattttctctcagttcaattgagagctatatggtttttgatcattcgatttggttcacttaaggactgtaaaagaatagttcattctggtagtacaatttatatttgtttaataaaatgcagattggttggagaaggttctgcaagaaaacaaccctatccctaaacttgttagtgttgtaaatcctggaaacccctctggagctttcattccgaagccgatgctcgaagtaacctgtctctctcattcacagttcacgcacacttgcattcgaggtgactttaattatttcttaatattgcaccattgttccagagaatttcagaactgtgcagaaatgctggtgcatggcttgtagttgacaatacctatgagtaagttagtactcaattactgattattgctcaactgcaacgtcattttggtgcttcttttctttctgttgttgataaagctcctcagtcccttcagaaattgatattacttaaagcaattgtaaagacgaggcactacgaaagaatgaactacacatggacatgatcaccttaagtagtagtttaaaaggacagttcaccataagcagttgagcaactgtgcttgacttcttgaagttgagtcctggatgacgccctctctgatagattaaataaataggacttcaagaatgtggtatctctttcaaaaagtatctgcaaaccacccgccagtaagggtttgtcaaatgtagttatcttcacatgctcagcttattcaagtagggaaaatcttccatttcttctcaacactagaattggacacatggaacaactcgttttcttttgaaggtcccatttcagttcctcaatttcagtgatgcccaaaataaaccctccagtcacttacaggcagagtggaagactcactgacaagagcctaaattgaatcacggattagactcttccctcaagaaaagtcttactttcagcagcctagcatccgctgtgcggcattgggaagaatatatctgttgttagttctgatcaaatcagaaatatttgatctcttgctaatctacccttgctctatatttcagatcatgtttaccttttcttgtctggctctgtagttgagtaatggaaattgatattagtttttgccatttccttaccctgatgttgatgttaaaaggatgctatgggtccttttcgaatataagcttgatggacttcccaatgttaatacaccaccgaatttgacatgtgtaaatcttgtatatgataaaagtataatttggaaactttcaattatcatcacattgatttttagataatctgtattcaaaatgtttgcacgaatactgaaattcaagaaaacattttctcggaagaattcttttccataaaaggtgactgaccttttactttctgtaaaataattctacatatggggctattttggattctgtataactttgatgttgaacttgcttgcaaaattggtgggtggtctccaggtactttatgtatgatggaatggagcactattgcttagagggtaatcacattgtcaacctcttctcattctcgaaggcttacggaatgatgggctggcgtgtaggatacgtaagtttgcctctctctctctctctctctctctctctctctctctttctttcatcctctgcttaggcttgaaaatgctgatgtaagagtcaatattgagttctttcagtttcatgaatttcccgcatccacttgaatcttttaccagggcattcccttaaattatcaccatagcaatgcagtataagtaacttagtggctgcacaatctgtgttgatcagtgagtcttacaagaactgatgagctgactgctgcagattgcccacccaaacgaagctgacggtcttcatgcacagctgctcaaagtgcaagataacatacctatctgtgcttccatcatcgggcagcgcctggcgctctacgcattagaggctggtccagaatggatcagagaaagggtgagagatctagtgaaaaaccgtgaattgctcatggaagcgatgtctccgcttggcaaggactctgtcaagggtggtgagggtgccatttacctctgggcaaaactacccgagaaatgctcagatgattttgaagttgtcagatggcttgcaaacaagcatggtgtggctgtgatccccgggagcgccagtggaggtcccggatatatccgggtttctttcggagggttgaaagaatcggatacaaggcttgctgctgagaggttaaggcgcggcttgcaagaacttgtgactgagggaatggtacagtgacagcccaatggatgcaagaaatacatgacatacaaatcacaaaagtgaaaattttcagttacataataattctgggattagttcaagagaagaaaagagccaaaatttcaagattacaacatggttgttagaaaatgctgaagcttttatttcagagaacttttgtcacattggatttcctagtggaaatttgatttggtgggttgagtagagggaaaaaaaaagactcatccaccctgtggaataccattgtcattaaaggggtattcatgtttagtacttactgttgcttgataacctctttccctacaatcaggacagcagctgtacacaagtaagatataataagatataatagcaacaataagtgttcatgatgtgcttttatttcagcttttttatttatttcttcggttcggatcacttctcgaagctcaaaaactgaaaaaaatatgtttcttgaacttgttagcacttcaatttctgaagaaatgtgctcgtgcagaatcagacattgcattttttttatataatggtttatattaaaccggcatttacatccaaagtgaatgtatagccaaaatcagacattgcatacaaccatgattttagttcttcaagcactatcacctccagttcctgtaaaactccaattgctgccaaaccagtgattgtaaatttagagttgttttcgtggattattgatttgattataggaataaattaaatattttaagaaataagctttactaatagcttacattacaacgagtgatttaagcaatagagtagaacaatccgtttaaataattttatgaataagctaaaaagaacacgcgcttcggatcttggaatagtttttcagtcactgcatgttgtgttttttttgctgtccacatacttctcatctcttttctcctccaacctgtgtccttttcatcgtacagtgatcgatccatcatcacagcagcgacatgtgattggctcacattaaaacgccgttctctgaaaaaagcaaatatgtttcctccttttcctcctctttttatgtaaagagatccatgaaaatgatgtgcactagcggtgcatcaaatgcctctcttttttttctttgcaaacgtgattgagtgagagagagtacatgagagaaaatgacagcaatcttcaggctgaaagaaacatagtatcagcagcatataaatagcttgatacgatgcaccagaaaagcaggttagaagtaatccatctactccgaaatataaagatttctaggttgcttagcaaatactcctttccaatgttaggtctaaagatttctttttactcacttcagtagttcagattttattttttttgaatctaaattcttgtattcccttttcaagtttgtgattggctttggattcattgaaatgatgggaatcataggaataagtacatggatgtttatattgtggtataaatttaagtcctaaaaatccttatatttttggaatggagaaagtagtactattcagcaggggttgataagaaaagcaataagcaacaatgatcacaagatcagcatcagcatcagggactcagaatgtgtgattgccaacaacaaatgccaactggaggagctatcagagactgacagttcaagaaatctgatgctaattttgtgttggagactttgagaggatgtgtacacacatctcattgccagatgaccaataatgcattgaaagagagagtgcttatacgggagtaaatgattgcagaagaaagcaggtggaggcagcactgcacttgtccctgcatgctgcacaattgaaatgcaattcaatgcagagttgcagtactgccatcaaagtccctggattaaggggtagtactgctctttacctgctaatctaacctgctactatcatgtactagcagtgaaattgctcacatttttttttgtatatattttactagcaggtgcatatatagcatttcagtaccacttgttctgaagatgcaggtagcaagttcagtcaaccactactggtaccaatcatcaagcccaaccaacctcacctagggtgcattccgaagtgtcgatggatgctgctgaaactgagtttaagacacaattattcgaaggtatacacgaacgaattgaatattacaaagttgatcaatatccttattttaaaagagttttccaagaatgccaatagtcggcgtcgtttaaggccccatttgaacttgctgaagatggacattaagtacgggcacgtaaaaaaaaagttattagcgtatgattaattgagcttgaaaattggatttatatgatatcttagaacaacatctatataaaacgttttcgcacaaaatacgccgtttaacagttaccggatcatattataatccaaattaatgtgtccttaaactattgcccagaaatgcaggctaacctgcagggggtgacacagtaactactgtatatcgtcccttgccgccttgcgtcagagtcattcttcaggactaaaataggatgaacagtatatgattagtaccaagaaatggtcacatgcattgctgccccaatgcaactcaaagccaagaaactatagtaataagattgagacagagagagaagtccaggcaaggcaattgcaaacgaacaaataattgaaggacaagagtatattagccaagtactacttgggggctcactgcaagctacagtactacgtactgctacagtatgcattgggttttgttgatctgggcacatttagggcgccattgatgcctggctctcaccttttttacaaagaaatcaattgaatctcgctttgcattgcagcatgccaacgagcaagctaccgagggtgtgtttagttcacgccaaaaatgaaagtttgattaaaattggaatgatgtaacggaaaaattggaagtttgtgtgtgtagtaaagttttgatgtgatggaaaagttggaagtttgaagaaaaagtttggaaaacttggcctgaattgagttgaatcgcttctcttctccaaaggtcaagaagaggtgttggccatgtgtgagcatcgcagcggccatagttgaatcaatgcattgcgttcgtatatataatggtcccaaatgcaagctacagctgcaatggccatggccatggagtagagagggagagagagagatgcgtctactaacttgctttgctgatgatcatcgacgatttgacgaagcagagacgacgaacggacagtattctgtccgtcaaaaaaaaatgatgaatctagacacacgtgtgttagtgtgtgtccatattcattcctagagtttaattttttttggacagaggagtatgtacgacaacctactgcagcagtagcaccacacaccgacgaagacaacgtatgccctcgatcggtggaatggaatggagggatatcgctcttaaaataaacaaacatattaaaaaatgtaacttattctattaccttgaatctaaaatctgaacatatatgtcctttcaaaaaaaatctgaacatatatcacattttttttgttatgttgggatagagagagtatgtcatgtatttctactactttctctatcatatattaagttaatgtagtataagacatgtgatttccattaaaaaaaagtataagacgtgtgatggttgttggtgcgacgaggaaaaccgcgcatctggagcctggaggtagtggctgcagaaggggaaatcggcgaagtggtagctagcggcagccggcaggcaggagcagcggacggacagacgcacgaatgcatgattgcactcacttctaagaaagaaataaaaaaaattgtggagtttcagagttcagggtttacgatggatcaagctgttacctgtttttttttaaaaaaacattttaactcttttaaaaaatttattttttaaatggatttttttaaaaaacttatttcagaaatagaccctccttaatatcgaggtccaatgtctcagcgccaataacattagtgctaatattatctcttcctggtagataagtagttgatgctaaggaggttggtgcctcctatttataaaaagaattctaaaggcttaggctgactttggtacgcatggttctcaactcactcctctctttttccgcgtgtacacttttcaaactgctaaacgttattacgttttttttaaaaaaaaattctatacgaaagttgcttaaaaaatcatattgatccatttttgaaaaaaaacaattagttaatacttaattaatcacgcgctaatgtaccgctctgttttctgtgtggagggaatgaattcccaaccaggagaatcgaacgtagctttaagggtctttgatgtcgatgatctatttataggaacaaatatttacattatgactattcttttaaaaaaatattttataaataattcctctgcaccaacctttttatgttttggcagctaaagactagcttgtttggcaacttgagagaaggggattgggagtttacatgagagaattgacggcccgtttggttggagggagtttttaggagggattgggagtatggagtgatgaggctattaagtgttttgtttggttgggagacataggaattttggtgggatggggatgaggaattgaggaaggaactcccaccttttcaatacctgcgtaggagcaggtaattgggagggaattcctcctttactttgtctaagcaaatctcaaccatccgtttttattaatgatctaatctccaactaaactccctatcaatttccatcacctctaccaaacaagatggctgggattaaaaatcaaannnnnnnnnnnnnnnnnnnnnnnnnnnnnnnnnnnnnnnnnnnnnnnnnnnnnnn

SEQ ID NO: 11420 - DNA, 4256 bp, Oryza sativa
  unsure (1)..(4256): unsure at all n locations
nnnnnnnnnnnnnnnnnnnnnnnnnnnnnnnnnnnnnnnnnnnnnnnnnnnnnnncaaacaagccgtgatggtgagattaagatgggaatttgatttttcatcccagtctcttgtttggtagaggtggtggaaattgatagggagtttagtttgagattagatcattaatgaaaacggatggctgagatttgtttaggcgaagtaaatgaggaattcccttccaattaccaccccctacccaggtattgaaaaggagggagttcattcctcaattccccatctccattccaccaaaattctcatgtctcccaaataaacaaaacagttaatagtctcatccatctaaactctcaatccctcctgaaaactcccccaaccaaacgggccagggtgtttgacagcgagagaagagtctaaaacaagttatttttcaagagtttatttataaaataagttttttaaaaaaaatcaaacataaaaaatccagacgctgttaccttttttttttgataacacgtggttctgtgctagctgtgataccgctggatagggatcacctcttctcgaacggcctgtggaaattgcaaacatgcatgcatctctcatattccatggtaaaattgtactagtgtaaaatttggcaagatcatttccaatttgtactgcgtattggcctcatctgaatgcaaggagacatgcatacatacgtatgtgcacattttatacattttcagtatatattttcagcgcaataatggagtaccatgtatatatacgtatgtgcacattttatagggcgcttattaaagaccacccagtcgtataatggaatggcttctgctcacagcaaccaacacggcgtggctcctgtatacatccatacgaccatacactactttatactggtacaccagtatacggtacatatgctgcaactgcaagcaggatagagtatcaattatactcatgcagcacttcccactattccaggctgtaattagttatactagtagtaattataatcatcaatggatgaaacgagtaatactaattataagtgttttgattttcttttaaatcagccttctttagtttggatcaaatttatagaaaaaaagactaaatttatagataaatacagtaatactttcaactaaaaaattataatgttagatttaataaaattaatttattactttaaatattactatatttttctataaatttaataaattttaagaatttgattttgaaaaacctaaagcaatttatagtatgagacgaagggatgaccaatgagtgctctctccgtttcaaaattcttggtgttttggtaaatgactcggtcttcaaaataaatatttgaccttacttttctattataatatatacaataaataaatgcatatttacttttattttttatttttattatagaactttgaaagacagattcatatgtgttattctagaattataaaagtttgactataatcttagttcaaaaattacagcagttaaactagcaggaggagtaccagattagtgacacagtgttgacagtggcgaattgattggcgcgagcaaatgcggttggggactgcattcaatgcgctcatccgagcttcagcttcagctttcactctagcccaataactgtctttgatcaactgggtagtagaagacgccgccgtgtggggcccataatccagatcgaccggtggccggccggcgacaaattagccgcggcgacaactcctccggccggctccggcaaggccgtgcggccaggccccacccccagctagcctgtcagagtttgtcaccgcgtgcatgcgtacacaacactccactgtagagtacgtaggagggactacttcttggactaggagtttctggtatttacaagtcttgtaaggcagtaaggtggtgtttgattctcctgaagatgaagactaagttatttacgtaaacgggatagtataatgtgtgattaattaagttttaattattacaaacttgaaaaacggattgatttgatattttagaacaacttccatatagaaagttttcgcacgaaacacaccgttcagcagattgaaaagcgtgccacgagtattcaaaatttaatccaaaagttgttggagaaaagaacagggcctaaatagttttagatttttaaaatttacagacatataatttagaaaataaattaaaagtacgaaactgaaaagactatttccctattggtttcatgaactgtttctcacaattttcagccctcattacatgtcctccgttgaatgttattacttgctttgtttctttctgtccatcatctttttagggccgtgtttagattcaaatttttttctttaaattttaaactttttcgtcacatcaaatgtttagacacatatatggagcattaaatgtggacaaaaaaaaaccaattacacagtttgcatgtaaatcacgagacgaatattttgagcctaattacgtcataatttgactatgtggtgctacagtaaatatttgctaatgatagattaattaggcttaatagattcgtctcacagtttacagacggaatctgtaatttattttattattagtctacatttaatacttcaaatgtgtgtccgtatacttaaatttttttttgacacacggactaaacacagccctggatctgatttccgagagttcatcatctgcatttgccaacctgttttggcttcttcacgtgaatcgtgccggcgtgccaacctgtttctactgctctcattgatccagctctagaaaaataatttcccaaacatataatcaacggcaagaaaataatcactcgtgttttgaagcagttgtggatcaggaaaaaataatagagagggtaaactggacaaagctaagacccttgcgcgccatcccatggtaggttcgcccctattttgaagcacgggactctatccaatttcactgtaaatcaaaacatcttctaccaaggcatcctaaaaacacaaataatttatacgcattcatatgaaatctaaactaccaaccatacagaaatcgtggagccttgcgttcaaaaatggctaaaaagaaaatcaccgtgttatggcatggtgaaacgaagaataaactttttttaaagtaaatttcacaaaactacaaatactttaattaaattatcacagaactacagatttaccaataaatttaatataaaactataggtttaaggctaagtatcataaaactacaaatttaataaaaaaaattatcataaaattatagattttgcggtttaaatccttagcactaatgttatgttggacttataagtgttcaagttttgtgattaaattatcattaaatatgtagtttgtgatacttttgttactaaatctatatttttatgatattccaccttaattaatctgtagttttatggtaaatttagtattaaatatatagttttatgatacatcacattaagagtaacgatagttttgcgaaatttactaaactttttttctgtgagatagaaggaagcacaacgattgggccacgtggaggcaggagaggaggggcccatgtcgaggtagcagcaaaggtggcccagaagagccaaaccgaacggtctaaactcaaaaggcgtcgtctccctccatcctccacctacgcttaattctaaatttctaattccccacagaattagggcacaaaaatcaaatcaaatcaaaccaagagcagaggcgacgcgaggagagagaaggcgagctcgtctcgtctcgtctcgcgccattaatgtcaccaccgcgccctccatccctcgccatcgtgccctctcacccgcaaacgagtggtgtcgctgcccttcatcccttcttctctctccgaagctccagaggacagtggcaaggcggcagaaatcggcgctggaggccgacggcgaggcttgccgttgtgccgccctgtcgtcgcccttttccctgggtttttcctctgcacagccacgtgcggatctcgtggcggagaaaattccgctagaggccggaggcgacgctcgtcgtcgtgacaacggcgagccagaggccgaggcgacgctcatagtcgtgttgccctaccgacgcgccctcttccctcctcgcaacctggcatgacgggcagagacgagcaatgcggagagggacggggatagatcgatagagtggggggaaaaggcgtggggcccacaattggccag

SEQ ID NO: 11421 - DNA, 9035 bp, Oryza sativa
  unsure (1)..(9035): unsure at all n locations
gcggcgctgcagcggctgccnacggtggcgcgcgcgagaaggggcctgctcaggtcgcccgcgccggggaaggaccgggtccagggcgacgacgcgctctgcgaggtcgacgtcgcgggcctctcccccggcgaccgcaccgccctcgtcgatcgcctcctcgccgactccggcgacgttgaggacttcttccgccgcatccgctcccgcttcgacgcgtcagtaccacactgctctctctctctctccccctgcctctctgctcgcgtggaagcttctagaagcgcaacactcgacactgacatgtggggcccaactggtacgcacgcacaccgggggaagcttctagaagcgctttgctcgccgcgttcttctgtgggcgaagtactcggtttccaaaaacgcagggaagctttgcggccgggagcggctgacacatgggccccacatgccagtcttgcgttttgttcgcttgctagttcagatcctactctaaagctatcgttctgatgaaatgcctagatcatgcggggaaggctacatttggaacgcagtgattttacaaaaaaatttgctgtaattttacgaaacaatttcagctacggcttgtaggatctgtaaatcgctcgtctcctctggttggtttggattttggtgtagaattttgtttgtatgcttgtagtgttggtaaacttgctcatgggctgatctgaagcatctgtgctgctctccatttttttttatttttgttggttgcagagtgcagatagagttccccaagatcgaagtgaggtacgaggatctgacagtggacgcatacgtgcatgtcgggagcagggcgctgccaaccatcccaaacttcatttgcaacatgacagaggttggaccaatccaccactggaatttcccctcctttgtctcagctctgcagcaatgatctactagctgttttgaacagtagcatgatttttaaccacattagtttttttttttactctgggtaaaattgctgtgtaaaaagctgtaaatagtgggttcacaaatgagctctagatgtgcttatttgctgtttttatttttctgaaaggcatttctgaggcatttgaggatctatcgagggggaagagtgaagttgccgatattggataatgttagtgggatcattcgtccatcaaggtacaccacgtgcagaacattttttgtttcctgctggatcaaattgtacgaccttgtaaaatttgacacttggttcttgctgcagaatgacactgctattgggccctccaagttcaggaaagacaaccttgcttttagcccttgccggacggcttggccctggactaaaggtgtgccttatcacatcaatccgtcttcttttcttcgattctcgccgctcaaagatgatgagcaaatctcttctatatgtatacaatcaaccaactctgcatctatcacctgctgacaagagtactagtgtctcaaatagcatgaaaatggttttctggtcaaacgctcatccttctcatttcagaaatactatcgaaaaataaatactacttcagtgctataggcctgtgcttattctgatcagtgcaagaagccttttaaccatgcggcattattcaggactatacatttttactgactaccaacacccaatggattgcaggtgtctggaaatatcacttacaacggccatcatctgaatgaatttgtgccccagagaacatctgcttatgtcagtcagcaagactggcatgcctcagagatgacggtcagagaaaccttagagtttgctgggcgctgtcagggtgttggaataaagtatggtaggtcatttcaccacaatgtccttggtgcccttccttacctccttggtagtttgcgctttgacgttaatcaatatgtagatatgctcgttgaactcttgaggagagaaaagaatgaaggtataaaacccgatgaggaccttgatgtgttcatgaaggtagatcacatccagctttatttggacacacactacctgttttgttggtgattgtctcatgacactgtttgtacttaatttttcaggcattggctcttgaggggaagcagacaagccttgtcgcagaatatataatgaaggtatatggtgtatccctttcagctgctattattatctactttggagtctcaagtgtttgcttctttgagtgaactgcacaaatattttcgagcaaatttcacgatgcataacgaaaacccccatgttttgggggcaaaatgtttcaaggaaccccagatttttataaaatattcatttgcataataatatatggtatttttagttatattcacatatataatgggcacaaaatgtacattcttcttcctcactctcgctctccatgattgcacaaactcaacacaaacacagtgctcactgttaatgacagattaaccagttacataaacacaaaatggtttatactttcgataattgacatgtgttggaagtgcggctaatatgtatatatcacatactattttttacaattattatgcatggggttccttgagacaaattgcaatacatggggtttgggttacgcatgtcctataaaacctagggttttgtgaaatttactcaatattttcatcaagctgtttaaccaaatggctcacttaattcccatccattcaagacaattttcaattttccctacaatgttattttggcttatcatttttacagcatcaacatgatctacctttgaatcatttggttctggcaagatttctgaattgctaatttttatctagccaagattttagggctggacatttgtgcggacacaattgttggtgatgaaatgatcaaaggaatctctgggggacaaaagaagcgcctgacaacaggttgttgcatgataatttaatctccttcatattattggtgctgatggttgaagaaattgggcaattgcaagttgtatggattgcatgcttattctggtttgcagctgtgctcatatatgttgctcttgcaggtgagctgttagttggttctgctcgtgtgctgttcatggatgagatatctactggacttgacagtgcaaccacatatcagattatcaagtatttaaggcattctactcatgctcttgacggcactacaatcatatccttgttgcaaccagctccagaaacttacgaactatttgacgatgtcatcctcatatctgaagggcaaattgtatatcagggaccacgtgaatatgctgttgatttttttgccggtatgggattcagatgtcctgaaagaaaaaacgtcgctgacttcttgcaagaagtatgcagttgtaatctgtgtttgtgatattatgttaactggactgttcttgcatatagttatttacattttctgtgttgcaggttttgtccaagaaagaccagcaacaatattggtgccactatgattatccttaccagtatgtctctgtatcaaaatttgctgaagcctttaaaacatttgttattggcaagaggctgcacgatgagttagcagttccatacaatagacatcgcaatcatcccgcagctctttcaacatcaaattatggtgtaaggaggcttgagcttctaaagtccaactttcaatggcagcatctgctgatgaaaaggaattcgttcatctatgtcttcaaattcattcaggtattttcaatttcgagatgcatccagcagagtagcagtttgatgtctcaaataaatactgtcacaaggaaatgtaacattgtctaccagttaaaatataaagcacacgtataataaagtcgctaaaccttgctaagaataaaaaaaactaagactgtaaatgccctgttaactcattttacaatttcactgctttaaaagtttagcacactgcaatgatcaatgtgcagttgtcacaaatgcttgcaatttttccctacttggcacacgagagttatcttagcgtgcataaaatgttatagcctagtaagttttccctacgtggtgcgtgaaaatcatcctagtgtgtttatgttattgtgacatcatgctcagaatcttggtcacaactcacaagtttggtcaacatgtacttttacatcttggtgtttttactggattgctgtaaacttgactggatggcatataatccgtcaagtcacaaaaggatctcgttgtggagtttccatagtcaaaaagatagatcttggctatatcatttttcacatgtccaaaaccttcattttaaactatgattggtcaagattaacttgtgttgacttcaaatttcctaatggcactcttctgttttcagttaaacttcacctaagttttattttcaatcatttgagggttttttttaacataatctttatgttgcagcttttacttgttgccctcatcacaatgacagtgtttttccgatcaacaatgcaccgtgactcagttgatgatgggattatttatcttggagccctctattttgcaatagtgatgattctatttaatggctttactgaagtctcactcttggtcacgaagcttccaattctttacaagcacagggatttgcacttctaccctccatgggcttacacacttccgtcttggctcttgagcattccaacctcgcttattgaatcaggaatgtgggtactagtaacatattatgtggtcggctatgatccccaatttacaaggtaattgttaagttctgttcatttgctctctggtccgatgttcagagatttttttccctatctgaagattgatcttaatttatcatctgcagatgtcttggacaatttctcttgctcttttttctacaccaaacatctttggctcttttccgggtcatggcatctttgggtcggaacatgatagtcgctaacacctttggatcgtttgctttgttggttgttatgatccttggaggattcattataaccaaaggttaagcttcttgagtcgactcagtattagcacttgagacttgagagcatctttcaagatcttacatctgacatgctgctacctgttcttgaatatctaacagagagcataccagcctggtggatttggggttattggatatctcctatgatgtatgcacaaaatgctatttccgtaaatgaattccttggccattcttggagccaggtaatacctgatttaaaccccttcttgaggttggtagcaaaggcacattgtggcagcaatctgttagcttagtttggtgtatgaaaaatacttgcataatatggaacatcgtaattgcttaaaattatattaaatttctttgtatgaacctaacgagatatttttttattcagaaaaacttttattagccttatataggaatatttgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatgtaccagcggtatgtcagggggaggccggtttatatggctgaaatttcttttaaaaatctatgtatattgattcataatcaagttttgcctagcaggaattgaaaagtcaaggtatagtagaagaccgcctacagttgcttattgatgtcactggagcatttaggccagggatactaacagcacttgttggagtaagtggagctggcaaaaccaccctcatggatgttttagctggccggaaaactggaggactaatagaaggaagcatcactatatctgggtatcctaaaaaccaagagactttcactaggatctctggttattgtgaacaaaatgatgtgcattcaccttgcttgactgtaattgagtcattgctgtactctgcatgcctccgattgccttctcatgttgatgtgaacactcgaagggtaaagtcttggctgggctgcagtgctatgtttattgtacaagacatcactatttttgtcattctgatccctgatggttcatttcataggtttttgttgaagaggtgatggaacttgttgagctaaatgcattaagtggtgctcttgttggcctaccaggagtgaatggtctgtcaactgaacaacgcaagaggttgacgatagctgtggagcttgtggcaaatccttcaatcgtgttcatggatgaacctacatcaggattggatgctaggtcagcagctattgtgatgagaaccgtacggaatattgttaatacaggacggacaattgtgtgcaccatccatcagccaagcatcgacatattcgagtcatttgatgaggttaatttctttacaaaacctagtagtcaatttatgcatgcatgacaagcaatagttcaaaagtcattattttgagctatccttttcgtgacatattaacaagttgagcacagattttgatattttttcgaagcaacagtacagattttaataatcgttcataatttgatgttaatcagttttcttatcaatgatggatgtgaacagaaactagtcccttttacacttgatctgttgaactttcattgtgctacttagggaaaccgcgaaattttcttatacaagtatgtactaacatttaaccagcaccctttcctaactcattcatatgctggtcagcttttgttcatgaagcgtggggggcaacttatatatgctggtcccttgggctcgaaatcacgcaatctggtcgagttttttgaggtacaatctgcacaatgtgtttcctcagtgatgatagcttatacaagtttctctgtccttacactttgcgttcgcgaaaaaactgtccttacactttcaagtttgtaaacaggcaattccaggagttcctaaaatcagggatggctataatcctgctgcatggatgttggaagtcacaagtactcaaatggagcaaattcttggagtggattttgctgaatactaccggcagtcaaaattatttcagtaaacacaacgacccttttcacctctataaatcttggtctctttttccttaaacatgtttatgttatggcattccaggcagacccaagaaatggttgatatcctgagcagaccaagaagagaatcaaaagaacttacttttgccaccaagtattcccaaccattctttgctcaatatgctgcttgcttatggaagcagaacctgtcgtactggagaaatcctcaatacactgcggtccgattcttctacaccgtcatcatttccttgatgttcgggacaatctgctggaaatttgggtctcgaaggtatgtccactgatgattctgtctccacttttcttcctgtacttggctggccttatagcgaacatgtggctttgtttgacagggagacccaacatgacatattcaatgccatgggtgccatgtacgcagcagtactcttcataggaatcactaacgccacctctgttcaacctgtgatttccatcgaaagatttgtctcgtacagagagagggcagctgggatgtactcggcactgccttttgcattctccctggtaattttccctgtcaaaaactcctgtcatctcatcatgttttgatgctcgtagtagtaccataataaggctaacaatcgaactgttcttcggcatgcaggttacagtggagttcccttacattcttgtgcagtcacttatctacggcacgattttctacagcttgggctcgttcgagtggacagcagtgaagttcttgtggtacctgttcttcatgtacttcaccttgctgtacttcactttctatggcatgatgacaacggcgatcactcccaaccacactgttgcgcctattattgctgctccattctacacgctgtggaatctcttctgtgggttcatgatcccaagaaaggtacggaaggaacaggaaccccatgcataatttgcacctaacgtcctctaattgtactggacccatgatctgttttccccataatccatattccagtgcacattatccatatctttattttttttgtcacattagcatatatagctatggaaatagtgtttccaatccataaggccacttccagtgcacattatccatatctttatttttttttgtcacattaacatatatagctatggaaatagtgtttccaatgcatattatttattactggggccaaaaatgaattatctcccttcgcaaatttcatcagaaattcttagaggagatatctattttcctggtttgaatatatatgcaatgtctcatccgagacactcttttttctttataattccttagcacatcatctaaaatgctgctatgttgcatagtagtttttagtttctattaacattgtactataatggagcatgagtgccctgatataccagtgcccctaataatttcaccaaacccaccagtaactttttttgtcctacagtgaccacttgtcatgtactagaaccactttagcaattgggaagcaataatggtttgtttaaattaggacgtgattaaagtggctaatgattaatgggcttaaacataatgcagaggattcctgcgtggtggaggtggtattact

SEQ ID NO: 11422 - DNA, 1152 bp, Oryza sativa
tcgtaggggacctaccatgctttatctctaaagttgatatccgacgtcttgtcttggcacatgtgggcttgtatgttgatcttgtgtcttgatcaattgttcggtgccccttctcttcctaggggccttgtatttataccaataggtgtccccttgtccaagtagaactaggaaaaccattatggataaatccgagtagttcttgtcgtttccatgtagaactctattcatccttcattatgcataactcctcgtatatccgaaggttgtttccgtataagacatggtatgtggtgggtcctaccgagatttagtcaactactattaggtatgtgatattcataaccctaacaacatgtgtgcactgtgcaagtgcaccagacattgacacaaaacaattcgtcgatagacaagaaaattcacacgcagagacatgcacacaccacatgctctttcttcgaaggaaagaaatacacatgactcgatctgcaggtgctgccaaggcatcacacgcaagcagagacgcaccacatacgtacatctaaggtgcttacttccaagatgcgtgaaaaggcatctctctctcaatgtggtcttcaagaaaaaaacaaaccaaggtaatatttctctcggatttttacaggtatattatgcgtgtatattaccgaattgtcgttagttcactacacgagaaagtgactgaattgtcctaagtaatataaaatatgtaggaaacgaggaaagatgagagtgtgtggctagaaattaataaactgaaacatgatatatactgtttatcatgttacatattattaaagttttaatttgagtcacccttaaaccaatctttctattttgtatcagattgttatttttttatttttgagtttcttaaaattttaaatttaaaaataaacatttccaaaattattttcaagatccgaatcttctggtcaagctaaccaagctggcatggcgaaacaatattgtcacacggtctaaatgacgtagcaacgttatttggtcacgccgatatagctagtgtggcaacattatttggccatgtcattatggctggtgtggtaggataaaagtcacacctaggtagcatgacgaaaattgttattttactgggtcaggcgagctgtcatg

SEQ ID NO: 11423 - DNA, 551 bp, Oryza sativa
actattctaattacaaataactagcatacagatatcacataacaaacaattcaccaacatggccaccatatgttggtctctgcttccagattagcaaacaaagcaatgcactaccatattttttctctacagcacagtagctcaacagatcaaacagaacacaagatatatgataactaccatagtttggtaagtctctaccacaaaggggaacagataatggggatacagattttcaacagtatgaaatacgatgttgatcatagggtaaaaacaagtcgcaataggaaaacgatcacatcatacaaacacaatcacataccctaacgcgattcatgcgttcacaattttaacagtatgaaatacacgatggtgatcagtgggaaagcgctggcactcataccgatggcgagtagcgtgggcttcttcagcgggcgatccgtatagacgtcgggctccggctttcggcgctgcacgatgtggaggtacacgggggacccactcttattgtggttacacgccacgtgcttccttcccgaccccaagaacga

SEQ ID NO: 11424 - DNA, 1366 bp, Oryza sativa
tcaactgatatacaaaacctgcatgcatttaactgtgtgcgagaacttggaaggtggaatattccttttctgtagcataaattgtgactcaagtcaaattctaaggaagctttaattcctaaatgtgctacacacagcttcctgctatcaaacatggtgtaaacatggaatcctacccacatgtttggaagtttaatactattgtggatttcaactcagccaatattcactgattggatgcacaaattctttaacttctattccttcaattctatgcaattttaaccactggtcactttcaatatgaatcgagaccctgtctggaataatggaattactcacgatatagttcaatcctatggaatctgaaaatgtttggcgttcctaacagggcccaaggtcgggagtaccatatacttactatacctgctaagttttctgatacataatgtgatcagcagatctcattttgatcctattctcattttttgatacttacagcctgaatagtacttttggacacacttttgaatactcctaatttttatgttccatattgatagggacaagaaggaatacaccctcgtatgtttaagacagttattgctgcaaagcatcccgaattttccagtatgaggcaacaggtactttggacctggaatcacacatttttggttgaggagctacttatttgaattttcctttgcatcattaactgcaattttgggtacaattttttccaaatagtcattttaactcatctctttgtccaggatgcgcttgatttcttccttcatcttattgaccaagttgatcaggcaaacaccggaaaccatgagctgaatccttttacagggttcaaattcttcattgaggagcgtcttcaatgcccttctggaaaagtctcctataacaaacgttctgactacattctttctttgaacataccgttacatgaagctactaacaaaggtgactttaaaacctttttccctgttgtattataaagttagtgcatatatccttgacacctgtgagatatgcagagcagctagaagcatttcatgagaagaaagctgcaatggatttggatggaaaggaagtgtaagttgttcatagctcatgcactgtctaatgagcacgacttatgtttcactttgcttccataaaacaggtctaatgaggaaattgtgaggcctagagtcccactggaggcatgcttagcaagtttttcaggcgcggaggaagtgcctgaattttacagcactgcattgaattcaaagacaacagcaattaagtatgcatatcttcattgccatttggttctattatatacatggaaatgtggtacagccttattgattaa

SEQ ID NO: 11425 - DNA, 16645 bp, Oryza sativa
ggctggctagtggcactgccacccaattaataacacacatattcatacaaattaagttatgttatagtaaagtaaaatcacaatgtgaaataagcaccagagtaatttttaattatcacattacataaaacagattaggtaattaaacataggaattcacaggaacagtagcgtcctccgttgccgtggtgtttttttttaattcgtctgtctgctttagaaccaaacattctcacatgcagccacttctaattaattatgattaccgtataattctcatacacgtcgaatttcattcgatattttactttcagtagcaagatcttcatgctagttcccatatacagtactacatccgtttcaggttataagacgtcttgactttagtcaaaatcaaactgctttaagtttgactaattttatagaaaaagtagtaatatttttaactcaagacaaatttattatgaaaatatatttaattaactaatttagtattataaatattattatatttgtctataaaattagtcaaacttgaaacaacatgactttgactaaagtcaaatcattttataatctgaaacgataggattacgtcctaatttgtcgagcacagtacaattaccaagattcaaaccgtgttatctacttcttcttttttcaatatatttactaagaagactaaccttatattacaactacaaaaataaacaaaacaaaacaaatataaacagtaaattgtttagaaaacagcacacagattctagaacagcaaacaagagaaaagacagcactagtctgcagccacgagtaaaaacagaggacagaggccatgatcatcatcatccatccatccatgaatggttgctaatacattacaaaattaacacagagacagagagagagagagagagagagagagagagagaggatgcattgggtctggaggtaggcggcgatggaatggccggccgtgcgtggaagggaagggacagggggatgatcgagagatggcggcgactaggggcggcggacgatcggcggcgaggtgtcgccggcgccttctggatgcgttgtcgggatcgatggagcagagggcgcgtcgccattgggtgggatccgtgcagccccgccgccgcccgccgcttcccacgcgctctccaccaatttctcccttttctctctttaggctacgtacggcgccgccctggaaccattcttatttcttatttaaatataaacaaataataatgcggtagtatataaaaatttgtatataaggattcgagtccactctagttcctgaatatatgtctaatcctcatcatgattttttctgcactatatttcttttattttagtaacaataataatgcaatggtctaggttttaccttttctttgcaaaataatgttgattattatgctaaatattaagaaatgattacaaccatattttttttagataattgattttcattagtccggcctctatatctacgagggatatacaaaatcaaaatgatacaagaacaattagactcacatctcaacaaagagaacacaaaaccaaaaaaaaagggaaaaaaaaacactacgacctctatacatccctgcttccccacatcctctcttgaagtggccaaattcaacgagtggaagtcatctaattgccatcacccctagtgcgttgtcgctacgaaattccgctggtgctatcttcatccgcttcaagtgagctgacgccacgtgacgccggttaaaccccactcatccatcgtcatacagtcagaactagccgaccagatgtgagccaaaaggatcagcttctgcttcattggattcctagacctccatcgacatcagaatcctcctccgcctctcagacccctagcccgttgccgccgctattggagtcctcaacagctgtcaccgaggatatcctctttcgtcctgactccgaggcctttgccgcccctagctagggccactgccaccgccgggatcggcctcctcctcactaagatccttgtaccggcacttaggccaccgccgcccctagggccgcagttaccgaagctgaggaggtcttctacccggactcgcaggccgctatcgcccctagggtcgctactgcctacgaaaccacctttaccggattcgccttcttcttgccgaggactattcgtcgacgcttaggacgccgccatcctccgccgcacccttcgctgtcgtgctccgcagcacctgccacccaaagagacatcgtcgccaacgtcttgctgctacctgccgcagcgccgccctcctgaccttttccgctgcaacgcgtggcccaccgccgcccatgggcccgctgactacaaccatatgttattacatggggaaaattcagacatgctagtcatacgcacacagataccccgtatcttagaatgccacgagagatgtattttgtttcgaacgtaaagggggccatttgccggtacatttcccatatttcacaatcaatggagctccggcgaaaagtcccgttgggcctttctcctatggggaatggaaagttgtaaaccaaatatcttttacaagtcatatacagctcaaggcaggagtgtggaattggtgaggaaaaggccaaaagaatgggagtcttgcacctttttcttgttttggtaaatacattgcataactaacacgtattgtgctcttatatgctaaacgcgccaaatgatcaaacaattacgtcaagggcagtccaatatccctattttattgttagggttaaaatagatgtacatctccttatgcatgttgggaattctatgggaacatcttccaaaattaatgtgcaaaatgattaacccaatcggcttgacgaatagctttcggggccactctattttttcccctacaattttgctcatttcaacaatttatttatcataaaacctatactaaatgtttaaccctcctaagctccataactaatcacttctgcacggaaaacggagtggtctattaacgtgtgattaattaagtattagtagtttttttttcaaaaatagatcaatatgagtttttaaagcaactttcatataaaaatctttaaaaaatacaccgtttagcaatttgaaaagcatacgtatgaaaaagagaggtacgagttgggagctatgggtactgaactcagcctaattgtatttatacacacatgccttttccctccttttaattgagtattcccactaacaatttatccattattggttcatattcgctgaaaggagcccaacaaatcgtgtgatagctcagcggctaattacaacaatttccatagataccatggatgatcttatttttctttacctaaacatgtactctctccatcccataatataagggattttgaaattttgcttgcactgtttgaccactcatattatttaaaaaatttatgtaaatataaaaagtaaaaagttgtgcttaaaatactttagataataaagtaagtaaaaaagtaaataataattctaaaagttttttataagacgaatggtaaaacagtacaagtaaaatgtttaaatccttatattaggggacggagggagcataacaccctgaaattatctattaattgtgagtgagaggtgacaagctgctagttgctgctatccaactcacaaaactcttctgaaacaacgaggagaagaaagacaagctgtcagacaaacgatgtgctacacacttgttggtcatgttgttcttatcccctggaataaactacaaccgtacaaaattcagggaaaacttttttaatggcaaacagtttaatttgaatttcgcgaggataaatttaagtcaccgcgtgtgaaaatgtccaaggagaaaatcaaattcgccatggacggttgtccgttggtttgtcctgacctgatacgagatgagtgtatagcatgtagctgggacccacattgagatctcacctccaaattaacaaaccaaaggcgaatgattgggcacagtagaattaatttttattaaccacacctgatagctaagctaaggttccttctgtccttttcttttactttgtcaagttaaaacttttggacacctagtgtgcttttcccactttaattattttgcttttttgttttttggttttacaagaagagtagctctgaaagccactaaaatgtcgacaaaaaatgctgaattaaataccagtaatagaaacagaacaaaaaccagatcgagctatatgaatcgataggaacatatttttgaataataatagaaatattatattagtccaaataaacatgagaaaaacaacttaattggtaaatgaaaatacacttgtctcaactcaatttgatttgcatcacacctcaatttacagtagtactactactttcttcttctcaagttatttttcttggaatctttttgggatatagtaaatgcaaaagatttcattaacaagtcaattatgttcttcacagcagaggggcatatatacatttttttttgcaactacaaattctaaccaactgcattgcgacagcaagccctgtcaccaaaccacagtacagcccgctaataatagaaaaatggacagggttgcatggcacttttggggtatcttttgtccaatattgagtgtagtagctagtagatcaccatgcacagagtactctagtcagtgcatcctatggactctctagccttaggacgacctcaatggttggagccatccagctgaaaagagaaggaatcttagcacaatggaatctgaaaaaaataaataaataataatcatatgaacagcagcactactcttaactctatcaattagtgatatgtttattgttcattcatcttggctggttagttattggacatatatagcagttgtctgtaataactgtcttatactatactatttccgttctaaatagctaggatgacgttctaaaacatcgacagagtcttcaatgttttatcatttttttcttgaactatatatttgtcaataatacttaaagtataactatatgaaaaagagggtcttttgtcaagaatctaccaatatattttttacatcttaaatcctgatattttttattaataatttaattttcgaagtttgactgcgctcatatttgagcgatatgtcatatccgctaataaagaactcgtatcgataattgtaacaatacgtttctattgcggtgtcctttttggcatttaattctcccatgtgctatacaaattatggttagaaagagatggttgttactgacgtctctctttcatttctctcatccacatataagtaaaagggtctgtataagtgcgagtggacgataataatatcatagtatctgatcttgcttctacccacgacttgaatacgaaagaaagataattaattgagaaatacctttggtttttaagtacaataataaccaattaatttgaaaagtgagtgtagtcaactgattaattttttttattatggtggaatttgtctattcagaattaaattctagatacagagtgttcgtatttacgtctcttcggttctgtccatacataccgggtgtgcgtgtacacgtttatacgagtgcatacgtatgtcatatgttttaagaaaagaataaccattaaattaattatataaattaatcgatcgatcggcgacctttttgctcgtcgcgacgtcgatatttttggagtattaatgcccccatcggggacaaaaaacggtcgaattattttagcatggaaccaaaggctgtaaaagtgacgttgagagacgcattaatgcttgtcgcagagcgtacacacggcgacaagaaaagatttgcgatttgtctcgttgcacgtcctcacattagctgcttgatgaattggccctttccatcgatagccacattagctttccctaatggcttttgttttgtgcttgtcgtttaagcacgtattgtactagtatatgtgttgctaaccactaccttaattaattaattaattaagagagcatcatgtcagcatacctgctgctgctaattaacggatcgaatagctttcttgatggagcaaatcccaactaactatattcaggggtgcacatatctatctggtccaataaaattaatccctccattatctttaggaaaagaagcaatatccacatcattaaatgtaaggtagaaaagggattaagatcctttgatttaagtggtcactgacatttggcctaatgacgatgagtatacttccttcgtactcgtaaaggaagtcgttttggacagcgacacggtccccaaaacacaactttgacttcttatttctataaaaatatttattgaaaagtgatatatgtatacttttatgaaagtatttttcaagataaatctattcatataatttttacattttcaaactcaacaacttgagagttattcatgatttatattcccaaggtttgactcaaatattgtcctaaacgactacctttacgagtacggagggaatatatgttagtgaccatgtcagagaaatcctttctatagaaaagaggggtaaaaaggtaagaatattatgctcgaattggatcaaacatctatatatatatatatatatatatatgcttggtttgtactcataatatactgtggacaaatattgtgaaatggggtagatttatttgacagggagaagtagttctttttcttggtttgtgctaacaaagtataaataagctgcggaaaatattgtgaaatggaggaagtaattaataagatagatattatgagttatatatgtgtgtgttttgtcataaaaaataatcaatatattggatataaacattaatttaaattttcattacaatactatttgatttttggcaactcattctccatctaattaatagtacaaaacttgtgtcgatatacattattgaacctaactaatatccctcgcatcctccatgctctaccccttcctttccccacttgcttcatcccttgcttcatctactccacttattacatcccctcgaaaatttggctccatcgagatattttattcttttatttatagtgaggttgcctttaagaaaaatacagatttgcctgtagtccacacataagcctgcctacccatgaattcgttgcgccaacctttgcattacacaatcaagccaatggttctttgtcaatcttcatcgatctgatccccattaattacttgtcacttgatatctattcttaggcatgcacactatccatatgtgtttatagctgatctatagcctgttattgtacatgctcttaagggctgtttcgccggtaacacgaatcttaacgtgatccgatatagagcttgagagaagacccctccgattggtggagatcagataggtctatcattaataaatggagggctggtgtacataattggttggtaaattgatcgatcatcagcatctggggatccaatgcactgtactagtggccgtactgcaattataattaaaaccgctatctaaaacggatcgacacacactgatggatggatggattatgatgctgaatgcgcaaacaacacaatgtggccaatgcaaggtgtacgtggcctgtctgatatctacatatatataaacaattctcattgactaatattatattattatagcaatatatagctccctttttcatcaatttcatcggtgcttaatgctgccattaggatcccttcagattgtatgacaaagcttatcctaggccacttcacaagcagtggaggatctaggaataacatgaccttgtcggctggaatgtgagatgttttctgagaaaaatcgtaggacttcagctttatttgttcttttagtcaaagaacatttagaggcctactgcaaacacttcaaacctacctggtgagttgacatgcaacataataagtcactgtcacagtatcagtctgccaccaattcatggttatatatatatttatttgttatggtacaaaagtgaggtttaaggcttatataaggacatgcgtccactttcttgtatgttatctaaatagttaagagaaaatttgaaaaacttcaataacatgtactccttccattcacttattaaataagtgatattttatattaatgcgtgcagtcaactcgtttaagttttgaccattaatatctctttgaacacttcgagtttaacttaatttaaaaatgttgttgctagagttgactttaaaaatagtttcaaataattataacttttccacatttttcataagtgttactccctccgtctacttttgataagtatatttccaaatctgataggcatatttcaatccaaccacatatcctcttaatgactttctcgaatttaatgcgtgactctctattcttccacacaagattggctatatagacatcgagaaatgtaaatattaataaatcgtttgtttacgaggaatagcttaaatggatgataagtagaatcacttatccttggtcattgtaccaagatgaaatatgactatcaaaagtagatggagggagtataccgtagtattaattactctctccacgtgcatttgaatggagcctctagaaaatactgtactaatgatggacacgggacaccatagccatttctcccactattatttgtcctgagaattgtcagaaatgaattactctctctgtaaaaaaaagttgtatcctagtattatgacaaatgtttaatttattgagacgaagagagtagctgcgaaacggaaggagtaataatcaaacaactgtatcgctgaccgcctctcatctataacgtcacttatttgtgatcggaggaggtactatatgttatactatcatatatcaattcgatccacacatcgagagagaaaagggatggcctgtaaaagtagtgcatgtatatctcgcgcaaaccgagcgattgtgcacaagatatatgtcaatcattgtcgaccacaacagcatggaggtacaatggatataactgatagatgggcacatatacacacatataccgatcgacatagcttgttccttctcgagcacaaacaggatatgcaagtagcaaatgcagggcacaacaggatatgattctagggtaagatagatatatagatatagctctagatcgatcatacaatatatatgacatcgatatatccatccatgcaaaattgcaatgcaaatgcaaacaagatatacatacacactttgggattgggtcatatcgatcaatcaactttggcttggctaggctatagctgcatgctccttcatccatgcatgctagctgccggcctgtgtactgtatatagggtgactagatgaatcactgaaaggtcaccggtagctgcatgcacgtatatactcccaccataatgtatgacgccgttgacttttcgatcaacgtttgaccattcgtttcatttaaaatttttgtgcaaatatgaaaatatttatatcatgctcaaagaacatttgatgacgaatcaagtcataataaaataaataataattacataatttttttaaataagacgaatggtcaaacgttgatcaaaaagtcaacggcgttatacattaaaatatggaggtagtatatgacactattagctatagcacaccaacatatattgtgcaatgcaaaaacatgcttgaatcgtcatgcatatatatgcagcatgacaagcctagcctaagatagcttggcccaatttgaatcgcacatacatgtcctagtaagctctactcactaccagatttcggagctactccctccgtccgcaataagtttatttttggcttatttcatttgtcagaaaataagtatttttaaaataaccattacatatcatagtttataaaagtaatgaataattgtatcgggagtagataaaatgaggaataattgcattaggatttgataaagtaggggtattctattttttttatattggtatgtgtgagataggtaaaaaatattttttttgaatggaggtagtattaattttgacggttttcggccacacatgattggttcgaagcctagtacggagtagcaactttatataagtgatgcagggtacgtagtatagtcctgtttgatccggtactacatataacgaaaacagtttcatttcttttattttgactcatttggtatataaatttataatatatatatcacgtattcagaatttttgaagaaatttcataggaaataattcattcctcacaataatcaggcaaaattcctgcattgggctatctctgctgataattttcaggtcaagaaagaaacgcaacttaaaggaaaaggaaaacgagtaaaaatgaccttttagaacgtaaggggacctagctagctagccaccaaatgcataatttcgatagatatgtagagcatcttctatcatgaaatatcatttgtccttttcctccggcacgatctccttgtcaagctaatccaattcatgtcacattccgctaaaaataccagtcaattacttagtaacatatacagatatactatgaccgacatggggtttttctggatgcataaaaagaaaacctataaacgacaggccctgtataacatttttattctcaaattaatttagagaggaaaatatgaaagtttttttttctctgacacggatcctctacagtaccgcccctgttgtggaagcggcgagcaggtagatctatagtcccacatattaatgatacaactgtgcagtactatagataaccctcgtcgattttgtgtgtgtgttggggggtgggggggtacccatagcagagcagtgtgtgatgagctagcatgtcagtagcatatatcctcctggattcctttgtttgattggctagcctgctccatcttttgttacacatggttcaatcatggatgctacagcaggcatttatggagaaccatatggcagggcacagttaggggcccctctcttccaaacacccccttagtcagatcgacccagctatatactccttgtataaggaaaaaaaactaagactagaatatgatatgatgcgacctattttaatgcaatgaatttgtacaagttttttttataaatttgttgtactgtaatgtatcatattctttattttttttggaatagaggaagtatgtgtagttttactatcaaataaaagaaaactaaaacacattgctatataaatagtacacaaattaaccaaatgagttctaaatggaggctcaccatgtcggcatttattccaaacccccaacacatattgtctagggacattgtcaggccagggctggccaaatatgacaagatgaattgaagttaggagactcttgtctaccatgtgaatgtcacatgatgtggggtaacacctacctaaaattacagtgcaaaagcatagtcaatcgaaagtatgaacaaccgaggaggcgcgtacacgtcaacataaacatatgcaatggcgcagaaggcagttcttggcatgtcggatgtccacccaagctctactgttaccactacaattaccatcgatgcccgtaaaaactagctggttgtcaaaaaatactattaactatccatgctcgataataccgctggctccaccattacacatatggcatgcatatattgccatctagcaacgcgatcaagtaatccaaccggtcggtgcatgcaactcgatgataaaatgaaaatgcttatcacacacatgatgcatgcatgtgtatatatatgggattggccgcatctatacggaatggtacaaaaatcatggtccatgggacaaactcccaccaatggaagcattttttgtgtacatactgatgcacctgcacacacttagggtgtcaacactaggaaacattaggacaacatgttgtgtgagggtggtgggtgttgaggggtgtaatgtgatgtcctttggtgaggctgtgagggtgctggttggtagccacaaaggagaataggggaatggatggagtgtagtgtatcttagttgacaagacgaccagcactgatagctcagtggagatgcatatatatgtgcagcatgtatgaacaatgctattgctatacaagaatttaattcagcactggggaaacctaattgtttgggtactaaattaaaaccgttcatgtgtaggacatggcacatgtacaacatacactagctaattagctttttggatagctaggatagatagatcccttaggtaaacaaaaaagaggagaccggctttgtagtttctcaagcaccatcgatcaaagacaggactgttggttgaaattgtgaagtgatcgttgtgaaagaaagcagttagaatatctttatgaaaatatgccggttatcatgatcgtcgatgcagaagtttcttcatttccttgacctccttttgcatctgtaggagagattagtcaaaggtacttggacatggacatttggtaatacaaaatgttactgtatagttcaaaatatactgtaggtgcacacaagatttaattttgccaattcatattcgttactccctccgtttcaattaacttgtcattctagcttttttttagtaaaatacttgtcgttctgagacatacaaaaatatttttagagatgtccttcccttcaccaatgcagtaatactagtactagtactccttagagcatctccaacagtctctccaaatctgactctctaaatgtctatttggcaaactctccatctaatttagcaagtcaaactcgttgtttactccaacagcctctccatctactatctccattataagtctatgacaaatgggacccatatgtcaacctctactacacttcttccaccccattccccccatacatctccctttttcggttcttcctcccctctacctcggatgcggtgcgacaactcgcgggaggcgggccacgcgaggcgacgacggacagcggtggtgactcgtgggcacgcaaggcaacggcgggcatgggaggtgggccaggggaaagcagcgagcggcgagcggagaaggcgccgagccggtgggctgcagtgcgcggatcagctcctcgctggcctacctcgctccttccttaccaccgcgccctccatccctcgccatcgtgccctctcacccgcaaacgagtggtgtcgctgcccttcatcccttcttctctctccgaagctccagaggacagtggcaaggcggcagaaatcggcgctggaggccgacggcgaggcttgccgttgtgccgccctgtcgtcgcccttttccctgggtttttcctctgcacagccacgtgcggatctcgtggcggagaaaattccgctagaggccggaggcgacgctcgtcgtcgtgacaacggcgagccagaggccgaggcgacgctcatagtcgtgttgccctaccgacgcgccctcttcccttctcgcaacctggcatgacgggcagagacgagcaatgcggagagggacggggatagatcgatagagtggggggaaaggcgtggggcccacaattggccagtcagtttggctggccaagtttggctagtgggaggtgaagtttggccatccatctagtttagccattcaagtagagaggctgttggaatgagatttttttgctaaaatttctaaattttaacttgaagagactgctatacatccgactttcttgtcccaccgacgtacgactaaacgtcaaaacagcaaatgcacaacggcgtgaggctcaatgagttggaggattaaacagcgcggggatcaagccatggacggacgttgcagtcgtacaggagtcggacatttcggacgtacgtgtagcattttctaattttattgctggctttgagaagacgtacgatggttagcatgtaattaatgagggtagccccttccacaccacctagtttagtgtgaaattatctaatacgacaagtaaattgaaacagaatgaatatttactttgattgcaaatgtactgtaagtcatttgctagtattttcgtacaacttttatggtcttaaaacatgcactagtaattcatattaaatttcttatgacaacctactatctattcgcttcaccctaaaagaccttatttttaggcgtgtgtcgattggcccactttattatcctcgtttttatctcccttgattaccgtcgtccccacctccaatagtaagttgcaaatatcattaattagagcttggccatgtgaagagttaaaggttgcgttcgtttcagcctgttccgaaccctttcatctcgttttccgtaggtatgcttttcaaattgttaaacggtacggtttttgtaaaaagtttctatataaaaagttgcttaataatcaaattaatctatttttttaaaaaaatagctaatacttaattaatcacgtgctattggaccgctccgtttttcgtgcggaggagatgggttcccaaccccggtaacgaacacagccttagtcgagcatcaaagcttaggagaagcatacagttaatgaaaggcgtattcattttttcacatccttattaatatatctgagattgactaagggcctgtttagatccctgccaaaaaatttacaccctgtcacatcgaacgtttgaacacctgcataaagtattaaatataggctaaaaaataactaattacacagattgcgactaatttgcgaagcgaatcttttaagcctaattgctccatgatttgataatgtggtgctacagtaaccatttgctaatgacggattaattaggcttaataaattcgtctcacagtttactgatggattctataattagtttttttattaatgcccaaacactccatgcgacaccctatataatatccaatgtgacacgtcaaaattttacaccctagatctaaacatcctctaaatataaggtattttagagatagagtaagtaatatatatctagagtcccaatgaaaagtttaaaagggactgtccatgataataacctgtattatagatgtcatgcatgttcatctttttcaaggggaaattaagaaacatgtctaattagtatatattagcaattaattaaaatcatcatcaatcgcaatcaagtccattgaaccaggggggcaaacaccatgctcaatttgccaagtaccccatttgtggatcctctccatacactagatagtgtccactgattcatccacataagccaaacacagtgtttcatgttggtataagctggatctatcactcttatcccttgtgtggctccttcattcagcatggggtcccatgagcaatgtccttttgtttccttttgtgctaccacaaagcaccggaaaatggaacatgattcaattgacaaatcttagcctaaatacgatatgtgaaattaatcgtcgatcgatcgcttaggaaggataaaagttgttaggataatatcataatctgtctgagcatcatttgcattgaaagtcatagacaagatgtggacgaatccgtttgagatcagtagccagtagtagctagacatgatgatggctcggtttattagtccatcgtttcatttccatgctaccatactgctacttccttcataaaaaaatagtgtattgaaatttaggctatattttattattatagtttttctttgaatcaccagtaaaccaatctttttactttggaccattgaattttatcgcttttatagtttaaccacccccaaacaacttcttcattacacatcaacgacctcaatcaaattggttctggcaaaccggtcgccaaactctcctatccatatgcaagccatatctttgctagactggaggctagatatgagtagaaaagagagttggattatccaaactgaagaaagggtaaaataatattttttttattattatttttgaaccttttaaaattttattttaaaaataaataacccttcatattttaattttctaaaatcggaaccttttggtcatgacagctcgcctgacccagtaaaataacaattttcgtcatgctacctaggtgtgacttttatcctaccacaccagccataatgacatggccaaataatgttgccacactagctatatcggcgtgaccaaataacgttgctacgtcatttagaccgtgtgacaatattgtttcgccatgccagcttggttagcttgaccagaagattcggatcttgaaaataattttggaaatgtttatttttaaatttaaaattttaagaaactcaaaaataaaaaaataacaatctgatacaaaatagaaagattggtttaagggtgactcaaattaaaactttaattatatgtaacatgaataacagtatatatcatggttcagtttattaatttctagccacacactctcatctttccttcgttcctacatattttatattacctaggacaattcagtcactttctcgtgtagtgaactaacgacaattccgtaatatacacgcataatatacctgtaaaaatccgagagaataatacctttggtttgttttttcttgaaaaccacaatgagagagagatgccttttcacgcatctt

SEQ ID NO: 11426 - DNA, 3135 bp, Oryza sativa
ctatcgacgaattgttttgtgtcaatgtctggtgcacttgcacagtgcacacatgttgttagggttatgaatatcacatacctaatagtagttgactaaatctcggtaggacccaccacataccatgtcttatacggaaacaaccttcggatatacgaggagttatgcataatgaaggatgaatagagttctacatggaaacgacaagaactactcggatttatccataatggttttcctagttctacttggacaaggggacacctatgggtataaatacaaggcccctaggaggagaggggacacggaacaatagatcaagacacaagatcaacatacaagccaacatgtgccaagacaagacgtcggatatcaacttcagagataagcatggttagtcccctacgatgtctacggatactctcaggagagacataacgctgtctttaatctcgccggatacggatttgaggaggaaggctaccctgttgtcgactacgagtcaacacttcagaccgtcaagtcgacaacagttagataggttaccctaaatattatgctggtgtgattatggtgaataagagtaacgaccggcttcggccaacaggagtagggttattacctgacaattcagggggcccaaacctgtataaaaatcctcgtccacatctcttttattacaatctcgcatatattctagtaccaacgattctcatactatgcaaataccggaatcgcgacatcaaacgtcgacacatgtatatgttgatatttgctgcgaaaagtgcctctgctttcccagtattaattgtaatattgaggggtatctgaaatatactgatagaaactaacagtaaatccccactacagaccggcctttttcagccgaccaaaaccacctttcctagatagatggagcacccacctaagacaatttatgcaaaagtcaagattttctattgcgggcatcataaccgtatgacggaacggattttcaaccctgactacaaaaagttttttggcgaaaaatataaaaaatccaaaaagttacagaaaccatagccccaatccccaatcgaaatcgccgccattgcaattcgtcatcatcgccgcaaccatccccataatggccgccaccgactttgttgatgccatccctggactcccgtcgttggatatgcctctcccaaggctagcgcggtcatcatcaacgtcgctcccatgcacgctggggatctgccccaaccgaggccagtggcgatggatccatcgcgcgctcccaaggccgccgccgctcctaaggttgttgtcattttcgtcgttgctcttgaggccggccgccatctacaagaggggaaggaggagccaaggcagtgtcctctgtgctgtggaaagaaaaaacgaagaggagagggaagtgtggagagtttaaggaaaatgtgagaagcaaggtgttgttggtgttcgtgctcctttattttaatataacgtatgtgttggtgcgtcttggtcgtctaaaatacagcgccggcccggtgttgactgtgagagtcctatatattttcacaagtgaatcttcttttagcccatttgtaaaaataaagggagctgtgaaaataattttctaagtattgagttgttttttaaaatcatagtctaattaacacacatgtttttagtttacgattagagagaagagagaatggattgtcaatttacaacgtaattaaatacatgtgcacgaacggcagttttgttagatatattctgagagtcaatacgctacaagaaaacggcatgtccttggcggtcgaaaaccaccaagtataatctaaaaaccgccaaggttaattattctgtcggccgaccggccaaagctaattatatagtacaagggcatgtttggattgataccctatcaaaattttgatagtgctaaatcttagacatgccgccaaaactttggtagggtagagttgaaaatgttgattttgattgaagccaaaatatacccataaggtataagtttatgggcaaagccaaatttatgacaaaggtaatgttttaatataggtgtttagtttgctaccctaccagtgttttggtagagtaaattttggtagggtagcaatccaaattggctctcaattcgtcatattacaacaaagtgtaatactggactattgctttgctcattgtaacactgacattcaacaacttaacgcactctaatagtgcgaatccgaacaggtagttttggtttgtataagctggttatatctgctttacatttatattgggatggagggagtacaaatcatcgtccttcgagattcgagaagcctagagagagtagatagatcgaagaatatatatatatcgatttgatttgaggcagggctacgccaacggtcacgaagaaattaatgatcaagtggctgattatcaccagagtactctgcgtgttcgtcttttgttttccttgggctgtctgtcccgatctgagttttttctccccttttctgtgggtgatcgatatcagaagagacgagattagcagcagcagtctgcagctggctagcatctcttgtcatcatctgcccccaactagatagatcgatcgatcgggctagctgccgtaatgcagatgatagcttaggtagctcgatcgatccaaccatggatcgctctgctcatcattaaccccaattatttgttactacttttttttttgcgggaatagagagctttattgattacgtaacaggattacagtcatgctgcagacattgcataacacaattcggtgcattattacgccaaaccgcgctttgccccgaacggatagcaatctgagcaagttcatgtgcgaccctattacactctctattacagtgcatcaaacgcacttccttaattaaccctataactgatcttgctgctcgcagcagaaaagaccatcttgatctctcttcagtagtggacaacaacctcgcaatcgctgtggcacagtcatattcaagcataactggcatgggaatccattcagcagctagcttcagcccttcatagcacgcaagcagctctgcttcctccgctgacacacatcgcctgagaaacttccaagaagacaac

SEQ ID NO: 11427 - DNA, 4466 bp, Oryza sativa
tagcatgaaacgcatcttccacttttgccccacatatctcacagtttggcttttgtacaatctgtcgtcgatgtttattatgttgtgtggctagacaatctcttgatactctccaggcaaaaatccttattttctgcggcacttgcacattccaaatgttcttccacaacttcctatcaccatcgccatttgagcattgtgcaacctcttcgtcagctctgatctgggcctgtagggctaatttgtaagcagaaaaaacagtgaacatacccaccttatcatagtgccaagcaatgaagtcctcttcagggctatgtggcaattggatcctcaaaatttcctcagcatccgggggatagaagattcgacgaactagctcttcattccaaatttgctgatgtggaaccataagatccgagacccatttgattctcaatctaacagtctttcccaaaacccttagggtatgctctctcggtatccagttatccctccagattctaactttgcttcctgatccaatccaccaaattagaccttgtttcagcagctctaacccgtggaccacccccttccaagtttctgaagagtccacaaggaaagtagtatcacacaagtccccattggggtaatattttgcctttaaaatttgagcacacaaactgttgggaaactggatcagccgccatgcttgccaagctagcagagcctggttaaaaagctttaagtccctgaaaccaattcccccttgtcctttgggtttaatcagttgctgccacgagatccaatggactttccttttctaacggtcttctccccaccaaaatttccggatcagctgcatatattcctcacagagccctgctggaagcttaaacacactcatcacataggtcggaatggcctgtaggactgatttaattaaaacttccttccctcccatagagaggtatttctcattccaatccgttaatcttttctcaaatctctccttcaaagattggtgtcttcctgccttcagtctacccatcggtgtaggcagaccaagatatttatcttcaaaggaagtgtgttgaacttgcaaaagggatctgatgtcagactgcagagcatccccacaatgctttccaaacatcaaagaacatttggccgggctcaggagttggcctgtgctttgctcatacaaagtaagagcactcttaaccacattagtctgttccatatttgatttaaagaacaacaggctatcatctgcaaacaagagatgggaaattccaggggctctcctgcagacttttagaggttgtaaccgtcctgatctttcagcttcactcagcgccgttgataaaccgtctgccacaaagaggaacaaatagggcgacaggggatcaccctgtcggaggcctctggtcggtttgaaggattcaagcatagatccgttgaagcgaacagcatagctaacagaggtaacacatgtcatcaatagctgaacccattgagaacaaaaaccaaccttaagaagagctccctctaggtatctccaatccaccctatcatacgcctttgtaaggtccaacttgtaagcacagaattgagactcaaccgatttacaccgattgatggcatggaagcactcaaaagctatgagagcattgtcagtgaacatctggccgggaatgaaggcgctttgcgctggcacgataacatcctgaagtaacggccgcatcctattcaccaaacacttagcaatcaccttgtaaatcacattacaaaggcttattggtctgtaatctttcaaatcctttggctctttctttttcggaattaacacaatggcagtgtcatttacaccttgtggcattcttctctgttcaaagaacagcttaacagccgcaataatgtcccgtttcaatacatcccaattcttctgaaagaaccttgccggaaaaccatctggccccggcgcttttaacggacccatctggaacaaagcatttgaaatttcgtcatcagagaattctttacaaagcagcttattcatctccgacgtgactctgggctgtaccaaatcaagtaatggttctggctcgacagaagggtcattagtgtaaagctctttgaagaaatttgatgtcatatcttccatctcctccctcttatcacaccaggttccatcacttctctgcagcctattaatcttgtttttcttgtggcgccaagccgctttcctatgaaaaaaggatgtgtttcggtcaccttccttcaaccaagagattcttgatctctgcagccattgcatttcctccctatacaagagtatccagcttcctggatatatcgagatagtcttgatcactagcacacctgcctgccatctgaagctctgccaatcgattccttgtttctttaatatctttgctaacttaaccaaatttatcacggctccaagtctgcagtgctcccatcacagactttaagcggcttgccactgagcctaagtctgatatatgtccctgtagttgccaagcagatttaatctcatctgtcagatgctcatccctctcccacataatttcataccgcagacaccgatcccctttcttgatgcgatccactcgggaggcttggagaagaataggactgtgatcagaactggacacagtaaggtgaatcacttctgcagcaggaaagagagaagaccaactctggcttgctactgcacgatccagtcgaactcgcacattattccttcctttttgcttgttatcaaaagtccagggggcacccgtgaaacctaaatcaaacacatcgcagtgcgacaagacttcccggaaatccataatctgcttctcccttctcttgtggtcagaaaaatgctcaaactgccacatagcttcattaaagtcgcccactaagcaccatggagcagtagaatttgatttgatgcgacgaagaagagtccacatgttatgcctttcgctagctttgggctcaccatacacaaaggtgcatcgccattgcacagggcagctttcgtccttaatgagcacatcaatatatctgaagttgtaggatagaagatccacttgtactgtgtcatcccaaaagagggctagtccatcccccccctccccgttccttctccaggcactgctacacaattccgcagccccaatctctattttaagccacacactctttctatattttgatgtgtttcagacaaaaaaaccagcttgggcttgtgtgtttgcactaggcaaacaagatcttgaactgtccgaggcctccctgatcctcggcagttctagcttaaaatattcattgctcctgacgggcttcctttggaatgcccgtcaggtggatcgactttgctgtctatagagacaaactcttactcctcttactatcacctccaactagaacatcaaacgaaggtccatcatatcctgggccaaggagagatttatccatactcctctttcctagcacaggttttaccccatcatcgatattttccttatgtccctcaccaagttcctcatctctaagctggtttataagagagatatcttcatggatcgttgataggggtggaacatgttcgtccacctcctcacggccattcccagcaccttcatcaagctgttcgtactgattgattgaatctttgctagacacccaagtctcccctgcagtctcactccttatttgtccctccttagcttgctgtgaagctgcgtggaaggtaggctgatcttcttgagttttccccatatgctcccactgttcagctagcttcctgacctcaccatcctccctggattttcctgggttcctagcatttaaacccttcaactcttcctgcaccgtagggatctctgcctctatctcatcccggttagcaaaattttcctttactggagcattttcctctggcgagttcttcttcctatcttccttgcctgatgggccatctttattttggcttcccgcaggagctggcttggactggttctcacctgggaaccatagatttctcttcgcgttgttgtcaactttaccaggcagagcccagctacgatgttcaaactgcttataaggtgacgccctgagattaaggccaaacctcaccgtttgcttatccgagggtaaatcacattccctctccatgtgaccaatgtggccacagtaaaagcaaaaccgagggatcctctcatacttgacatcatacctctgaaccaccgaagatgactccttgtctttcagtttcagccaacacgtcagtggtttattcacagggtgccccgcccgaactctcataaaatcattccatgctcttccctgatcatacacccgcaccttacgaacctcacccaggcttgcaccaaacaattaacccattggttcagtcatcatagacaggggtagatcggaaattctcacccaaactggtagcgagttca

SEQ ID NO: 11428 - DNA, 4532 bp, Oryza sativa
  unsure (1)..(4532): unsure at all n locations
nnnnnnnnnnnnnnnnnnnnnnnnnnnnnnnnnnnnnnagttcttcttcctatcttccttgcctgatgggccatctttattttggcttcccgcaggagctggcttggactggttctcacctgggaaccatagatttctcttcgcgttgttgtcaactttaccaggcagagcccagctacgatgttcaaactgcttataaggtgacgccctgagattaaggccaaacctcaccgtttgcttatccgagggtaaatcacattccctctccatgtgaccaatgtggccacagtaaaagcaaaaccgagggatcctctcatacttgacatcatacctctgaaccaccgaagatgactccttgtctttcagtttcagccaacacgtcagtggtttatccacagggtgctccgcccgaactctcataaaatcatcccatgctcttccctgatcatccaccgccaccttacgaacctcacccagccttgcaccaatcaatttacccattgtttcagtcatcatagacaggggtagatcgtaaattctcacccaaactggtagcgagttcagtttcacatccgaaggtctagacttgccatcatactccgtgatcaggaaagcatccccttgatagatccaaggaccgcctccagtcgcaaacctgaaatcccctgcagattggaattccagtagaaatcggttatcatgcaggcgtttgtactccatgccttgtctcaagccccatgccttttgcatggcttcaaacagtccctttgcgctgaaagtcctccttgagaagaacttcccaatggccacatactgtgtatcaatatgctttttagcctcatcaaagtctaccacaattgcatcttcatcgtcttcctcctccgaagccccgcccagatcttcaatcggttcctcatcggttgttgcaccaccttcatcacgatgacgatcgcgcggatcttcatgggatgccatattgccaagaaccaatttgatctatatgctggacttccccgactgcagacgacgcagcagacaccaaagcgaatcgatctacaccgaggtcaagaccaaaccctaagttcttgtataaaggattgcaccagagacctagattgacccggcctagactgcaggttaaacaacacccgattcaatctggaaagctccaggaatcggacagacaaattcaactcccgtggactctagcatcgcctggcgtgacgacccccctcttcatatatttgacgtgatgagacaacttcgatgtgttaattatttgttactactagtagtatagtatatgtatacctgcatcctgcctgccagatacgtccaataactgagcaagtacgttcatatataagtatatgttgtttaaaaagaaaaagtacgtagcactacctccgtctcatgtgtagtaggtttttgtgtctaacatttgaccgtacgtcttatttaaaaaatttatgaaaaaatttagaaaacaattagtcacacataaagtattatttatgttttattatctaataataataaaaatactaatcataaaagaatttcaaataaagcggacggtcaaacgctaaacataaacataaacagaaaaaactacggtcttttcggtctcgatgttgatcttcctcagcccaccccaagttgcatatacgtatataccctctccttttttaaatagatgatatccttaaatttggtgtaccacttgtcagattttaaaattgatgcatacatgcaaaagtacttctttaataacgaaaacaagtcataaaaaataatatctttatattttttttcaataaaatgagtgatcaaacaatatattaaagtcaataacatcatctattgaaaacgaagatagtacatatagtatactataagtatatacgacacacactagctgcatgtgtaatccatcgtcgcccaatcgatcagaatcaacgtgtatacataggtagctaggaatggtatgaatcgaccattgcaattattgagctactatttcttccgcttcaaaataaattaatttaggaatctaaccaacggggccaaaccatgatataccatcctactattattatttttgttctaaaatattactgaggatttgatttatcctacaacaacgaataaagatatatttatttttatctagatttgttattttaatatggattaaattttattctagatagcaacgaagaaaagtactacaaacgatatgaataactcgacgatcgattgagatagctagcttagctgcacatattgacccatgaccgttacgtacattgaccggccggtttctggttatagcttggcttaaaccatagccgtacgtcagaagagtcagggcgcatgcaggcgattgatcatgtcgccttccgacacgcacgcatgcacagcccatggatccaaccaaggcacgccacgtgtcccagcaacagtcgcgtcacccctagctaagctacactcaagctcagctatagctactcactccactggctgatcgctctctcaatctcacttctgtactccctccatctaaaaaaattaatctaaaaaatttaatccagtgtaaatctggacacatataactctattatagatgtgaatctggatacacacttagaattaggtgtttttttgaaacgaaaggagtacgcaagatatacgtatgtatatagagagaacaaaccaaatatatttgtatatacattagcagcagatcaagctgcctccaccactgtacgtatgtatatgtatacacactggtggagacagctcgaccattaccatttacgaactgccattaacatatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaaggaaagatggtagtaataaaaagctgggacgagtggatcgatccatgcatgtgttgttgcgtacctgcgatgcaggtagaagatgctcctactgccccccttttgaaggtgttagatcttcaatccatcaatcaatcccgtttcttctccatctctcatcgccacgcaccatcgatcgatcaccaaatggttagtactcagtacagtactcctcatacctttccttttccttttcttttttttttctttctttcttgttagtagtagttgctgctctagctaggttgttgttttgcagtcctcggaggcagcagcagcagaggccaggggacgcagaatctgctatagctagctgctgctgctgctgctacttccaaaagagtacccccatggagggacgccggttgcagcagtcaaaaggcttgcaggtgtcgacctcccattggctcaccgtggctgctgcaaaatgctcgccgaatattgcactgctgccgcaccagccactacgtacgcagtataacgatcaagccaatcaaggagcacttgcctgtttgatagagctcccgctccaactctatccaaccaaacagtttcagctcaaacaggctaaaataatctgaaaaaaattagaatgaggcgaggtttcggctgttccacagcttcactttagctccgagttagatctagttgttggagatctgccaaacaggcttgcaacaggtagcttagctatacacttgtctccttttttctgctgggctctgatctctgctagctccagcatctcccgtgaccgggaggaattcatcgtgacgacagagagaagagacgcgtgcagttctgaagaaacgaaatggattgatgcatgcatagtagttgcagtacacatttgagcgctatagctggccagagaattaatggtggtgtacgtcgtgctccctatagctcgcttctcgctcgtcgtcgtctcatcttctctggaagttgaggtacttgatggccagggcgaagacgacggcgaagagcacgcagaagccg

SEQ ID NO: 11429 - DNA, 597 bp, Oryza sativa
  unsure (1)..(597): unsure at all n locations
agctcggtacccgccatgaggacaaaggctgcctctatgcatggtgatcctcttcttctgtcatgctcttctaatctttcagagaagctgttgatgctattttatgttgcttattaatttggatgtcatctaaactaggttatattctctagattaggatgtgatctaaggtatttttcaaagtagaaattaggacatgtttgttcatcttggatgcactgttcaacatttctcaaatcatcagatagttcatctagtttcttcagacaagctgatttctgcatcatgtgagcattgaacacactcctaaagtcctactagattcagagatggatgagctgaagtagttagtggtcattttcatgtccaagaaaaccaaagatcatgtgagattttgccctgatcaagagggcttcttcaccatttgacaccttttttcctctgtttacctgtgatctctttccctttttgttgcagcctgttcaccctctgctgctgcttctgctgctacgagacctgcgagtgctgcctcgaatgcctctgctgctgctgatnnnnnnnnnnnnnnnnnnnnnnnnnnnnnnnnnnnnnnnnnnn

SEQ ID NO: 11430 - DNA, 398 bp, Oryza sativa
  unsure (1)..(398): unsure at all n locations
nnnnnnnnnnnnnnnnnnnnnnnnnnnnnnnnnnnnatctcctgggctttgcgatgaaggagttgagggttctgaggaggggaccgcggtgtttccagtgccagaactattggctggaccagacgatgagattggctgtttgcgttttcgcccattttgattcttggaaacctgcaaaacaatatatttatgatggatacaagtcttaacaaaaggataggcacagtaacaaatcaaggtggtaatgttgaatatatgtagaaggaagtgaaacctgttcacttccacggaatgaattagacaggctttcatcaatagtaacacttccagctcccattttttcctgctggcctggaaggtgattagagattggtggttgctggctaagtaaaaaatgc

SEQ ID NO: 11431 - DNA, 709 bp, Oryza sativa
atgtgggagaccgcatcccaaagcatgtcgggcccaatctctcccgccaagcgaagggcctcggcctacccggtggaggagtccagcgctcgctgcatttccgcgacggtgtgttcggcagctgcgaggcgggcggctaagtcgctttcgtccgcggccgccccgccgataggcgccctcgcgtccagctccttttcccgcgcctcgaggtcagcagcccgctgctccagtgcagctctctcggcgcggacgcattcaagattgcggcgcgcctgctcctcttgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggatagcagcggcggcctcgcggtccgtcaagcccctctccacggtgccggcgtgttcttccagcgccatggcacggtactcaagggcctccttgcgccgccgagacgccgcttcagtctccgttacccgccgctctcgggcagcgccggagtcaaggaccccttgggcggcgtcgagctttttcttcagctccgcctcccagcttgcgtgctgaagccggagggtgtcttgcgcctcgatcatcgcggtggtggcgataagggcgg

SEQ ID NO: 11432 - DNA, 840 bp, Oryza sativa
cctgcgaaacaatgggagagatattggggaaaatatcctccaatccaatcctcaccttagttttgtcatgactttccctcggttgctccgcttggggcttcgatctcactgtgggtgggcactgtagctagtggtcttgtgtcgccattgatgccgatctcgggccattcctctgtcgaaacttccttcacgggctgcagcttcgcgccacgagcctttgcttttgggccgcggtgccacttccgtgaggatatccgcatgggtaaaccccatgggacaccggttggtgaatggtgatcccctccggcaatcgccaacgcgaggacctcggtggtattgccatgttactcctgctctccctaaaccctaagctcaaagccatctttcctcaaaaggcaaataattgtcaacactggctgcttccgctattcatgatgcactaggctcaatcattcaatcgattcactatagtgagttagtgacctctgctcgtaattgtctgttcctcttgaaagcaatggctcctcttccggccgccggcgcggcggggcgcatcatcctggcgcacggcgcgtgccacggcgggtggtgctggtacaaggtcgccgcgctgctccgcgccgcggggcaccgcgtggacgcgccggacctcggcgcggccggtcagcgaggcctgggcgtgggcggcgcgccggcgtcgtcgttcgcggaccacgcgcgcccgctgctcgacgccgtccgcgcgctccccgacggcgagcgcgccgtgctggtgggccacagcttggcggcatgagcgtcgcgctcgccggggagacgttcccggacaggtcgccgccg

SEQ ID NO: 11433 - DNA, 8522 bp, Oryza sativa
  unsure (1)..(8522): unsure at all n locations
ctaatcagttcataacctaatcagcacaggattacacgcttgcgaagagcttggttcgagcgagctccttgtacgtggatgagctgcggcggcgggcggcgttcagggaggacaggtacggcgccgtgagaaaggtgtatgtggtggtcgagaatgacatggccatcgtccaggagcaccagcggtggatggtcgccaacgccgaggtggcggaggtgagggtgatggacgccggcgaccacatggccatgctctccgcgccggaggagctggctgggcacctcgccgacgtcgccaacacatacatctaaaattaatgcgattgatggagaattagttaatttgttttcttttggatgacattatggtgaaacttgatttgggtataggattagtactaagtagggttaattggatccagccattataaatttgtctatttgaaaatatgacattacaaacacatattgtaaatatttacaatatttttaatatgtacaatagtttttttaaaaaaaataaatccattttcaatatttacaatagctaatatttaattgagagtaaactgtactttggacccctttttattaactaagttacatattgcactaggtaatatcatttcttttcatttacactatgttttagtattacccaaacttgcatattggactggtgactcacatgtaagtgagcaagattttcttcctcctcctcggtattccctgagcccgtgtggtgcatgtcactcaccagccttgttaatccccacggcagtcccctcttctcaccatgccgaagaaagatccatcctcttcttccccactccaccaaacgatgatgaggttgagcgcgctggatttgggatgaagtggtgaaggtggatgagcctgtgcagcacagtggttgagttcgcagatgaattggagctcgatctttagacgtggaaagtgctggagctcgagctcagggcaggatgtcctcttgttcttacccggcagcaagcaagcaagcagagcatggtgacctcttcacctctttctcattttttgctatcggcgaggagccagcttgagcttgtttggccctgttcatggcggcaactacaagctcagatttgcatgcctaaaggaaaggagtacagagatgacaagaacgggtataaggtgaaacgtttagcaaaaatctgattcagagtgaaaagggtaagttaatcctagtccaaattacaacatgataaaaagagacggttcaatataaaatttacactttaattaataactaaaaaagtagcccgcgcattgcatgtgtcataggttgcatctgcaatgtgtcataggttgcatctgcaaagtgtgatttctccgtaaattttctttgtcagaattgcctaggtaattttgttaacttttatactatgcaatatttaatacatccctataaataattttctataatattcttatcatctaaaaagaaaaagaaaggtagacttagttttttaggaaacaaatttaacacttaaaagtaagattttttttctttttttactttagtgtttacggcctctcaaatgcattctatttttaccatcaggctagccctccttttatttggttcacattgatgtgatttgttaaatacttagatatgaacaataaagacagggaaaaaatatatatcatagaactcacttccctatgatattggtgacctatggtgtttcttttttaaaaaaaacctagtcaacattagttttaaaacttaaatataaaaaaaaatacctagtcaacttaaatataatttttaaatcaattatgtactactaccttagtgtggcttatatatgcaataatatgtgaaaaaattcatgatgcatggcatatgatacagagaaggccattaatatataactacttaaaaataatgcaatggttatggcaaatgggtgtttcaatgtagatgagaattaagagccaaaaaactataaaattttctccaattggttcaatttagtccctattgacatttttttttctattttttgtttattttatactaatcttattttaagtcaactttgaaaaataatcaccaagttaagactgatataggttcctattgttaattaacagatggattgtgtgggatatgaggctacactaaatgtatgcatttgtagagtccaatgcgattggggaagtgtgggagacgatctattggaaatgtttaatgtggagtgtgcgaggctcaatgcatcctagctagtattaacatgatcagacgaataaatatagctgcacaaacatcactatttttgcaatgtgatgtattatgattgcttccataattttaatatttttctataaaatttatattttaatgctagaaatcatgtaactatgtatttctttttaatccagcctacacttggcatgaattaagtacatttatattatataatctttatgtgaagcctacaatgccaatccagttgcgataattatgttgcattccataaatttgtagaaagaccctagaattttttctaaataatttaagtgaaaccgatgatcatattttttttctcctcggatttctaatatgtttcctaacttttaagaaggggcaatgtgggtgcttatggttttccaaaaggtagatttagtggttgggaataataaaattgcaagacttatatatatggtctttagcatcacttatatggttagaattggaagactgatccatacttggagttgaaagtccttccacacatgctgagcaattggtctctcaaattactaatctctaattgcctgcacaaaccaatgatcaaatgttttacttttttaatttgaatttctaagttttttttctagttttaaaacaatgacacatggagacttaagagcattatagaggatgtttaatggttctttattacgtagaataatttaagatgacataaaacttatcatcattattttcaatgctttattgttatttggttgaggtgcaaaagataggggctatgttcaagattttcaataatttatataactatataaaaattaaaattagaatgttatttggtttccatgcaaaagaataggggtatatgttgaaacgacttatttgattttttttatatgagtaatataaatctcgagttatttagctatccatttgtaaaacagttcaaacaaattaaaaagcaaatataactataatttagctatgtaactattagattattttattattatgtcattagttcaaaattaggaggggtgaattaaatgggaggaggagaggaggggagagtggtgcggaaggagaaacatataaatgtaaagcagcagggggaggggaggatagtttgttttctttacatagatccaattggtcatccatttgagttgtctatttttaaaaatagatcttggttgtttttgccataggttcggatacaagatttattaaaaccgtgtatttctagtttcacaaatccatttatttatatccgcgattacattgatagcattcgaataaatcattttgttcctattttagatgaaacttaaattttttaaacaactataatttaacatgtaaatttcaaatctacaatggatcaaagatatagagctatgccaaacagatcctaatggttaaaataacatgcccaccattttaggaataaacgttaggtgttttttttctcatgatttctaagattttttatattaagttgttagttagaaaatagaatagcgaattaaatgggagaggagaagagtgaattaaataaatctgatgtggtgtttcaatttttaagtttcctgttttgattctgacattaatttatccatgtagtattatgtggatcatgcacaatctttaattttaattttgttggtttaataatctactccccccatctcgtataatcagactaatttaatgttgtagatgttgctatattttttttataaatttggttaaactttttaggtaacgaaacaaaatcaaagggtcgtacactatgaaatatgaaacggagggaggaataatctctcgagcatgcagtccttgattgttttggtgcattaatttgtggatcaagtgcagtcttgaattatctctcgatcatgcagttcttgattgggttaaaaattggagtccttttttttaaaaaaattagatctaatgtaaatcaacagttagatatttttcttttttatcagaattttaggatttattaaaacgccacgtggtggtttaggagcgtttatagtaagacacgtgtcgtttcaggagtgtttgtaaacaatttaataaatttttagtatataatagatagatagatttgttcttttttttaagccaccaaccggcgcagccaaatactatcctgctagttttatcagatatttttaagatgagcatgggttttaagaaggttgatggaaatgattgaagaaatattgcgatttatcgagaagagaaagtatatgagaaaattaaatggataatagtcgtgactaattgaaaaaattaaaggatatatatgaaaaaatagctccattttaagatatgatagctgctagaaatagataaatattttataactataagtaaacgtcccctaccaatagccacattatttgactggactataaatttttatatattttttttgtcgaatcttggaaaatgagtcacgctcatcatagggacaggatcctctacagttaaagtcatgtaactttgtcactgtcacgtgggtctaatgatccctagctcacatgttagtaacaaagaaaaagaaacttatccttgtcacagactcgcaacagcaggcagtgccagtggcggcccggcgcacctcccagcctcccctcccgttgcatcagccgtgacgcactacccgactcccgtggaactcatacccgcatgatgagcctatatcaatgccacattaattgccagtttgccacggtgcgctgaattactagattcgcacgagcaacagttagctagctatagccggcgccatcatgccctcgtcgacggccgtcgtcccggcagcggcggaggcgagcagccgcatcatcctggtgcacggcacgggccacggcgggtggtgctggtacagggtcgccacgctgctgcgcgccgcgggccaccgcgtccacgcgcccgacctcgccgcgtcgggcgccgacgcgcgccggctgcgcgacgacgaacgcgccccacgttcgacgactaccccgcgcccgctgctcgacgccgtccgcgcgctcccggacggcgagcgcgccgtgctcgtggggccacagcttcggcggcatgagcgtcgcgctcgccgcggacacgctcccggacaaggtcgccgccgccgtgttcgtcgccgcgctcatgccagactgcgccagcccgcgccccgacgtcatcgagaaggtaaaacacacatccaagaacactcctcctctgttctcactcgatcaagctgacgcaatcttcttcttcttcttcttcttcttcttcttcttcttcttcttcttcttcttcttctccggggaagcttccattgacggactgggtggactgcgcgacggacgaggagcacgcaccgccgtcggtgctgttcgggccggagttcatgcggcggaagctgtaccagctgagcccggaggaggacatcacgctgtcgcggagcctggtgcgggtgagctcctactacgtggacgacatgcgccgccagccgccgttcggcgaggaccggtacggcgcggtgcgcaaggtgtacgtggtctgcgggaaggaccaggccatcgtggaggcctaccagcggcggatgatcgccggctgccccgtagaggaggtgagggagatcgccggcgccgaccacatggccatgttctccgcgccggtggagctcgccgggcacctcgccgacgtcgccaacacctacacttgattttgattgtactagctgacaacacgtcgccagcataacataccaaggccgtgtttagttagatacccaatttttttttgacgtatacggacacacattttaagtattaaacatagactaataacaaaacaaattataaattccgtctatcaactgtgagacgaatttattaagcctaattaatccatcattagcaaatatttactgtatcaccatattgtcaaatcatagcgtaattaggctcaaaagattcgtctcacaatttacatgcaaactgtgcaattgttttttccgtccacatttaatgctccatgcatgtgtccaaataattgatgtgacggaatttttggatgtttgaagaaaaaagttgaatctaaacacagcccaaatcgggaagagtagacttcacgctctcacaacagttctagttggttgcccgtattcccctagcctagctcatctctctcatctaggttaagtttgacctggctaggaagatacatatacagctattggttgttgcattggtctagccacgctagcatgaggttttgtttggttacctatacgatagatacaattgagaagagattttgtttggttggttgcatggatgtaagtgtggttaccttctcatatagttaggtgaggttacctctacaatatatataaaataattgagcattttggattaacccatttttcacgtagaatcggtggtaagaaaagaaaaaagatatttttcttaagttattctctccttttcaataccaagcaccaagactgcgtcgtggtaccaatccattgctgaggaactaagcggaagcaacgactgagaccaaccttgctgcgaagaaaagggcgccgccgaggaagatgtcgccagcgtcgctgtgaaggaagatgtcgccggcgccgttgctgatgaagaggccgccgcagctgccgctgctgccgaggaagaggccgccgtaacttctgccaaggaagagctcgtcgctgaagatggcgctgttgcggaggaatgatgtcatgacgaggaggaggagcgcgcaaacatttttgctgtgagtgagcgagagtgagttgatcgcgattggaaatagaaattcactccccagaagtgaggtacgatatatctatatttgggaacctaatctattgaaagataggatagggattctcttggagacgatttttgacaaaaaattcctaaatttgatgataaggaataaaataagtaagatgttggtgatgctcttaattccccctccaatccaccaaaattcccatgtctacaaaccaaacaaagcagctaacaatctcatccctttacacttccaatcccttctaaggctgcgttcgttagcctacgttcctagcctgcacagtgctcatggaaaacagagcagtccattagcgtgtgattaattaagtatttgctaatattctttttcaaaaatggatcaacatgattttttaaagcaactttcgtatataaactttttgcaaaaaaacacaccatttaacagtttaaaaagcgtgcacgcggaaaacgaatatgggttgggaactaggagcattgaacacagccctgttcctggtttctatccggaaccgttcgcacggaaaacagagcggtccattagtgcgtgatgaattaagtaatagttaattttttaaaaaaaatggattaatttttttcaagcaaattttcgaatgaaaacttttgcgtgatgaattaagtaatagttatttttttttaaaaaaaaatagattatttttttcaagcaaatttttgaatgaaaacttttttataaaaaaaacaccgtttagccgtttgaaaagcgtgcacagccaaactccccagaccaaacgggtcctctacagctactgtgccaaagaggagaaagaaaaaaaataaaaacacagtatttattcgatccttctcctggaaggctcccaagtttgtgggaaaaaaattctgtgcagaccggctgcaaaccccgcaccgtgcatacccgatccagattggtgacgcgtggacgagagactgatccaacggcgtgtctgcatggctccatccgcaccaggagaaggcccagcttggctcgctcgcgtcggctcccgctcaagcgatcagccggcttcgcttcgaggcggcaccgcggcagggatgccgtacgcggactcggctctagcaaaagcgaaatctttttccggcttcgtcgtcttccttcgccagattggatcgccgccatgcgcaccgcagccgccaggattccggtactttcttcacccgccttagtgaacgacacatggccagacagccgtttgtctcacctgtgcatgcggacgacgtagtcgccggggattgtagagccgatgagaagcagaaaacatatgtatgctcgccttgttatttgatagtcatatttcttcatactggttgatctgtgaccatatatatgttatannnnnnnnnnnnnnnnnnnnnnnnnnnnnnnnnnnnnnnnnnnnnnnnnnnnnn

SEQ ID NO: 11434 - DNA, 6918 bp, Oryza sativa
cttcgccagattggatcgccgccatgcgcaccgcagccgccaggattccggtactttcttcacccgccttagtgaacgacacatggccagacagccgtttgtctcacctgtgcatgcggacgacgtagtcgccggggattgtagagccgatgagaagcagaaaacatatgtatgctcgccttgttatttgatagtcatatttcttcatactggttgatctgtgaccatatatatgttatagattacacagaacttcgaggggatgaccatgatcatgcatgatgaagttgcacaacaggtcaatgataaagctgaacaagctttgatcgttctgttagatagatctctctccccttgagcccaacggctcaagggggccttgaccgcgccctgatcgggggcgcccagcccaatggctggtgggcccccgtcacactgcgccatataaaaggggggtggaggccggcacggcacattggacgagattcaccgccgccgccaacttcaccccacaaaaccctaatccgatcgagagggggcgcagccagtgacgggaaacgccaccgccgcatccacgttaagccccgacgacaacgacgatgtccggcgcctctttctccacgatctcctcaaccggtcggtatctaaacccccttcctttcatctacaatgtcgttcatcaaacccaaatagaaccacccgactagatctaacctaggtgatcctagtgcaaaggttaacaatggtatcagagcaaccctagtgtttagatcgtttcggggaaagaaattcaaagaaagaaaagcacaagatccgcacggatcaaaagaaccaaaaaccctaaccctaatttttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctctcgaatggcttcatacttttacttcgagatgtcttttatgttccttctttgcaaaggaacttaataagtgtatcaaagttggattttgatggatatgattgccgctttggaaatggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtagcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtgttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaaggggggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacacgttcctcaagttggaatggatttcgattttattccatttactatgttacttaactatactattttactatgttacagtactatgttttacttccatttgcagtgtgttacacttatgatcagctatatgttgtttgagaacgactggtctctggacatcatatttcagatttgacattcaagatttcagattacacaattttccggttttcatttttaaaggaaccagacagacaaaccacaatcttgtttacacattgatccatcacattctagattttggaatacccagtcgtaagcctt

SEQ ID NO: 11435 - DNA, 1094 bp, Oryza sativa
  unsure (1)..(1094): unsure at all n locations
gacattcaagatttcagattacacaattttccggttttcatttttaaaggaaccagacagacaaaccacaatcttgtttacacattgatccatcacattctagattttggaatacccagtcgtaagcctttgnnnnnnnnnnnnnnnnnnnnccagctaaatgagcagcagatgctttgcataataatttttgtcagaatgcagtaaaccatctgaatatccctaatttagcactgctgctatggaagcctgtgactcagtttgtgatattctcaccaacagcctactcagtgtgagagataaatcgcatcacttttagcaaaggctaatgaactaatctggttaaactatagaaaaaccaaccagcaccctagctagcattttgacgaaagacagaaagacacgggcaaatgatcagacgtagcaactacaaaattacaaaatacatgtcacttccaggatttttcttcattgcttgaatggtgctccacttgcattgactttcggcggcgcgttgcagatcctggttcttccactgccttttggcttttgctcgccctcgccaacccagccgctgcggcctccaccaaaggcgtccgatgcccgtggtcaggagggacgaggaggggaacacggctcgtgctcgccttagccaacccagccatcgccgccgccgtcaccgatggcgctcgtggccagggcccaggtgggaggccgtgacggcggtagcaggcgagagaagtggccgcatcagttgttgaacggaggggattgtgggctaagccgatggcgccaaggaaaggcaatcccgacagatggaggcaagatggggaaggagatcgcggcggcggtggaaagggaagtggggatcgccgcagcagaaagaaaatgacgcgagtgagccgcggagccagtccatgcgcttctagttctggttgtgggagtcgacgcgagcaagccgagctgggccttctcctggtgcagatggagccgtgtgggcacgctgtcggatcactcgctcgtccacgcgtcgccaatctgaatcgggtgtgcacggtgcggggtttgcagccggtctgcacagaatttttttc

SEQ ID NO: 11436 - DNA, 7182 bp, Oryza sativa
cgggctccggcggccagctcggcggcgcaccgctgtacgcggtgggggacgaggtcgaggtgcgcatggacgaccccggcttccacggcgccttctacgaggccaccgtctccgcgcgcctcccgtgctccggccgctacgaggtcatgtactccacgctcgtcgaggggggaggaggccgcggccgccgcggcggtggcccgctccgggagacagtcgccgcgtgcgacgtgcggccgaggccgccgccgccgccgccgccgccgctggcggaggacggggcggcgccgggcgcgcgagctcaacgtgttcgacatggtggaggcgtaccacagggaagggtggtggccgggcgtggtgtccgcggcatggccggctcgcgggcggaagccggcggcggcgatgtacaccgtgtcgttcccgtcgtgccgggaagaggcgaagctcccggcctcgctcgtccggcggcggcgggcgttcgtgcgcgggcgctggatggacgcgcgcgacgtggtgagtcaattctgctgaacggattgttgtactccgtattttcccccttttgtgctggtggtggacaggagaaaccctcttcggtgcgttattcgtggctggattattgaggcgtaaacctgacatttgacatgggatttaatgctcaattggacaagatggaatgttcataattttaatcggtggtgatgtcgcatgtacatgttagaggaactttaggtagtgtttggtaatttgttatttctaacaaaaaaaccactgaagatatagaagaacttcgttttttttttttacctgtaggtgagtggtgacttgaactgatgacctcaacgacaacaatcaatgaattcatgtgctgttctaacactaggcgagactaggtgctttgtattgtagatatgagtgtcccctctagtttgctactagttcagaatctgagatatcaagataagaccaagtgatgacaaatgccatacttgtttgacctaattatcgtgtgctgagtttctatttacatgtgggggattttattgaattcaacaaagcagtaagtcattcttcgtccactggttagtatatgtatgctaagctattggttgcatccttgactacacattatgatggattggagaatgcaaattagtgttaatgagttccagtgagaaggcaaatacaaaagaattgtgcttccaaaacagtagcagttgaaaaattggttgtacaaacaaaaagaattgccatctagaatttaaaacaatgtcaaacaagcaagaactcctgctaaattttatgctaactgaatgaattttatcgtattctgaattgtcaaaagaataaaatggaagactaaatgtgtactccctccggttccatattaattgacgttttagacaaggttgatgtcaaacttttataactttgaccatcaataactttaaaaatatttagtttaaaggaactagaataacatatatagatttgtctttcaaagcactataataaaagtaaacatgcatttatttattatatatattataatagaaaaataaggtcaaaaatatattttgtagaccgtgtcgttgtccaaaacgtcaattaaaatgaaactggagggagtaggcaaaaggaactccgttttttcctgcatgaacacgaggcaaaacaaactccatgaaacctgatatccttggtgtaagcttcactgagagagaatgagacacggcaacacaatatttactttgtataactaatgtttgtgcttttgttattttgagtgcaggttccaagggtgccgcagtatgacgaagggagcaatgtggaagtcatgttggatacaggaaagcaccgtgcagcctgggtaactgctactgtcattaagatggttagcagtaaaaactatgttgttaggcttaaaaataaggaaggctcagttaacatcgtagattactgctatattcgaccacaacctacctttgacagaaagaagtttgagtatgaactggagccctctgcagaggttgaagtgaatctgggtggtgcctggtcgctaggcgtcatctcagatgttggaagctgtggatatggggtaaggctaaaaggacatgatagctcagaggaagaggactacatgcttgtgttgcgtgctttactcagacccctactgcaaacaggatgatcaggaattgatgccttgtacagcaaaggtatttctccaactagtcatgttgttacttgtgatttgggtattttctcctcttctttcttggtactaccagtctactgcagtgttcatttttctgctgtgaataaaagtttacaatgttttcttgccgtgcttgtatgccttcttggaatatgtggtgtttgtcattttaatgtcagtatgccagcttagttgtccctgtgctctggacaagcaggtaacaaagttgaacaagctagagaacaagaacataaaagggaaggcgcgcatgctagtttcaaggaaactgcctaacctaggctgcacacggagtggtggtaaacaaagacacagcatgaaaaaggttgtcctgactccgttcttcttaaattgcaaacttaaattgtgtcttaaattgcaaatttccgcgcattcatacagaaaagcccgcttggcgctttcacaggtcatagtgcttttatcaatatatattttgaccatcaaatattgtgcttcagcatcttatgctaatgacatcatgtttttggtatacgctttcttcctccaagcaatgacattatcttatgctaatgacatcatcttatgctaatgatttagttctctccctaaactgtgttgtcatttggataattgttgttcaggaatttgcttgtacaagtttggatcttccatgtatctctgcacctaaagatgctgttgaaatcaagggcaaatctagttatgtcgatgtagtcgaaatcagtgacaactctggctatgatgttattcatatcagcgatgattcgagctgtaaccctagaagaaagagaaggcgacagaatctcctagaggaataactccattcccggcatacttcctatccgattcaagaatcacaatccaggctgaatatgtcaccagcacgaagtcctttgaactgtgacccgttgctagatgtaatgaggcatcctaaagtagagtcgtgcaaccatgtgttatcacaatcttgtcgccattggaaacaccacaggctcatttcaacaacaatgctgggcagctaattcctctgccaagttatccggtattagagaagttgccagttaaagtgcttcctgaaatgaatgaaatgaaagaaacaaatcatgctcatttacaagctgagttcttggcacctgatgattgtacagccggagaccaaaactatgctctgcctataaaagttgaggtacatacgtctgttatctttatttgagatgaaaattaatcccttcttgattgtctatctgttgctaactcacctcaacttaggtggagagctgggtcgctgatatccgcaagaaagaagcaggtaccggtctgactacctcaaacaactgtgagtacttgttataacgactttgtgttacattcaattgtaaaacctgtcttaactagaacgaaaatatcaccagcaatgcagacaattactgatagtggtgaagacaattcaagaaggccacgatcaggagattctgagataccaaattccagtaaattagaaccatattcatctgagcaacaaaggtttgaggccgatctgccatgcatgccagtgcctaacaatgttactattaatactcttcctcttgttaccagacatacgtttcaatttgtttctcggaacaaactggaagtgccagtgagacataagaaggcccctgatgctgtaagaccatctacgttttcccccctgttttatcttctgtttaaatgtatgtgtatttcccatccatgcttgatcatcttgatgctatttgtacagctggagatgaataccaattcggttgtcttctctcccaaggagcaaacacactgtaatttggagatctttagtccaaactgtaagtcttgccacaactttaagatagtaatttttgatgcattgatacttaatactggtctggctgatctgaatattatttttctgcagccaagaagatcattgatgcgtcacactatgaaagttatgcgtcattacagcagcatcctttgggccaatgtcaagttccaaattattggagtgctgcagggcaatcttcatttgtgcatccgagcataacaatgaacctattcacaatattgccagcacctaacagtcatccaactacttttgcctcaagcttgttgatggggccttgtgagaaaatagaggtttttgagaatctgccacaattaccacatttcggaaagttgattggttgccctcctgagctccgcgaaggaaaggctctggggctaatggcatccttcgcaaatatagcagagagcatacaaaacatgtgaattcaggacgaagaaaacgtctttgaggagaaactgaggtgcctctcggaattggaagaggacggatttgatgttagggccctgaaggagcggcttgaaaacctcgtgagcataaagaatcaccagacagaactcaagaagaaaagagcaagattggatcagttcatgcttgagagagaggtggacaatgcctctgtagagcaaagccagaagctgctcgacataatgatcaaggagcttgagctgaaacttttagagtaccgagagaagaaggcatcactcgtggagaagaaagcagcgaactgttcggaaattgcaaagctccaaggcgacatggatcaaattgaggagtcattcctttctgccgagtatgatttccacaccaccgctgctgcgccgtggtaaacattgatgacagtaagtactgctttcttgcttgctcatttgtgcactgcaaccaagtccatttggatggtgttaactgatgtgaaacaatgcaggcagagagctctgttcacagttcacctagacatatcacatacgcatatggttcactgatgtgatgtgatccaatgcattaggggaatgaggcagctagttctcttttgcctagacttgaaatgctgaacttaattaagtttgtatgtataatggttgtcacttgaatttggtagatcatctcattcaatcaggcttgcccccctgacattgatatgcgctgtttggcctttaaccccccccttagtgttggccaatcaagcagctgtaattttctttgtattctcttggttgtaacccctgtactccgttttttttttctactctaatgttaaattctagcagatctcctgccgatgttctccttaaaaaaaaaaaacaggcttgccccatcttcaatgctagctctgttcactgatgtatgtgaaccaatgcattattaggggagtgaggcagctagctctatttgcctagacttgaaatgtcgaacttaattaagtttgtatgtataaatggttgccacttgaatttggtagatcgtttcactcttgccccatcttcaatgtgagcaaggtctccaacgtctagaatcacctgacctggttaatagttttctgctggaaaaatatgatgctcctcacagtcctctggttgttggggaaaagtgaaaacctctttcggggatattcccaatctcaacaatgagaactgaaaagcgatcttattaacttaatctcagacgttcttagtttcagcagtatgataacctggagtgaacactgaactgaccttggttcttacatcagggctgcacgcgcactgaatctagaaaagcctctggagtagtactaattaattaactaacgatatatagccaatgactactggtgcaaaccttatacattataggagtgtgtaattaattaactgtgtgtgtgtgtgatgagttctatagctagcatttctcgtcggcgtcggcgacggcggtgtgctgctgctgctgctcccgcgaggtggcggcggcggtggcggcccacttggcgcagacgaggtaggcggcgaggttgaggacgctgaggacggcgaggagccagtagaagtagtcgaggcggctgcggtcgatggtgtcgccgagccaggtggtggcgcccttgacgagcgacacgagcacgctgctgaagaagaagccgagcgagagcgtcgtcaggaagagccccgtgctcatcgtcttcatccccttgggcgacctcgtgatgaagaagtccagctgccccgtgtagatgaacgcctcgccggcgcccaccagcaggaactgcggcgtcagcaggaacacgctgatcggcgtggagttcccggtggtggcggcgacggcgacggcgaggcgcttcttctcgcagagcgcggcggcggccatgccgaggatggagagggcgaggccgatgccgatcttctccaggttggtgaagccttgcttgccggtgagtacgcggcagagcgggatgaagacgcggtcgtagacggcgagggtgagcatgatggcgccgacgaagaaagacggtgagcgaggcggccgggatctcgaagccggcgccgacgcggcggtccatggtggtggcctgctccacggagaaggtgatcatctgcgcgtagatggtccagaaagaggatcgtcgtcgcccacaccggcatcagcctcgccaccatcttcacctcctccacgcgcgacaccgagcagagcttccacgggttgggcgccgccggcccgcccggcccggccacctcgttgtcctcttcgccggccaccaccgccgccatgtccaggcacgggaactgcgcggtgtgcgcgatccgggcgtgctcggggcggtcgtcctcgtagagctccgccgcggtgggcgggcgcttgacgaccccgcgcttccgcgccgcggcgacgagcacctggaggatgtggacgatggggctcccggagctccgcttgtagcggtacctcctggtcccggagaggaagacggcgatggcggcgagcatggcggcggagcagatgccgtaggcccagctccggccgacgtggtcctggacgtagacgagcacggtgacggcgagcagcgtgccgaggctgatgaagaagaagaagcggttgaagaagatgcccatggcggcgcgct

SEQ ID NO: 11437 - DNA, 13429 bp, Oryza sativa
ttcttctccacctcctgcacgcatgcacacaaatatccatgtcttttactaaccatgcataacatattgcatgcgacaacatgacagagtacgcagttgctaatgaaattaattaactaggaaactaatttgtataacctacatgtatatatatatgaaatgattgaacaagaaattaatatttgtatctcacacgaaccattaattctacgatatatttctgtccactcctggtctcctgtaagctgggaggtcggtcgagtgaaagccttggttgctcgacgacctcgtggacttgcgatctcacccttttataggcgccaagacgggggcatgcacaaacaccatcaaattaacttaaccactcatcattaattagcgtcgaaagggacttgcactacgttctaatccctgtttatgcaggatgtttctgctgcacacatgcaaatggtggtgggggcaggaaatgggtacaataatgcaaacctatgcatataacaatcctaattatatatattcagactatatgatcgatctgtcagtcataagggcacacacaagaaagtgatcagatcagatcagcaggtaggagcacttaattaagctaagctaacccggcctccatgcgttgtcgttggacggtcacaaaggggtcagaggagagaagagaaactgcgacgtggaaactaagaaaagtgagcagcatcaactgggggagataaagtgtagtactagtatgagatgagatgagattggtgaggaattgaagttggggtttcccctctctagtggggaatgttccaggagcttcagctactacggcagctgcattctgtttgtgtacatatgcatgggccctctcatctcatgcccactagtgatctcacaataatgcaaaactagatatataaatactgatagacagaggcaggggatcactggttgatcttgttgttctgtccaacttttccaatttttcacatgcacttgctaggtgcagatcattagcagatacaattagtatacgtttgttgtattattgagcaatgctgtcgatcagttgtggctctaaaaagagagaaatcagaagaaggctattataacttaataagaaaaaaaagtccattttgctctttctaactttttcccttggagcacttaaccccttagacaatttctcgactcatttaattttgacacccccacactattaaaaatggttcacaccttactctctaacaatatttgtctttttcgtttctctctctatataggtcatattttgcaatgaaatttgataggattgatatatgcattataacttacctctcaatattttttgagtttttaaatcgctgcttatataggttagaagcactgagactaatttaagaacagaggttttaaatttcaagcaaaaagtcatgaaaaatttttaaactattttggaacttcgataatggtgtcatatatgactttacaaaatttaagcttaaaatatgacttgtataaagagaaataaagaagataaatgtaattaaccagtcaattgaactatttttaacatttcaagagctaaaataagcttaaaaatagtttagggggttaagtgataaaatgaaatagttagggggagtaaattatttttttttctgttaaattcacatcgctaactgaattttgaataaggactagctaggtagtgtcctcccacttcctagatatgagagtttcaccatgatatacatattttaaagttttttgaacttttgagttttttgttttattagatgttctggttatctacatttgacacccttcttcctaccaaactcgttttgcacaattgcccttcgagaaggtggcagggttctaacttctaaggtgattcttcctgttatcattttttttcataccattatctcattaactatattttattatttagttattctagttttatcatttgtgttgtttgatcattattctttagaaattcaacatgtttcttgtaagaattctgttatttatgtccattcgcacgccctaatcatttgtaaacacctctattaactaaatggtaacataagtcactgtataatgcattttttagataatggaaacgatttacacactgtatagagcgtgcatggaaaattaaacaacttaatttggccacatattggtaaacaaagtatatattcatatgtacatggaatagatgatatatatgcatataccgggatattatattccattatctaaaaaaatatatgcatatagattttgtgaaaaaaaaggcataccaagttatcataattctaaagtgtttgagatgtccattctaatgtcgggaataacaagtaaagaagaatggagctgaggtagtagtacatacatctctcgaatatttagaagaacatttgagggaatacatccctttctgtcccattacgcactcgatctacagctcaacttttttttccttgatgcggtttaaaagatctctttaattttgccccaacaaaaacagtgataagcctttgctaggtagcatggtgcatatgatcaagataagcaccttcttagccaatggccacatctaggaaaacgaccttgctttgcaaagagaaccattaattggtatcttcatgcacaccatgaacagtacctatacactactgcacatggaagcatatattgtgtccatatatttcagttagttggatcgatctgatcaatcagctaatgttgagatcctagatagatgcatgatggatcatatcgtcttcctcctctggctgccatccctccatcttttggagagagagagagagagagatcccacaccataagcatggagaaaaaaggcagcctccctttgaatctcctcctctaattccatgacctcccacaccttttgcacaggggcctcttcttttccccttcttacaccaggtcctccattttgttgattttttatgtacacatctcgatgaaattatatatatatgggtctctgttccaacctttatatacgtatcgcgcgaaaaagatcgacaagtatatatttttttgtcaaaattcagtaatattgtagctggctagggtatctaccctgatgatcgatcaaaacgatggtgacaagttgtcaaatggaagccttccaatctgaatcctaaatcctagccatgcatgtacatatcacagtagccaaaaaccacacattttcatagtatgcactctatatatttctttctctatcaccccaaattcccagaagccaccaggtgttgataatttaagtatggaatattttgtatgaccaattaacgacaattgtttctttgctaatactagcagaacatatatatatgcttgtaattctagtattaagctagctagatctagctagatagtacaaaaaaatgttgaattagttaatccatcggacatatatatgcatgttaactccatatatattttaaacttaactaggaagataacccacgcattcacgtaggcatgcttattagtttgtttgaaaatagttctaacaaaataagttgaaattaaagtaaggtgatttctatttttaattgagtgttcatcgtatctttttttctgaagaaatctcgataaacttttattggtaataaatgtatttttttaccaccctgcaagccctctctttaaaaattcatatacatgcaattcgttatgcatgtgaatcaataaagatggaaaagttcttttaaaaatatttattatattttaaatttagtgatcgagttattctaatttcaaatctgtattcaaatcaaactattgttttattctaaattgtcattttagtgatttaaattatacttaatattgtatcgtttagtatttggactcatctttttaatagttattttattatttcaaatttaatatatttataactcatacttttatatgaactcttgatattttatattctacatgaaatcttcttattttttttatagttttaatattttttttactttttgaatgtgtatttaatcaaattgcttgttttatttttaattctgaatttagttataaactccttgtagttgatttgcctatcaccatcggcctcacggattatttcgtggatctcctcatcaatgagcctctcctgatgcattggacatgatatggcgtggctcggcggtagagctggagccgttttctagtccttgtcgaagacgtggaacgtctctctccgcccctcttctcaatccttgtccttcatctaatcatctagcgcactattaggcgcaggaactcgtggaagtcgaagctgccgctactgccgtcggtgtccacctcaccaataatgtcttgcagttccgcctccgtcgggttcaggcctagaatatgcatcatggttctaagctccttggtggtgattgaacctgaactttagactcacatatttgaattctttcatcgttttcaaagtgcaaattttgttcaaatatttgtaattagaacggctgcattatctaatttttatatagtaaatatgagaaatatggatcttgaattatgtactcccttcatccaaaagtccaagaccaaggagcaactaactcattcatcatgtgacaaaaccaataaacatacaaccaataaatactaaaatgacttattggttccgattaataatttaatttagcacatagtgactacaaataggactagatttttagagaaaaccaaataatagaatgggtcttagacttttggatggagggagtatttaattataaataacacaacaaatcaaataaattaagaaaagtatgtgtaacttgagaatcacgatcattttgctatctaactattatctttttatatattatgtgttagctagaaaataggggaggagagtggggggggatacctgatttttttggagatttaagggtgaaaattattggctctacctatttaaaggaatatcaatcgttaggttttctttaccataaattttagaaattttcttctcgtttattaagcactgtatgacgtcttaggagcgttaatttgtagaacgccatgtgacagcttgagagcttttatagagaattcaatggacttttagttagtatataatagatattcaaaatggaatggttgtgctagtacgtagctaactggagcaaagcatgcagtcatgcatatagagtggaagctggcgcaacttggtggccgtgatgaaattgtcggtagctagccctatttcatttcgggacccaagaataacatacagttgcacttacctgtatttgcttaccttccaattgccaaaataaaagggggttatgataggttattggacttggacctaacttataaaggagctcaagaatgaaaatacatgtagaagcttggagaatggaagacttgagaggaataatgtaatgttgatatattgtttgcacaatattgaacttatcatgcatacattgcatagtgttcaggcttaacagaaatgcactatggttgggcggattgactatagggtatcactgcgtcgagatcctatatgcagctcactgtagaacacatatcagtaaagtttactacgactgtacatgcagtactgcagagaatctgtatccgggtatcactattatatgctttattttcctcgagagggtgagatgtgctaattgaagtggctttataaaaggggtggatgtctgttgagtaagaggcggcgactagaggaggggagtggaaggaaaggcaagggtaaagaatgcaaagtatttacgtattattttggagaagggatctaaacgatagatatgagatatacatccggtcacctttgttcaaaattaattggggccatagccaaattgataaatataatatagggtgtgtatgcatggtaagatattatctatatccatgcaccccattttgatccttcagttttaaatcccaagcatgatttcaatatttatttaatatttatatatatgcaaaagatactactaatgaactgaagcactggattgcaatttaattattatctctaagaacatgttatggccattgagaatatccaaagtacaatatttatgagtaaataaaaatcataataatacaaatatacttttgttataaagctgtacatgtgattaattatcatgaatccaatctaaaatgacttggggacgtatgtctatttttttttaattagcagtaccatttttatctctactatttaaaaaatgtagtcgtcttccttcctgttgacagaaaacacgaggcctgggagatctgcttaactccagtgcaggtccaaagctcgcctacgggtgtgctagcgtgccagttgatttgatcatgtaaccaacaagaagtagaagcaaagaaatcgcggttaaatctataaatgatagccgatcggctaagtgccgatgacatatcatttatctctgagccgatgtaatatgtgtatcgatcggcaatcttgaataagtaagaaagaactaaatctacttgatcggctgtagatgttaacgatatatactccttatatcgatatatacttaaatcaagtgattgggatagatcggtcgccatgccgagacagtataaaccacttagaccgaaatatatattaataacaggactatatatgtttatagcataaccgatcagatagatctagcatgaatcggctaatactccgatactactttatatcaggatattaaaacaggtatagaatatcaagcaaaagcctaatatattcaaatatagcaatatcttggcataaagggcaaatttaacatgtcaataaagcatatagagcaaatatagttaaatcagataagatcggctgaaactccgatgctaccctaatcggcaaccagaaagcaggctagagattgatattctaagcacgacttaatagatcaaactcaactgatacaacattaagtatgaaaagaagaacaatatctagacaatcaagccgctggaagtttcatagagtggtagatatcttatataatctgagtcaacgtcaaaatctaacctaatcggctgccctcttcgacagatgttagccgattgtagattagatagcggtattgccagagattatataaaatatatgataacccgacgaattacataaacaagattagagtgtcataaagatggaagcactaatcctgagaatgcaagccgtcataacaagttttacctcttgttgaagatcgaaaccgatgcagctcaacccgaaagcaagaactcgtcgaaataaaactaaagcaaaaaggtgacgatgcgcattgtattgaacgtgtgttaaaagttacatagggctcgggtctatttatacccgagaattacaagatatgtctataacggacacgactactatctctaacaaactctaagatactataagtctttgcggcagacttttgcccaatcatatctctaaggaaattacataaaacatcctaattaatagatacaattgcctcctcaggactctatccatttgcggcaatcaccttgaagcacctcaatccaacccaacatcacatatcaagttgtattgctaggatcggctacatcggcttacctaatccgactcagactcagccgatcttatcgtagccgatctggactccagccgatccctgctctgtttcagaactcgatctccacctccgacttcgcttcaatctaatcttctttcccaatgccgatattaccaaatttggttgttaacacttccgtccctttctcattgcgtgcttttttatgtgtgcatagccataatagcattttcaattcaatccacgcatccaacccatcctgaattatataggcctagaacgtgttttatcctcaatccactcatcaaaccaatcacaaaatcatatgggtttgacctgttataaagcacaaacatattactagtatatgagataatctgacatttcactctagatgccactccaagatatgtgttggaccatgctagaaataaaaaaaaaagagtttaaagcgaaatggtagatttgcatgtcttctgaatgacattaaagcattatatttttgagtggtaggtaaaccggccttacctcttataagagtggtgtatgtcaaattttctcctaataaatattatcttgatttcttttcatctattggttctctgacctctccggaggcataacacgtgtgaccacactagccttgccacatgttgagtcctcatgcaccaacagcaataagcctcttgaaaagctaaaaagctccaacatccaacaagcactcggaactcatctgcatttcctcgtgaaggacacgcgatttagctaaaccacacggaatgaaaaattatgtcaccatatagcaagccatacagacatacaaacacatcctaccaaaaattaattgaccaaatataatacactgattgtttgtgaaagttacaaaccttgtaaggcatacaaacgtttaccttctaatgtgacatataataatgtgtttgcattctatgatcaagctcaagtttaaacgtcttttttttggaataatatgtgtgtgctctagttgatataaattaattaatatgaaaaaaaaatatgctagcaatgttaacttgtaggaccaccactgtgtgtaatgaagttgagctatatttaaagttcttacaggtactccctcccatttgataattcctaccactttggataaggaaacatctaaaacatatctttgactataatttttcttttaatatatataataaataaatatttagctttgttaaagtactaagggtgagttcttttgtagtagttgggaactcctaccttctgtacgaataatgaagcatcggattaacgtatgattaattgagtattagctatttaaaaaatgaattaatatgattttttaaagtaactttcctataaaacttttttttaaaaaatgcaacgtttagcagtttaggaaaagcgtgcacggaaaacgaggaaagtggagttaggaactcacactaaagaacacaacctaaataaatatttattgctttcgaatgtttagttcccttagcaaaatttttcaccctgtcacatcgaatgtttaggcacatgcatggagtattaaatataaacgaaaaaataactaattacacatattgcatgtaaattgcgagacgaatcttttaagcctaattgctccatgatctgacaatgtggtgctacaataaacatttgctaatgacggattaattaggcttaataaatttgtctcgcagtttacacgtggattctgtaatttgttttgttattagtttacgtttaatacttcaaatgtgtgtccgtactccgatgtaacacgccaaaacttgtattccgatgtgacacgccaaaactttacacccctggatctaaacacagcctaaatatcctaaagtttctgatagcgaaagttctgatagtttgatcacaaccttatccaaaacaacgagaattatgcaacttgaggaagtatgataaattataattgaaacactacctcacagtattttctaagctaaaagggaacttgtaaattgctagctaggaaccaaccggctagtgcagctttcatgttgttgaattttccattcttttgcatcgacttcttcctatattttccaaaaagagaaaattaacaactcctttccttgtagcatctccaaaatctcaagtgttggctagggtctttgaaccatggaggcatggacaagtggccggacatatgactgacaaactgcaccatgaccatgacaactcgccacacattcaccttcaacttgtgcgaaaacatgttccccttttcaactagtaagctaataagacaatttgatctttaaattcctgaaaacctcagtaatgacacttattttgggtggcagatacataaaattataagacaaatccaacatatatataaatacaaatcatgcactgagattaccaaataaatactgtaggttttataaacctttcttttgagaaacacaagacaaacgtaaatgttcacatacacgtatgcacactcacctctattaacacgcacgcacaaagacactcacatacacgtgtgcatactcatccttatgaatacacatacgcacatccaattataatgagaacatctgaaaaattgagctgacatatcttgagactgatgaagttataatcgatggcttgctgtcaatggatacatcatctacgactaaaataaataaatagccataaatacgaacacccgtactaagtctagaactttaacctgcgtggacaggtttcaccgtaggtttgtaaccttgatggctctgtaaaacctagacagattgatgagtttggaaatgccaattatttataatgcatacacatcatttttacctttcctatatcaatatattaggcaatccctttgctttcttcatgaaaaaaaatcacaacatttcgttatgtgcatccccatgcttgccctcccaagtaccaacctaccttggttaacttgtgaccacactactagaatttcactccccagcactagtgacttttgatgccaataattgggagatcaataacctggctatattgtcaaaaagttgtttcaccctccaaattaacaatggtatattctctttgacagcaacttttcagctacatttgatggactaacacacatctaatttgccagccataaggagtagtcatataggctcatggctagttgcttcatgagcttgttaacttgttatgggagactaatcacaatagctggagtgggaataaaaaggtgcatgtggatagatggcaccaccctgtcatgatcagtgtaagagcaaatcaccaagtggtggtacaggggcttggatcagaacaaaaaaaaaagggtgacttctgaaagacacatgtccatgtgtatatacatgtatgctgtttgtatttgacatttggtgtgtgtagtgtagttgacatatgtttgactcttctgattattccacagggcccagctaactcctcctctagcttaaattctcctatccttagcatcatctggtatgtgtgtgccgaccagttagtggggcaagggttatcagttatcttcagacactaaacttaataattatgttatgtgtgtgacccagctgagcattatatatgttggtagctagagagaagaaaaaggggataactaatgaagcatggtgctcctcccagcagcttttttcagctgaaaatgttttcttctcagatgcataccatgtgagaaagttgaggctcaagggagagagatcatgagtttcattggatgtacctgaggctgccaaatgatcgatgtaggtgtccatgcttccatggaccatacaaaatattccccttgcctgtttgtgtttgttgttgtgttgagggggggatttcggaatcaattgggtgaacaaactggatcacaaagaagttatgataaccagtaaaaaagacaataattttcttagggagtgtctatatttcaaatggttgagaagatttcaaaagtttctatcacttttctcatttcttgaatgacaatccaatggttttcatcaattttcttattacttttttaagtgacgctatttctattgaatagtcccacattggttgtgtaaggtcaatggacctaatatataagtgggggagtctcttaccttattgactagcttttagggtgggaaagactatttacgaactttctttcttagataaaattattctaacctgaacataaatttatactccctccgtttcacaatgtaagattttctagcattgcccacatatacatagatgttaatgaatctaaacatatacatctaaatgaatgtgagtaatgctagaaagtcttatattgtggaacggaggaagtagtttataaaagattacaaaattacatgtaaaagtattcaaacttagataaataaaataaaattatatacaatgataaaatcgcacatcatatggcacaattctaggcttaacaatgtacaattttagatgattgaaaagttaattccatttttgataagcagatagatcgcatatatacgagggaagttgaccgatcataagtcctcccaccgtttggttaatatatattaagagaaaaaaaagctaaaaacgctaggagaaaggcaaacacacgctcctcgtgtggtgaaataaacatggcaaagtgtggtagccaaccaagcgcggatagtgaaatcggaagagaatgggggagaagataccctggacaaacaacactggggccatgttaatcgaataaccgtggcatgtcaacgttacaaatatacccatcagcacaatgcaataattgagctgacccagcaccaccatcaaaatcgctactggcatcgacccaaaatttctccatgatcgaacacacgcacacacatctccttccatgaccagttcatcccaattgacaattgtcagcgtagtgttagctgcagctcgatttagcccaacaattgatcatccacttggccgtcatcagtggcaggtcaagtaacccgacacacacaggagaagatcagattgctctaaatcgcttttaatcttttggttagttgcgtagtcgagtcccatcctggcaccggaccacctggcctgctgccggcgattatcactggctgcagatcgatccgtctcgctgattagattttagctttaatcaatctcaacgccgtgcatttcaccacccattatgccctgtctcgtttgctttttttttcttcttttctttacttctcttcttcctttttgtgctttagagagattaagcccatctcgatcgctacatcctccaaatatctcgctgatcaaaacatatcctccagctacgtggtcaacacgcgtgtccggatcactcactcacgctttgcatacatagttgctcaattattaggcttagtcgacaagacatccctgaaatgttatgtaattcatactctcttcgtcctaaaaaaactgattaaaagttttttttttgacgaaggatgtagtctgtaatgatagtgacagataaaggagtagctagttgaatagtcaggtcagctatagctaaagtttcatacaaaaatggtcagctatagctacgtggtgtttcctctgaacctatcacaagttcagaaaaggagattttttttttggtctgaaaattttgtagctgtctgtatctcccactaactcacattcctgaagaaacagatactgaatatacctcaagagttaggcacgcaagcagtgagaggttgcactctctgagtctcagattcttcaaatgagaatgagagggcgtgtgc

SEQ ID NO: 11438 - DNA, 654 bp, Oryza sativa
aattgtgtttgggacctgtgtgacttgccttgcaacggtcttcaattaatcttcttgaacacttccggcgcactcgcgaacctttgcaacgacagaaacgacaagctaacacgcaaaacaaagaaaaagactaagaaactccaaataaacaaaacatataaagtaaacaaacatgtagatcatgattttagatgaatgagacttgaacggccttattccaatttcatatgatttaattatgaatttacaaaattaattccaattaaagcctattaaagaaaaagactattccaaattaattaaaccatttacaaatgatttataattaagacaaaagattaaaacaacctccgaaaaagattagattatatttgatagatgacatatattaaaaaggaataatatgtcattgaaaagagcgaacagatttatatcgattttggacggctgagattaatctcgatcgagtcgaccaagattggatgacttaaattgatctgaaccggaggaaagagcacgacgaggggagctcaccgatgacttgaatgacggcaaacgacgacagatgacgacggcggcgaggttggagtggcgacggggtactgatcgacggtggcgatgactttccggcgatctttggcggagaagaggtgg

SEQ ID NO: 11439 - DNA, 686 bp, Oryza sativa
agagaaaatggtgcgggccccacatcccttccttttcccctttcttctcttctctcgttttcttcgacgagacgagatgggcgggatgacggccggcgagagcggcggcggcggcggagggcgagcgcggccgcggcaagcgaagcaggcaggagcggggcaacggccgacgagagcggcggcggcggcggagcgcgagcgcggccgcggcaggtgaagcatgcaggagcggggcgacagccggtgagagcagcggcggactgcggacgaccgcggagggaggtgggggcgggatccgggaggtggcggcggaaccgcggcgcgttagggtccccgaacacgaggtcatccttgagcccgcagtccaccgagcgcggcctgtgggcagaatggaggcgggtggcgcggcggcacgcggagcggcgttggacggcggagggcgagcggaaggcaagcgcggcgggctgcgagcagagcggacgacgggcgtcgagcgagcgaatgagcactgcaggcggatgaggaggccgcaacggcggaggtggccaaaggaggagcgtggcggcctactccgccagtcgcgtcggtggcggcggcgagagcggcgcgcaaagcggacagagcgaacgagcacatcgttcttgctgctggttcccgccgccgccgtcgcactcatcggaggagcc

SEQ ID NO: 11440 - DNA, 696 bp, Oryza sativa
  unsure (1)..(696): unsure at all n locations
nnnnnnnnnnnnnnnnnnnnnnnnnnnnnnnnnnnnnnnnnnnnnnnnnnnnnaaatcatgtgaaaataccacacgatttgtgaaaatacttaagtccaatcagaccagccctaggcttgagatttttctgccttcgtccgtggcagtggcaacctcaaggaagcacagagatggctcacgggtgatgtgcagagaccttgacatcagatcctacggggaaactcccctacctcaaccgctattactctacaccattagcgctcaaaagaatagaagcttcggaaagaagtacattgaccattgaacctgcacaacaatcttaggagaagatggttattttccagttattcaatgtgtagatgatactattattataacaaaagtatattaaaaataagcttttttttcttcttaagtcccttcttcatactcatgtccagtcaacaggccttaaaattaatttcaataaatcatatagcaggaattctgggttgcacaacaaagtccagagttgttgactgtggtccacttatagatagaactgacaggaggctatcttccatagaaatttatttatcacatggtcaaagttaacagtggtaattctatttttttcatcattaccaacctaccacatgtgtacattgaaggttccaaaaaaatcatgttacataaagacagagcagggaggtgtt

SEQ ID NO: 11441 - DNA, 683 bp, Oryza sativa
gatgaaaacattctgttcatttccttccatgttgatataaatgtacagttcgtaaggaacagaagaagttttttcttttaaaaacataatgcttaaataatgtttctttttcaaacatctgtccatgttcttgcctaggagttaaatgtgcctaatttgtaaggctcagaatagaactagttttcatttaccttgagaagcctgaacaaaacagaggatgctagagagcaagcaatcttctggcttcatgttgtgaaacaccacaatgatgatatcagagtcctgaatggtacccattgttgcacgaaatgcagcttcaggagtcaacttcattgccaattagccaaaccaagaaggaaacacgactcctatgtgatacctaatagcagaaacacgaactgtgcagcagatcatattaggaacaaaaacacaaggaacttcagcctaaatacttggacatattatgccaatcttttatctccttagcagtactttttgtgtactcccctatatgttaaatttatattacccggtacgagtaatgatcgactaaaacatgggtgagcactgaacaatcctgcataagaataactgtattttactcaatattatccctatctaattgaaaggcaattcccctgccaaattttagaaaaaagaagaaatgagacagcagtgtaaac

SEQ ID NO: 11442 - DNA, 900 bp, Oryza sativa
  unsure (1)..(900): unsure at all n locations
nnnnnnnnnnnnnnnnnnnnnnnnnnnnnnnnnnnnnnnnnnnnnnnnnnnnnnnnnnnnnnnnnnnntcccggagggtctcactaataaagtagacaggcctctgcacctttcggcggggccgatcctcttcgctaggggccgtatccccggggtgctcttcgtccaagtggcctctcggggcacactcgtctcctgcgctgatgacctcggggtccgaagatgacaggtgcggccttcccacagtggcctcggggccgtcccgggggtcgggggctcctggcgttgtcagacaagcgggcaaagggccagctccggtcgtcaggggcctcaggcctccgttcggctcgggggcctcttctccctgctctctcccgggtcgaatcagcacagggttagcctcggggtcaaagggtggtagatgcggccttcctgcagtggcctcgggtccttcttagaggtcgggggcacccggctcttctgacaagcgggcataggtccgactccggtcgtcgggggccttaggccaccgttcgactcgggggcctctcctccttgcctgctcgtgggccaagtcagcacagagtgggggtgcgcagaatgagcattgtcttcatcgcgctccacaaccaactatgcactagctacttggggggtcgccgctaagtaaagtagcaggggctcatttggctccggggcgactagaaccgggggagagttgagatatacctttacctgagtaagggcatgttcagcttcctccgtccaagtgaacggcccggagcgcttgaggagcttaaacaagggtagcgccttctctcccagccttgatatgaannnnnnnnnnnnnnnnnnnnnnnnnnnnnnnnnnnnnnnnnnnnnnnnnnnnnnnnnnnnnnn

SEQ ID NO: 11443 - DNA, 1563 bp, Oryza sativa
aactaatagtagttgactaaatctcagcaggacccaccacataccatgtcctatacggaaacaacctgcggatataggaggagttccagataaggaaagacaaccagagttctatatggaaacgacaaagactactcggattgtatccatattggtttccctaattctacttgaacaaggggacacctatgggtataaatacaaggccccctaggaggagaggggagacgacgatacacacccacaatcaacagacacgggtaacatagacgtcacaaagctgtgagccaatacaagccaacatacgccaagacaagacgccggatatcgacttcagggattggcacggctagtcccctacggtgtctccggatactatcaggagagacgaaagcgctatctctgatctcgccgggcacgaactcgaggaggaagactaccctgttgtcgactacgagtcagatcttcagaccgccatgtcgacaacagttagataggctaccccaaacattgtactggtgtgattatggtgaataagagcaataccggctttggccaacaggatgtagggttattacctggcaattcaggggcccgaacctgtataaaaacccctgtctccgtctcttttacctcagtctcgcgtatatcctagtaccaacgatccccatactatgcaaataccggaatcgcgacatcaaacgtcgatagttgtcaatggtggtaaaaatttaataagtagtcccctctgaaactcatcatggtaacatatttgcatttagctcctctgctgtttatctctaacctaactcctctctactccatttattatcctctttggactcagagaagggaaagtggtagcgacataagagcatctctaacagcctctccattatactttccaagccaaaatttagccattcatgccaaaaaaaaacatgctccaacagcctctccaatccactagccaaatttggcaagccaaaagccactagccaaccatgggcccctcgcacattcctcctcccatctcctctccggctcctctctcgctaacgtcctgccatcaacgacgccacaaaggagagaggcgtcgtcgccagccgcgaccaccaccgtcctccacgaccgccgttgtcccccgcgccgtcggccgccgccatcctccgtgaccgccgctgtcctccgcgccgtccttcgtgaccgtcgccctcctgacgtcgcccaccgtgacctctgccacgaccaccgccgtccgaggtagagggcgtggggaggaggcagcagtacatgaggaagaagagagatgtatgggtggggaaaaatgtggtggaagagaaggaagaaggttagcagagactgacatgggtcccatttgtcatagacttataatggagatggtagatggagaggctgttggagcgagtaactagtttgactagctaaatcagatggagagttgggtatatgggtgtttggagagtttgatatggagatgttgttggagatactctaaaagtacgggagggtaggatgatgtgaagtacagtgagagtaagg

SEQ ID NO: 11444 - DNA, 219 bp, Oryza sativa
tttcacatggtgtttatacctatagggcagctgcgggagcagccgttgctgccgatcaaggccacaaggggtggcttatccgtatatcagatgcaaaataggggtgagtttgttttgaaaggaaaaaattgtggtgattgaatagtattgtgatattcatccttggacagaagtgaccaaagtgacagtctgtcaggttgaatagcttaattggattat

SEQ ID NO: 11445 - DNA, 4134 bp, Oryza sativa
gcatgcaagcttcaccggtggttggaactcgttgttaaagctatgatcttggtggtcgcttaaaatcgagggaaacctaggtggttgcttggaggctaaatacttcttcctagttgtttgtcaagtgaggcaaggagttaattgagacctagctctctggagctgctcaatgagagtagatccctgtaatctgaatttcggaaaaaaaaatcattgtctccccatgtttttggtccatcttgtatgtgtgttgatttaaatgagctaaccgtggcctgcttctattcggtaactatcacaccatgaagtttccctttcctagccttaatgcatttaataaatcaccaaacgaaattgtttaagttaacctagaatgaatccctaattaaaaactctatctaataagtggaaatggcttggtgtgatttttcttgagtttcccttgccaaaatatattaactggttcttgccaataaccgaaaatattttttaatagttttgtataaacaaagaaaaccagatacatgccctaagttttataaacacatttagagacctctttaagattggaggaaatttgaaatatttgaaataaattatgctaaaatagttttttaaatttcctgcattcccaagaactgatggagccggcttccgggtaggtcggacgattgcccaggcggccaggctctaccgttgctgtcttcactactgacagcaatagatgccaataaaaattatttaaccgaaaatgcttgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacagtagccccctgagaccttcacagtcagaaagataatcttctctcgaactagattactccaaagccgagtgcttcaatcatcttcgccatgatctcccgagtactttttctaaatcagaagactgtggagggctgaaaaaataaagtcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaggaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgatcacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctaaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactctaaaataaatataataattgaatcccgactggcgcaagtattcggttgatagcccttacggggaataataattggtccagtctttgagcatagaaaatagactcatgactttgaatccatgtgggatgtatccggaacaagtccaaattggagatataatcctcacgcttgagttgatgagcccctgagcatatagcttgtccttctgtcatagtcaaaattgtatattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagccagcaatgaagatgaaagcgcccagcgataaagttgtgtagccatggcagcgaaataatcagtcggtgacagacgatgcagttggtgaagaagatgaagatgcccattagtggcaacataataagccatccatgaaggcgaggataccggtcggtggtgacgaaagcaagccgacggtgaagatgtagacacgcatcaaaggcgatgacgaaatccaccaatcatgaagatgaagaaaatagtcggcggcgacaaacgcaaccgacatgatgaagaagacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcaggggcgatgaagcaaaggtgctggtgatgatgtcagtgacaataatccatcaaattaatgttatagctgttgtagatgcttcacttggaggagagttgatgttgttgtccaactcgttcaaaccgaaatatttgaagtagaatgtctgttccgaagcaaagatgaagataatgactcctggagttgactcattggctgatgaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatataagtagaaatcctgaatattggagagcctcttgttgtagtaaaataacatggcatcgcatgccgagatgtcgaggctcacaaagacgtcgtggttggtgaagtagtaaaacttgcgaagtagcagcaatagagtttgccagtgccgaagataataaagatgaagttgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtaactgtataaaccagacgtagaggtgagagcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagccgtgcaggcggtgacaccagtcagctgcggatgcggcggccggtcggtgaagacgtagacgcccaacaacggcagcataataagtctgccgtgcaggcggaagcaccaatcggtagcggcgaaggcaagccggtcggtgaagacgcgccccagccgtgcagg

SEQ ID NO: 11446 - DNA, 7303 bp, Oryza sativa
gacgccccccagccgagcaggcggaaacaccagtcggcggcggcgaaggcgagccggtcggtgaagacgtaggcgcccaacagcggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcggcaaaggcgagccggtcggtgaagacgtaggcgcccaacagcggcggcataataggccagccgtgcaggcgtggacaccagtcggcggcgacgaaggcgagccggtcggtgaagacgtaggcgcccaacagcggcggcataataggccagccgtgcaggcgtggacaccagtcggcggcgaagtaggcgagccggtcggtgaagacgtaggcgcccaacaacggcggcataataggccagccgtgcaggcgaggacaccagtcggcggcggcaaaggcgagccggtcggtgaagacgtaggcgcccaacagcggcggcataataggccaaccgtgcaggcgagaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcttcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggagacaccagtcgacggcgacgaaggcaagccggcggtgaagtcgtagacgcccaacagcggcggcataataggccagccgtgtaggcggaagcaccactcggcggcgacggaggcaggccggcggtgaagtcgtagacgcccaacagcggcggcataataggccagccgtgtaggcggaaacaccagtcgacggtagcgaaggtgagccaacggtgaggatgtagacgcccaacagcggcggcataataggccagccgtgtaggcggaggcaccactcgacggcgacggaggcaggccggcggtgaagtcgtagacgcccaacagcggcggcataataggccagccgtgtaggcggaaacaccagtcggcggcgacggaggcaggccggcggtgaagtcgtagacgcccaacagcggcggcataataggccagccgtgtaggcggaaacaccagtcgacggcagcgaaggtgagccaacggtgaggatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacggcggcggcataataggccagccgtgcaggcggaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagctcaaggttaggaatctgtacttcacccatatgtaaacatagcaaaaaaaacatttggtttgagagatcagcgcacattgaaattttgaagaagctaagtgtgcaagttaagaggtcattagatgaatatacggaaaaaaattcacatggacaatgaagagcagaaaaacagaggcgcacaacagcatcaaacatgggtagtgcgagtgatagctaggtacaaacatcctgcaattgtaaagatttaatatattagtgcatggtatggcatcctggtaatttagctagggatcatccaggaaaaccagacatcaaagtataccatagatgtgactgcttgcagtacttcttggtaaacaacatttttggttttcgtacaacatgcctcgtcctcatcctctatgagaatcctaagaccttctcttgatgttgatctagaaacagcaacataaagttgcccatgtgtgaacacaggttttttcaagtacacgctgactcgtgaaagggtttgtccttggctcttgttaatcgtcattgcataacaaacacgaacagggaactgtcttctctaaagcgtaaaaggccacttaggacttgtggtggtaagtgcaattcgtggtatgaatgttgtctcgccaatatttgtcccagttaaaattacacactctaacaacctattaccaagagaagtgaccaataaccttgtcccattgcatagacccatagattgatttaggtttcgtagtagcataatcgtcacaccttttttgagcacaagcttgtgcgatgggaagttgttgacattaattgaattcaaaaattcagggggtaaaggatgtcaaagtcaggtaaatgatctcttgattttgaaattgtatcacatattaaatactcctttgcgtcgctgggtatcatgtcaacaatacaatcatttatttcatcaactgttgagttattcgggcaaacaattgcccgacatgcaaggtaagaatgatctgtatagcaatttgcaaagtgtggaaagatctcatctactatagcccttattttgtcaccgcatgtcttgatcaaaaggtcatcagggatatcaatccatgttggctcaaattcgtcaagcttttttgttgcaggcaacctaccgtcaccaagtgctaggacccaatcgccaaagttgctaagatcgacacggttttggtcagtaacgttaccatgaagaagtctcatgtttattgtcagtctaagaagaacaacatgccgccaaagaggagagttcgtgatggatgcatcgactatagaagcacgtgaaccttttcttatgaccggcaatatttgacggaaatcacctccaagaacaacaactttaccaccgaacggaacaatgctgttagaaggcgtgtgctcagaaagcaaatcacgtaacgttcgatctaaggcctcaaagcatcgtctatgagtcatgggagcctcatcccagattataagagacgttttctgaatcaaatctgcaagcatagttcctcttttaatggtgcaaatgttgttttcatctatgtcgatcgggattttaaatctagaatgagcagtgcgccctctaggtaggagtagagaggcaacccctgaggaggcaaccgctagaacaatttttttctcggatcttattttagaaatcagtgtattccacaaaaatgttttgcctgtcccaccatggccatagacaaagaataacccaggcctgttttcgttcacccgttgcatgattgtgttgaaaacatttctttgatcagtatttagcctaggtatattcaaattagcttctgcagttagggccgcaacatcaagagcaagttcttcgtcaaccatcctatttcctgtaatgtcatctgaataaattgccggctgcggtaagtcgtaatcatcaatgctaccaccactgtttgaaaacacaatgtgaagttctttcattaatagagacaggagcctatcaggaggtattacgtacgaaggattcgataaagcagttctgacacgtcgctgaatgtcatcggtaaaatatgtccaatatttttcaaagagcgagcgcacatatccaacagaacaaaacattacaacgggagcaaacaactgtctcaattggcccgaagacgcagatactatagcctcatcaaatagcaagtgccattcgttatcgctttcaagtaggcctcttgcctcgcatgcttgcctaaaggtcggataaacgataccatcataggtcctaacatcagcatagcacgttgcacctttcactatcattaatagcattcgtaggtagtagagctcaccgctaactgggctgacatagtatatcctgcctattttttcacatggtgttctaggacgccaactacgtgagatgctgtcccatgtccactctctcggaaaatcacagtaagtaagcgttcggggactgttatgttttctggtagcctcgaaccactcggttagcatcgtttttttggctacagggctggatagcaaggactttaggtcagaaccttttttgtatcggacaaagttcatgtttggaaggtgcacagctaggcgttctacagaaggcactctgtagtgaatgtcaaattcaaatgcatgccaaagggactcacaggtggacagaaatcttgcatcgatatattcttgtatttcatttcgtggagcagtacagttttcagctggtttgttcggtgcatttccagaaatctcaaagaatgcttttgttctatccgcccctttagtgacatatttgaagagatatttaatcatattagatttattgcaccattctacattaatctgagcctggtattttttcagaagttccatgttgtagggaacaacccatctgttgtcaagtttaataccatttttgagaacataccgaccatcattgctacgtttgtaaacagtgaatacaaattcatccatgatggtctcttcttgaaaagatttagggaaatgcttagagcactctcccttcttcatacaggagcatgttttgttcacatcgccacaagggccatggatcataaattcatcaaccaaggcatagcctaaagggtcggttagcacatcaggtatttcagcggaaataaaaccatcgacaataggagcactaaactcaatatttcctgcagcaagccaaaccaggcaatggatatgaggaaggccacgcttttggaactcaactgtatataacactacatatagggatagccaatgttaggacctatacagaacataaaaatggaacttagaaactaggtaaacatcctactagcaaggactggaccaaatgtctttccttctctaatatctgaaatgaattcattcactttcatgttaaacaccctcacaatcatatcggaacgatcgcttggcacctggcctggctcaaacagcaaagcatcatatatttcttgccactttgagttgcatgtaaaggtcacaaaaagatcaggtgaaccaaaaacccgacaaatagccatcgcatcttggtaattttgaaccatgtaacgacgccctccagtaaaactggagggcagcacatatcattggccgacagaatccccggaatcaagaccatgatcaatcgcatcagctattccctggacagattcagaacgcaggtcgggctggttgtcgaaaatgtacttaagcctagattactcaacagttgagtatgagtcaacacataaggaatcgctaagacgaccacagcaagtatatggatttggtttgttcaatcggtaatgtaaacgatagtggtagtactcaagcatggtaacatagcgtctggaggcaccagtgatgctaggaaagtcagtgtactttatacctagatggaatcctcgttcaccataaggaaagagcaaagggtactgaagagccatataggatgggtgcaaagctgagacacgtcgcaatctagcatcgcaagactaaaccatcacatcatacatgtattcgccagctgagtaatctccagctactataccagcaatatcaccactcgttggcaaattgtactggatttcatctcttgaatcacaaccaagcaatctaagtgcaatcttttgatcaccattatcttttagccgatctctagcaaagcggaatgccttaaccaaatcattatgctcatcaagcatagaactaagcccattaacaatgtctgggtctggttcatcagaaggattgtctttttcgtaaatattcattctgtttgcagtttcattttcagtgtcatatatgtaaagttgtgcaaatttaggtcgtgagccttgctgtggcagcaggctgccaataccttggtggacaaccccattaatcttgaacacaca

SEQ ID NO: 11447 - DNA, 13145 bp, Oryza sativa
  unsure (1)..(13145): unsure at all n locations
cgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgcttgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaatgctattatcacctctactcaacggcggtgctacctctgctactgccaagaagcccttaattaacgttgctgcgaaaacccatgattctaaaaattgtagggtcaacactgtagcgagctgctaagcctacgatgaagcaagtatatgcatggcatgtgcttttgttcagtggacactgatgatcgacctgcgttttgttgagatctggatatactgcaggaatggaatattttgtggaagcatccgtggatctatctgcgctgctggatcgtcagatcagaatttggcgaaatgtgtatttgcaaaaacattcccgaaaccactaatccaatgatgtatgtaacatactgatgaatatatatgtgtccagtcgagactatgcagctcggcaaaagacaccatttgtcagccttggagcacattaattggacggttcgacggttcgaaagggcgcgacacatgcagaaagccctactgatcagtaacagtatggatcattcatccgtggatcaagatctaggaacaatggaacatgcacatcgaaaatgaatgattgaatgattctctgatcacggagaaaacagagaaaaagaaaaatagttggcttataaactaaatttgcaagagagtaggaaaaacagttaactgaagaagtagcatttttctctccttaattgagaaacacgcaggggtcttccggctagcttaattaataagatggtgggctagctagcctggtttcgaagcctcatccattttatttatttgatattacatccttctctaatattcgtgtttttcccccttaattggactggctttctcgatgtaacaaggattagctatttgtcaatcacctgcctagctgtatatataggagacgacccaacacacactgatcgccttgctctgcccaactttggcgatggatgatgcatcgcaaagtatgcaaagaagtataaagtctattttgactaatttttagggtggtgatatcttagctaatataatttagcaagataatttagccgatacagcataaaccctaaaacgaatctcagctgatacaaaagtaaattaagatgctaaactagattaactaagatatatgataaatatgtatgcaagtataccaaccaaaccagagcgatccaagaggtcgaagcgatgtagctttgaacaataccaatgtagtcgatacaattggtagggccggccgaacgtaggacttaccccttcgccggagatcgaaagccaatgcagccccacgtcaggtgccaagtctgcatcaggtgctccgcgtcagccgttgctagcctgccgtggttgccgagaggaggagagccaggggtgggggagggaaggggagaggtggggggaggagctaggagggagagtctgagtgagagaaggggatataagatcagtggaaattttaatatagagaacttattttttttttgctttttttttcagttggtactccttagccgctactagcgaaatttgtcgcttaaaggaaccgtttgtaaaaatacctctatttttgcaagcagatatcttaagcgacaaccaacgaaaactaattttcactggcagttggtgatcggaatccctcttaattatctttacaagcgtgtgtttattaaacttgaggaaaaaaaaataaaagagtggtgctatgaaaaatatattttttaaagtagtgtcacttataagggcgatccgtgcacactgctaaagccacagaaggaatgaattaatggtcgccacatctatctatatctctctacttgttcatgaaaatggccatccaaatcctactctatactacgtatgtgtgtacagcgtgattccacgcagccttagcttacccgtaccgtacgcccgagtatgcaagcatgcacatatacgacaatctgttgtggacagccatcacggtcaatcgacaccccatcctctaaccaatgataaatccccattctttcttgatttgactttcgttcgaggtttttaatagccgtagacgaaaaattgaccatttgattcatataattttgcatctctgtatataatgatggaattataaaaactatggcatgtgttttccgactcctaattaaacgatgtgattttcgcataaaaatatatacgacttagtaatattgttttttaatctatttttaaaatcttataatagttaatttattttatttgtactcgtacataaatagttatcataaaatcatttagctattcatgggaaaaaatattcccgtaagacaagctcaatcatagcttaagaatagacataattaaattttttttagataatgaaatataatatccggcctttactcaaaagcattgcattccaatcgagtaactggaaatgtggaaaagctatataccagctgggttacatgcgtgtagagtaattaagcgtacggtatgctgttgatcttcccagttactccctctagttttttttagataatggaatgtaacattccggcctttactctaagagttacagccaattattatggaactcacacagaaagttcacgatagcagaaacaaagctaagcaaactaatagacaccaacaaaagaaaaagatcccctaactactgaattctaatagagaacctccacccgaagttggcaaatagatgcataattgtcgtctcaagtttacgacattcatcatttattagcttgatatcttcatcatgcctttgcaactgagcccaaccccgaagccaatacgttgccctgaaaagcacctgcaaataggattttgatggtgttttatcaaaaaccatatcatttctactaagccaaagagcccaacatatagcggaagctccaacaagaataagttttttgatttttttactaacacccacaagccaattcccaaacatatgagatatactatgtggaggataaagtccaaaagagaattgtatagctctccaaagaaatttagaaaaatggcactgaaagaatagatggtgaattgattcatttttcatacaaaagcaacatctcaaactaccattccaattccttctagccaaattatctttagttaaaacaatccctttaaggagataccacataaaaatcttaatcttaagaggcattttaagtttccaaataattttatttctttctatgtaaccattattaattaaagctaagtacatagatcgaacagaaaattggccattttgatgaaaattccatctaaaaatgtcatcctcgtatgttaagttaatatgcacaatggaagcacacaaattatgccatctaattagattctgaccaactaaagctcttctaaaagaaacattaagcggaacagaacccataacattagcaattgaggcatttttccttctaactatagaaaacaacgaggggtacttttccttcaaagaatagttccctagccacttatcctcccagaatcttacttgttcaccattattaataatccaggaacccatatttaaaaaggaattcttaaccttcatcagacctgaccaaaaatgggaatccccttgtttcctctcaacctgagtaattgatttaccagtaagatatttttgtttcagtaaatcttgccacacaccttgctcatttattaatttaaataaccatttacttaaaagacattggttttgtatttctaaattgtgaactccaagtccaccctgatcttttggttgacaaataatatcccatcttgtcaatctatacttttttttatgttcatccccttgccaaaagaaacgggatctataataatcaattttttgaagaacccctttaggaatctcaaaaaacgatatcataaacatagctagacttgacaaaacagaattaatcaaaaccaatctcccaccaacagacatatgtttacccttccaactactgagttttttttcaattctttcttcaattgttatccaatctttattactaagatttctaaaatgcattggaatgccgagatatctaacagtaaaatcacctagcttacatccaaaaatatttgaatattgctcatgacactcctttgcttgaccaaagcaaaataattcactcttatgaaaatttatcttaaggccagaaagtttttcaaacgcagttaataacagcttcatattttttgatttctctaaatcatgctctagaaaaataatagtatcatcagcatattgtaaaatagataaaccatcgtccactaaatgtgggaccaagccagagatctctgaccatcatcttttgctctcttaattaatatagttaacatatcaacaactatattaaaaagaattggagataatggatccccttgccttaaacccttgtaagtttgaaaatttgatcccacctgatcattcactttaatgccaacatgaccaccttagataaaagaagcaatccaatcacaccatttttgggaaaagcccttcattctcaaggattgttgaacaaaagaccatttaactttatcataagctttctcaaaatcaatcttaaaaatgacaccactcattttttttccgatgcaactcatgaatagtttcatgaagaatgacaaccccctccataatattcctcccaggtataaaagctgtctgtgtgggactaattactttctgagctaccccagtgattctatttgtagcaactttagtaaaaattttaaaactgacattaagtaaacaaataggcctatattgttgaatctttatagcctctttgcacttaggcagcaaaataatagtaccaaagttaagagagtaaagatttaagcttccactatgaaaatctttaaataactcaaccaggtctgttttaattacgtcccagaacacttggtaaaactcaaccggaaatccatccggacccggagctttattatgttccatctgaaaaactgcatctttaatttctttctcagtaaattcatcaactaacgattattttctagagaagacacctggggaatatcacctataagactttcatccaaagttaaagaagactcatcaggtggaccaaatagacctttataatatgtggtaatatgtgcttttaagtttgcatcaccatttatgatgtggtcaccatcttgtaattgataaattcttgttttcctatgcttaccatttgctaccaaatgaaaatacttagtatttgagtcaccttccaaaatatctttggtcttagcccgctgataccatttaatttcctcttctctaagcaaacaagctaacctattcctcatataatgtttagcattaagctcttcctgagttaacaaggttgattcagcttttttatcaagtaaatcaagtttttctaacagggctttcttctcctttttataggtaccactagtttgtttagcccaacctcttaaaaattgtcttagtctgcgaatctttgcttgccacctctctagagaagtatttccttcatcaacacttaaccaaatttcctttaccatatcaacaaaaccatcccttaacagccaacctaactcaaatttaaagttatattgactattacatacagaagatgagtttgtattcaggagtagaggagtatgatcagaaatatctcgattaagagcaaatatcgtggaaagtgggaatttttgttcccactccgtcgacattaatactctgtctaacttctcataagtaggtactgaaagattattagcccaagtataattctttccagacattgagagttctttgaggctaagaccgtctatgatagcattaaaaagaaaaggccatctattatcaaaattgtcattattcttttccatagtgcttcgtaaaatattgaaatcaccaccaacaataattggtaaggtttcatggctacacatatgaactaatccagaaagaaaatgttcctttaaatcattttgtgcaggtccatacaccaagactaaagcccatttaaacttctcaattttgttacaaagatgaaacttaatataaaaatcgccctcatcaattgaaccaatatcaaaagtttgtaaattaatccctaataacataccaccagaacaccccctgggaggtttacaatgccacaaaaaatctttcccgccacaaagatttttaagggcactagatgtaaaatctctcttaacagtctccgataaagcaatgaaatctagttgttgttcctttgtaagatcagaaataatttgggtccttgaacccatcactgttccaaaaaaactcctttcattaagactattgtaaaattatttcttacacctaactttcttgtcacttctcttttttatcgaaggagatatcatagaatcagaggtgatatacaaattataatcataatcaccacccgtatccattacctcctccatgatttcactacaaagtttttccaaaactgaattatcctccaactgatcgtcggtcaattcattttcaggaaaaacagtagaattatgcttgtctttcaaactaatacaatcacttaacctagcttcttccaaactccttatatccttaatagcattcacaaaattactatcattgtttgcatcgataaaacccagtttagaaagagaggacgaaataactttatctgacaaatgtaaaaaaggaatcattaaaatgcaaattacctttaacattctgaacctccaaattccccccagctttaatcttttcagccctctgcaaagtgagttgatcactatcacttgctcttctcttgctttgtctagtaggggagagaatcgtgtcaggtactgccgctaacttaacagctagactttcatgagacttaactgatcctgccccaacagattcctccacaagcccatcaaactcctcatcagatactgtcaatcctttaataataggtgacaaaacctgagaatcctttaataataggtgacaaaacctgagtagatggctcagaagacgttccttttcctgaaacagaaccactaaactggccaccaccttgcagtagggaaccatccttaaaattacttccatctgatcccttacccttatcttgcacatcactcccatccatatttttaccatcttctctatcaccactattatccatgtccatgggttcaggcacatcaagcccattttctggctccaccttaaaacacagctcatacaaattatccccaataaccacatccaccacatcagggataagagagggatctaaaaccagaacttgtaaacgagcaatgtcatatcttctagtaaaattcatatcaaccatttttgtaatacctaacattgaaccaaccgcccaaataattaaaaactcccttaactcagaaggtaagcctttgcattgaacccatacctttggcaacacatatttcacctcattactaactcccctttcaattatcttcatttctgcatcactaaccttagtatgtactattccccattctaccatgcgtttcagttccgcagcagaaggaaaaatagtacgaaaagtgttatctccattatcttccaccacccacttccaatttccaggaatcaatctctccaattcagaaacaacggtctgcaccgtcatttgtcctctagttactttaactagggcagccttagaatcatgttttattctctggccagctgaaagagggatatgaaaaaaaccaagaccatccactgcatacccacacaactcagctgagggtttattattagacctaaaaataggacacctggatcctatatggtcctcactttcacaaacctcacagtaaaatttagatgtacattcctgcaacgtatggcctttagtatagcatctataacaatatggattcttgttaatacctttgccacctacatgcacactcagctgattatccacctttgctttaccagagctcttgtcccccataattaaacctctacctgcattctcttgagtagatggcgtaacggttggttgtgaagtcccaaccatcgtctatactgcaaccactccagccgaggcaccagattctcctacagcggtcaaatgccgatcaccagctaccccgccaggaagatgcacattatcaccaaaaggagcaatcccagccagtacagaaccattgcctccagagttgctactagtctgtgcaccggcgcccgtcaacccggcaccatgttgagctgctgtcgatccctgcgcaacaccacccgcaatcatcccgccaccaaactgtgcagccgctcctccaaattgtgccaagccactgccggcagccaatagagatgcgtcgccaccaccagccggcaccggaggaaactgaccaaacggcaacgggaccggctgcaatccaaagctaaaggttggagattgcccaaaccttagcccaggattatgcccaaaaattggcctagcttgcagaccaaaaccaccttcggtatttctaaatttttcctgtccaaaccagccatctcctccgccatgggaaccagcatttggttgcccaccattgccgttccaacctcttccaccttgcccctgccggcctccaccaaaattccgagctccaaagcgatttctgccaaaccggcctcgagcaccttgaaaacctccctcgccatgacctggatgaaagtttgcacgagcagcaaagctgccttgtcctccccctccatgaacaggacgctggttctttctctccattgaacgacgaactacagcggcgtacgaaggaggcggcacagatcgatccgtaaacctaaccttctggcgcactgtccccgtttttgcgaatagagagacaagaccaggtgtgggcctaaaaggaatactgggcctatgtggcaattgcggcaaaaactcatccaaaacctcacaattcgaaatagatgaatcacccgaaagttttggaaacgcatccaatcggatcgaggaaccggactcaccgccggaggagaccgagatctcgccggaacggaagagactaccggagaacatctattactctgaattgtagaaggaaacgacaaaaaaactttaccctgaatcgctgctttgataatacctccaatcgttcttggcggcgatcgacgaggcgcaggaagaggaccactccaaggcttcgtagccggctccaagtgtaaatgatcttcatcttcagaaacaccctacaaaactgaaaaacgagaacctgacgaagtttccagctgcgtcctcgccgccaactgcaaccggggatgactagccatcggccttgaagcagtagaagccgccagctccaccatctgtgccagcttgaaccggacctttgcatctcgatcctctttggacaaagcatcagatggcgtctttgttggtgttgatgctgcagcccagcccggagccaaggtaagccctttactccctctagttaggtttatctgatgcttctgagagctaaaatactatgtgtaagccattttcactatccgaaacgtcacatgatttcatccgatggtagtaagcacacattttcaatgaaaactgataaaataaattcatggaatttcaaggtttaatttcgacgccatagacgaaagtggattccaagtgaaaattttgaacctctaaaaaaggtgaaaaattcggaggatttttgagaaatcatattgcaaacaatagattttattgaaatcgaaatttgacaaaaaaataggatttatccggcattcggtcgataattaaggcgagtctcgacaactggttaatttatgacaaaatttattgcagaacactcgagaagtatggtatttgctaatagacaccacaagaatgtgaatctgtttgataatatgttaatttgtcacaaaacatcggacgcattaaaatatattatccatccaattaatacgagagaaaccacataaaatatgaattttgcccttatcttcttctcccttctttcagtttttctccggcaccgagttatttgccgctgccgcccgtgcagtcatgcaaccactactcacgttcgtgtgagcacaagcgctgtgcacccatgtctcatagcaaggtcgctgcagtcacgctatcatcactgttgcagccacccccaccgtgaggtcactgccgcctctcctcacgcagcgcgctacccccgccgcaccacctagtcgtgatgctgctcctcacgtgctcactccctgctgtgctccatgtcacagtccactcatgtgaccctctccctcaaggccgctgccatcgtgttggcctactatgtagtcctcaccgctacaccgctagccacccgctacaaagtcgctaccgccacaccatacagtcgcatcgccggtcctcgcaccgtacaccctcaggctgtgttcttacccccaggtttcctaaaacatctctctcgtttttcgcgtgacgcttttcaaactgctaaacagtgtattttttacaaaaagtttctacacaaaagttgcttaaaaaatcacattgatccatttttttttaaaaaaagctaataattaattaatcatgcgctaatagaccgttccgttttccgtacgcactgttccggttgggaacacgctggagcgaacacagccttactacgcgtgagaggaatggatggttggaagaaatccggggcaccaaagtcattttagttaaattctctctccgatcctaatggaaataataatttaatagtcttagtgtgttttgtagcaaattactccctccgtcccagaaaggaggacgttctaggttagttaggaaaaaatagtgttgtgtgaaaatgaccattttgccctcaatttataggattggggctaatcatttgaatgcttagtaggagtacgacaagtacactgccacatctgtacaaaaggaatatttgaagcatccaattaatgttgggtgctactactagtatcaacactacagattggtgttatacacctaattcgagtgatatggcgccaaaacataagggcttaaaataatccaactggtctaatcaaattcaaaaactccatggatggtgctttgccgcccaagggtaccctccataatcctcaagcagcgaggcagctacaagccttttatcacttcatccatcatcctacaaaccaactccacacctacccatcacaatggctatagatctaaacatattagcagaagaagaggaagatggaggggctttacctgacctcaatgaagcacaagccaatctagaagaagaagttcctggaaggcatgttatctaggtagatgacattgctcgagttgcttgccatggaaatgatcaagttgtacattcttttgatctcaacttgggagcttttgatctcaacttggaagcaacagaagaacaagaacaactgcatccaggttttttacttcatctaatctttctcaatgcataaaatgggttctttctcagtacatgttgattgcattagtaaatctagctctaaaaacctatggtgttgtatgacatgcaacagcagattataccccctcatcagcacacatgctctatctctctctctctctctcacacacacacacacacacgatctgaaaagaacaaaaggttgctactgtgacagttttgcagagtttagttcttctagttccattatcatgtatcagaagacactttagaaactagacaacaggtgtagtaatcatagagagtaaaactcaagacatgtcactatggtttcaaatagattaaagcattggcaaacaaatagattagatttcagagcctagtatgaaattttagttcacatttaaccatttcttttcagaatcctagagcatctggactttacagaagatagagaaaacaaatgaactgtaaatagcacattgttacctaacatcgaattagggaggaagtaactttggtcatggccacagcatgttggaagaattaacaggcacaacctattggtgagcagaacgatgtcaatatttactaactgattttgttaattgctagtacaaagaaccaatttattgccaagaacccacacgtcttgccaaattttagtatttaatattcatcaacaaatcacgtgtttatgatgcgaaatattgaatcatgcttagatggtcacatacttgtgaaatttgaattgtgaagcatccttaactccagatcccagtcccagacacaatattcctgttgacctgctactgaaaataagcaagaactgtattaagtacctgaaaaaaattacttgtacagcactagaacttaaatagagctaaagatagaattaaatacataactgaattagcatgacaacaaatcaatgctaccttannnnnnnnnnnnnnnnnnnnnnnnnnnnnnnnnnnnnnnnnnnnnnnnnnnnnnnnnnnnnnn

SEQ ID NO: 11448 - DNA, 2004 bp, Oryza sativa
taagcaagaactgtattaagtacctgaaaaaaattacttgtacagcactagaacttaaatagagctaaagatagaattaaatacataactgaattagcatgacaacaaatcaatgctaccttacgaacagatgttatgcgttgcaggactcttatcatggcaaaacaatattaaatggaatgcaataaagatcctgtgtggtaacggctagaacattagatggtgcatgactctccattgaacagatcaagtcttccagctatatggcactatactgcttactaacttgtggctttggttgcacattacataatgcattaaagttagagtgattaaatatctatggttacctaattgttactagctagaagtatatggatatattatacatagcaggctcctcgggagtttatctgtaagtttccatagttattaaataatatatcttcaattttttatgcaaagttgactcaaataaattaatagcacacaccttgctctgctcgctgatattggaggactccaccacgaagtgcttgctcggttcagcactgtggttggccattgtcccctgccacaggtcacctccctgcggataagaagcattcgacgaaaaggaggccttggtaatggtagaactgggtcgtcccatgccataagtcacattggagctcatcagcttgccaattttaccgcctcgcttcttctccatttcaacaccatcgtgaatctttttcttgggcacaacgtcaatgaaccaatcttcaaatacgaagtcgcctccttcatcatccaaatcaggccagaactcatactcatccatatcgggcccatcctgggtatcaaagatcacgttcttgccttcttctaaacatcggccagattcacgatgaaaccacttgcctcgaacccgctgcccgcaccacatctgggcaggctgtttgcattcatcatttgagtgcactatgttgctgccgccacaaatcccaccacccttctccacttccccgcaatcctgaatctcaccaccattctccttcgcttccccacaatcttgaatcccaccacccttctcgttcacctccccacaatcctgaatcccaccacccttctcctcaacttccctacaatcctagaactcagtttcgggcacaaactcctgatctaaggagaagcagtactcgatgccttcatcatcagaatcagggatgaactcaatctggtcgtcgtcggacccatcttgtgtatccaaaacaaaattctcaccttcttccaataattggccagatattcgacagtaccacatgcctcgacgccgtttcttaccgcgcatctctctcatccgattcctatggcacacacttcaactctatctaactggcccctttgaatcaaaggaattatggaggaatttcataggattgaaatcctataggaaattttcctacgtagctctttgattcaaaggattaaagttttctaaatccaacaaaattcctatggaatggcttgttgcatatagattttggaggaaatttagcaagaggtctaatctcttggtaaaaatcctttgagtctatctctctcatccgattcctgtgtttttcatgtggtccaatcaaacgatcattcctgtgttttgtaatcctctgttttatacttgcattcctgtcagaatcctatgttttttctattccttcgtttttttcttcctacgattcaaaggagccctaaaagtttttattgtgtcaatattaccactaggaaaatcttggccgatctcgagttgtcgaccatggaattattaacaatgaacggtccagatttactctaaaccaatttaccgtaccaatctctgaaaaggatccgacggatcacataaaaaaaaacagccaaacgcaaagcgggcaaaaaaacaccaaatctcaccaaacgacattcgtgcggcgcaagtggagtggacggagcaaggccgaaacggaaggccgcaaacagcaagcagcg

SEQ ID NO: 11449 - DNA, 8365 bp, Oryza sativa
ctgccagtgcattgcctatctctatatatccatccacccatctcatcttttgtctctttctgctgctggagtagtattgttcatttatacatgcgataaatatcgagattaagcggaaactaaacatatataccctcgaatgaattaatgaactgaatccgtaaaatatgtatggtagatcggtagtacgtgtttgttccttttttttatataaaaaaaataatttgctggtgtttgatgatgcgaaggattgcattacattgatgatccaataattcgctcacgacgaaaccgcataattgcatttgtggttttgtttctcctcctcggctcctccctatatatgagctcgccactgctgccgcttctcctcgtcctgtacaaaactacacaccatcacgagaacctcctcgtggcggcgagctctcgcgactcgactctcgcgtcgcgcgcgcgcacggcgccatcaatcgattctcacatccatccatctgcctatctatctctcgcaattctggcggcgcgctgcgcgcatagggggggatcgaatttgatctagtggtgatggaggcggcggcggcgatggaggcggggcggaagctggcggcgcggcacccgcacgggcggagcaggacggcgcacaacatgtcgtcgtcgtcgctgcggaagaagtcggacgccgcgctggtgcggaaggtccccgtggcgccgctccgcccgctgctcgccaacctccaggaggtcttcctcgccaccaagctcgccgtcctcttccccgccgtcccgctcgccatcgccgcccagtgcttccgcttcgaccaggttaattcaattccccattccattccattccatgttcgctttgaccatcctcttgtctgcttggtgttcgttgcatctttttttttttcatcttttttttttcgagttcggcgtttgcaagcggcggtgaccaggtggcaggccgctgcggcgcctattttaagtttttttttaactagtataaaccgagatatagtactgtagctttttgctggtaaggccacatgggcaactgcacggctgcacgagggctgtgtccttgcactcctgtttcttttctctctctctctctctttgacacttttatttatggtgtaggattaattttcgtaactgtagtagaattagccatcaatgtctaaagtggtactagtaacagtgttaaaaagtatacatacaaaaaatgttgtcttgtaccactagtactagtgttaaactggccatggacgttccggtggacttcctgattccacttgaaaattaggcgctgttaggctaataggacatggaaattatttcccactcactagaatacatctttaaatcataaccattcattttcgctctttcatttaatcctaacccttcgttcatttccaaatctcaatcccacctcacatttctcattatctaaacacacccttagtacatacatttatggcctcttttaaagaagtcaataaattacagaaatttctcatacatcagttcaatttccacaaaattcctaggcttgatgacgcaataagcatccatgtctgccagatggcccagatgtaacctgaaatacaggcctaggagttaaaatgtggagcacttcattattcagtattttaattttctgttatgaactgttagcttgtgatttcctccctcctctgtgatagtagaatattcccccgcaaaacatattttgtggagtagtttgtattgcttgctggtggagcctattagctttgccagttagtttgcctcgtcgggacacaaatattctgccgtggagccctgagctttgaagaaaacccatctgtctccttgcagcaaaaactgaacttaatttgtcatcttgcaaattgcactcgattcctctttgatccgccaaattagcggcgtcatgccgttttgctgcttgctgagtagacgacaggattctgccggtacaagcggctgggacgatgacgaatccaacccatttaattctttgcctcttggttgagtgtacttctaccccagaaagtgatcaatctccgttgtgttttggagcttggtgaatcagggggtttgattgtgtgttgtgctaatagatttagcttgatttttagtttcgaaaggaaaacagatttagtttggtttggagataagttcacactctgctgcatgcatcatgcatggatgatgagtgaagctgcttccagtaaaggttggaagtgttggattttagtggttgaggccaacagtctgtcacatttcctgattagttggaagagacatgttttattcctgattagttggaagagacatgttttattccttccacgtggcatctaattatttaattgtgatgcaggtatttttgctgatccagtgctagtaaattagtgataaaataaaataatgcgttaccttacagtactttccctttttttttgtcgatatgtcttcatcttatacttttaactactattgcacattaatccaatatgtgttgacattgggaaacaaatatttatcttgacaggtgtgggtgttcgctcttagtttactgggcctcatccctctcgccgagagagtcagcttcctcacagagtaagctactcgttacagaagcaatttttatgtccagtttttaaaaattctgtttataattcgaatgctgaaattttgcattttgctactgaaattttgcaggcagattgcactctacaccggtcccaccggtaagtcacaacgatcagtcccaaactgaaagtaatttaagacttcatattattcgtggatggaatcatctttcttaacatcaaaaaatggcacttgtttctctattcgttgtagcaaatgtttttttaaaattataaaagatcagagaaaaatgtctcatattttgctagagaaaccaaaaataattaatgctacatttgtccacatgcaaaacggatggatctattagctcttgattaattaaatattaactaaaacaaacttaaaagatggattaatacgatttcttaaatcaatttttttcaaaattttttcagtttgaaaaaaatgagcacggagaagaaaaaaatgagctaccaaacacagcctaagcattgtatatgaagtaattgaacttgctgttgtggtgtgttgatgatggtgtatgcatggggggcagtgggcgggctgctgaacgcgacgtgcgggaacgcgacggagctgatcatcgcgctgttcgcgctgctcaaggggaagatcgaggtggtcaagtgctccctgctgggctccgtcctctccaacctcctcctcgtcctcggcaccttcctcttctgcggcggcgtcgtcaacctcggcgcccgccagccctacgaccgcaaccagtccgacgtcagcaccgccctcctcttcctcgccgtcctctgccactccgccccgctcctcctccgctacgccgtcgccgctggcgagcactccgtctccgccacctcggccgcggcgtccctcgacctctcccgcgcctgcagcttcgtcatgctggcgtcctacgtcgcctacctcttcttccagctcaagacgcaccgccagctgttcgagccgcaggaggtggacggcggcgacgccggggacgacgacgaggagccggcgctcgggttcgccagcgcgctcttctggctcgccctcatgaccgccgtcatctccgtcctctccgagtacgtcgtcggcaccatcgagcccacctcgcagtcatggggcctctccgtcagcttcatcagcatcatcctcctccccatcgtcggcaacgccgccgagcacgccggcgccatcatcttcgcgctcaagaacaagctggtaattcaaacaaacaatgtgcatcccatgcaaacgatcagagtcgtctctcctgaaaacaaaatcaatgtttaacttgctaattaatgtaacataatctggtgtttgattcaggacatcactcttggggtagctctgggatcggccacccagatatccatgttcgtggtgagtgctgctgcttaacttacccagtacagatcctgtagttgttctgctctcatccggttgaacggattgccaaatcatgatggggttgcaggtgccactgagtgtgctcgtggcctggatcatgggggtccaaatggatcttgacttcaagctgctagagaccggctctctgttcatggcggtgctggtgacggccttcaccctgcaggtacactgtgactcatgcatttttactttgaacaggtggaaatggaatttagtcaccgaaaattactcagataacaggataacatcttaagtgacatgttgcaattcaatgtgtcaactaattaatgggcttgatttacaggatggaacatcacattacctgaaggggattctcctcctcctgtgctacattgtcatcggcgcatgttttttcgttgcaagacaacctgcaggtatgtttgcctttgtaaaaaaatagcatgtttttgcacttgattgtaagtcgtattcacaataatccttcgcatgataggccatgcaaacagcaatggagccttgctggatgtaccaaccggttccatgagtgttcaggccgcatgatgggtaagctagcataatcttgttctagctaatacaaagacatgtgatcatttaatatagaacattgatctttaattttgaagaaaatgatagaagatgacttaaaaaaaatcaatacgtatgtatagcttctggtactgccgtatctctctatgtggactaccatatatttgtcatgatttccagcatctggtgtgacagagtagctaatttgtcggactcttggaatgcttaagtatgcccgcatgtgtctgaacaagtcatcaaataatagcatgtagtcctgacaggatgcacaccaatccctttcattggtattaaactatatactaaccttttggaacagagtgtttttactcttggagagcagagctgtactgtagtgcaatagtacttaatttaagctaaccacctgtactctgcacaattcttaactatgtccagtcagttatcttcatatgagaacatggaggtttttgtccttcaaatgagcaagactattagtaataagatttccagctccataatgtgcatctgatgcatgggaaaaatttcagatcaagatgtctcctgaacaaaacatggaggacagcaagcaatgtaccttggctgtcaagtcacttgggagggtagctcttcatgtgccagcaagacagatcatcatgatcatcagagtttcctgaagggatgcattggaagttgcacggaatgcatgtcaaggtgttactaatccttataggataaggatgcaataaggatatccatatatatttgtgcccaatcctatacccagtgtacatgagcacatttgttccatctatgcagctctcaataagatagtatttgcggtacaaatctatgctctcctaagtcctaacagggtgatgatgtaagagcagatcatgtttatgtctgcaactctacttctctatttcatcttaaaactagaatgtttttcaccatgatccgataatgaagtgacaactgccgaggtttcaagcagcgtaacaaaaaagaagattaggacaaccaaaagaaacgcctaagaaaacccaccatttctatgaattgagactgaaaactcctgttttgttttctggcatctccttttatcaagatgaaaacattctgttcatttccttccatgttgatataaatgtacagttcgtaaggaacagaagaagttttttcttttaaaaacataatgcttaaataatgtttctttttcaaacatctgtccatgttcttgcctaggagttaaatgtgcctaatttgtaaggctcagaatagaactagttttcatttaccttgagaagcctgaacaaaacagaggatgctagagagcaagcaatcttctggcttcatgttgtgaaacaccacaatgatgatatcagagtcctgaatggtacccattgttgcacgaaatgcagcttcaggagtcaacttcattgccaattagccaaaccaagaaggaaacacgactcctatgtgatacctaatagcagaaacacgaactgtgcagcagatcatattaggaacaaaaacacaaggaacttcagcctaaatacttggacatattatgccaatcttttatctccttagcagtacttttgttgtactccctatatgttaatttatatacccggtacgagtaatgatcgactaaaacatgggtgagcactgaacaatcctgcataagattaactgtattttactcaatattatccctatctaattgaaaaggcaattcccctgccagaattttagaaaaaaagaagaaatgagacagcaagtgtaaactaaatctttgttcaatcgtagaactagaagtagtattttgttcaagtgtaaactgatgaggtggacctgatatcagaaacatagtgaagtgattttgagttagcctttccagtccaactgaactatgcgcatatactttgtgtttatataaaaaaaaagtaaaaaggataacaatgtataaaagagaagacagaaggacataagagtacacccatgcctaacttaagagagaaaaggcaccaagagatacatgataaagaaattaaaaatattattaggttattggctgcagtagtctacatggactggattccctaagttagtttcagcctgtcatattctgcatatttaaatgcatggttccatacaaccatccataaaaaacctgcgtttttttggatcaattcagagccctttcgagcagcacgattcataaggagaatgtaatatttttagtcaagaaagaaaagtgtgtgcaatgcttgaaataaacattcaccagacttgcagtatgacaatgggaaagcccataaacaaattggatgttataactggaaattcagttagcggatacgagatagagctctcactcctctcagttaatctgctctttccatgtttagatattctgtactgacaatgcattcaaaaccataagatattcttcttgatcgcacaaatgactaaaaccgacgattagcaatataccacctgtaaattgcacgatagattaaacattattgtcagctattgccaccttgcgaatcattagggtctccatggaggccgcacttgagatgccaatctgctagcacggcctgaagaacggaccatatcaccagtaggacgttggctgttcaccggccgtcctgcccgtcgctgctgatgcagtggagcacgctctctcggctgctcactgctgccacgcctcatgttagcagcctgcgatccccatgcccggccattactgatctgaggtccgctgtgctgctgctggagatggacaccaggaatgtagaagctcgtgtacggcacgacagcgtagaaataacccattcttgcacaccttggtgacacgcattgatctgagctcaagtgtgaagacacccgcatctgttctcaggaagatgatattggcaccctccacaaatccaattggtagcactggggtagagtgatcaagatttggtagcagactgtctagctcaatgaccctgcacttctcccaatttgccacaccatgtccatgatccaggctcacatccattgaccacacagagaggaggctgtgatcctccacggccgcgagcccaagcacgccatcgttgtccagcggcatgagcacgaagccatcgtcgagctcagccggcggatcgatgagggagaggcgatggcgcttcatgtcgaacttgacgactccgataccaaacacgagggcgaagtagagcgaatctccgatgagggtggcgggcttgccctcgacgcagaactcgggtcctcgggcgaggcgagcggaggtcggtgggctccactcgtcggactccgacgagtacacggtcgcccacgcctcgttgtcctcctcggtgcccaccacgacgacgcggaaggggccctcgtggcagtcgaggtggtcgcagccggcggcggcggcggcgcagagcaccgcggcgttgtagtacaagaggtacgggacgtcggggcggggaagccgccgcagcaggtggcccgtcatggggtgccacacgacgaggtcgatcctggaggggtaggcgtcgaggagggcgcagccatggcggcagtcgagggccatcccgcagtggagctcgggtggcggcggggggatcgggagggcggtggtggggacgaagcggtcggggtggtcggcgttgtcgaggttgtggaggaaacccagcaggggaggcggcgcgcggcgtcg

SEQ ID NO: 11450 - DNA, 9142 bp, Oryza sativa
cagccccacaggacagagacacaaatttttttctcgaacgacgtggatgcaagtgcaaacgaacacgctagtgcaaataccgcgcaaatcgctccgggaggtgcagatcgcccttacctttaattactctgattatttaaaaggaagagaagggatctttacaaaaatgcaaacacccaacaacatgcattgaggtattttatatctcactgacaaatggcccaaactaaaaaccaactgaattttgctttgcacataacagcttgcctcttgtatcactgatgattggtccaacctatggtggaccccttgtacagtctatggagccatgcaacaaccaaagagtttgcatctatggagagggtaaagcgaacggtaaagtaaagcatgtactactactactactaaccatgaacagtgcaacagtagaagtagctacgtggatggctgtggcagctcaggctgtacctctctaggaatatagatataggtagatgagcccctagtaaaataaggcctatttaatttgaaatacgcgtgcaacaaataacacaacattctctaagtcattctttaaaatacacgtcaacaaataacaaaatattcaatttaaaacacatttccaagaaacaacacaactttgttcatgtggaggaggaggtcgatagggtacacacaatacataaattgatgacattgcacaacttcattccacaaacaaacataaccctaatagtagacacatgaatgagagcacacacttgtctaaaagaaaacacgctctaagaagaaacaacatgtgattcttcttctcttccatgtcaggacaggaactgcatgcattggaactaactgaggaatggaagaatgatgatgggaaacatagcgtgacaaacaatatatgagcatacataaacatgctcttacgccaagacatgtggttggacggccggttgttgctgtatcagagagggcaactcaagccaaggtcctccttatcagctgcatattgtcccctgcttgccgcaacgatgccaggtgcacctagctgccatatggcctacatgaccacaaatccaacaatggcgagggcattccttgtagttatgcatcccttacagaaagagcacttctcccagcttgcgcttgatgacattgttttgtattgttcgagtttcttctttgactgtatgattatgagtttggcaatagactttgtgattatggatttgagactttatatacgagccacaccagatcaccacgggcatatttagtatatgacaagcgggggccttggccccttgtcaaatttaactttatattgtatcccacatgtgtctgttatatgggccccaaatcacatgaggtatattcaatttaaaatacatgtgcaccaaacaagccattgatattcaatttaaaacacatgtccaacaaataacacaatatttattcatcgaggagtaggtcaatagggtatacacattacagaaattggtgacacgacacaacttttttgcataaacaaacataacccaaaaaatacacacttgaagcatagcatagcacaaacttaattaaaatgaaacacactctaaaaagaaactaacacatgatcttgtccttctcacatgtcagggtcgacatctcgcttgtgcatgagaattaattgaggaatgaaagaatgatgatgagaaacattatacatgcatacacaaacaggctcttaccaccaagacatgttatagagagggaacctcaggcctcgtcccctacttgccacaacgagaaaaatgtcaagtgcacctagctgccttgtggcctacatggctgcaaatccaacaatgacaggggcactccttgtagctatgcatcccgcacaaaaggagcacttctctctcttgcgcttcatgaaatttttgtgttttttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaagctctaaaaagtcttttttcccccccccccttccccctcttgggccggctcggcccatctccctccctctctctcctccccgcggcccactcggcctctccccgcgcgcgcgccgctgacgggcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccgtgattccctctctctttccccccatttttctctccctctctccctcggattcggttggaaaccgctcccgcaaacctcgctggcgccattgatggagcccgagatcgccgcgccggtttccttcccctccggccgttctctccccctcccaacactatataaacgctccccgtgcctccttccgtccggttccgcctctcgccacccttcctcttcgccggatttgagctcgcgacgtcgctctctctctccgccgtcgccgccgagctccggtccaccgccgtcgtcgccccggacctcctcccgtttcggcgtcgccttcttcgggttcgccgcaacctcgccgacctcgtccacccctccatttcgcccgccgaccgccggaacgccgccgtcctcgtcgacccgagccgcgccgccgccttcctccgctccggtcgtcgttcccgtcgccaccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagctgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgttcactctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaataaaggctacacgagctgcggcccggtagtcgagatgtcatggcacagggctggtgtcctgctgctagggggctcaatcctgcctgcctgtcccgggggttccggccgtaggtggggttgggtcggtactcttatttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttctacccccttacattaattatgcatctccggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctatttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttcctctttttcttcttcccctaatgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtgctttgcatcggtgggtggtgatgtaaccatgctaggttgtttgcttaatcaacttgcagaataagtgaaacaaacaacacatcaacaagaagagttagttcctttaaggtcttatctctagttctggtctattctttcctagcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccgagcatgctgcttggttcacagctaccattggttggaagtcaagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagctccttcctttggtttagcagggcaggcatcgctaaaccagcctcctcgcaccaagtcaagcttgcagcctagtgtgccaagtagagagcccaatggagagaatccattgaatcccgagaattgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacatcaaagaggaaataccttccgaggtgcacgacagttgacccagcacctcctaagccatggtggcagagtatctgatagtgaagggtcagatcaagtctcctcggatgatgaagatgagtctccccgacatctcggcgaggaagaaatggaatcaaaggcatgcacccgttgtggagaaattggacacgttgctagcatgtgtcttacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacggttgtctcatcagctagtcagctccaatagcaacatcgacaatatcatccacaacaccaatgctcctcctgctccacctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttttaagaggattctattggaagatgcggatatgtgatcatgtgtataattgtttactgataaaggagacctagggtctcatttcagaggaatcatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcgggtatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacatcaaggtttcactgaaaggcagcaagccaaaggacttcatcgtcaccagaagcgtccgcaatccacattaaagagtaccacctgttagagataagccgaaagaagattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtatttctttgaaggcaaggaatgaaatctttaactcggtatcagatgctacacggagtgaaaagtgcaagcaccggttaccaggcaatgccatgtcttgggagatgatccaatgggaaagagcacatcaaggttaaaggtgtaaaggaatacgttgaatgctaactaaggacaacctgaagataatagtgggaaataaactgaatgtaaagaaagtgaatccgagttgtctgttcatgggaactattcccagttatgaaccaagtgatatgttcgaagatagtctacagaggtcagacaacgaagcttcagatttggcaggataacgatcaaacaataagaaatccagcaataaagccatttgggaagacgtcaaagtatgtcaagtgggataagttggttctcttgggaagcataattcaaaggcaacgttatcgacccttgcatcaaatagcagaagtagctattacccggagaccgggaaagctaatatgaggcagctggtggcaagttagaagtgaatgacaagcatgatattcttatgatgacaaacatggtatcctagtaatgacaagctagtgttgacgcatgacatgaagtggtaacttccatgaggttgacgccaaaaatatggactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaatt

SEQ ID NO: 11451 - DNA, 28376 bp, Oryza sativa
aacccctattattatccccttgtacccccttgcattaattatgcatctctggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctgtttatttttgattgccaggcctgaaatgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttttgttcgagtttcttctcaaactttgtgattatgggtttgaggctttatatagcagcaatagcatatcgccaaaggtagatttaatgtatgacaagtagggccttggccccagtaaaatcctatcttactataaagttatcccccactaactccttgagcttgacatgcaaagatgccacatcatcatccactaacaagatgccacatcatcatccactaattaacaagatgtcacatcatcatccactaacaatcatcacatttaaacattatgcaaacatgctatatctttagagtttttataatttaagagcttttcaaatacaaacatgttaaattatcatccaacataattcacataatgtttcaatgtacatctttattatgttttatgatatcctatatacttttatagttcatcctcacttagttagtacttaaatgattaatctatggtccaaattatctttctcctttttttcatctaattaattcatatcacatcacctgtttttagcctttagatgattaatctacagtccaaactatctccctacttttcttcttccataaagtcataccagcttactttttatgtttgaatcaccattctacatactatttaaatttaaattatcataaaccacattaatttatttaatctgatgttatctagctatcttacacgttatttttttattattatcatactaaattcccgcagcaatgcgcggggtttcacctagttttactttgtattgtacccccacgtgtgtccatcatatacttactccggtttagctaacacatcacccccactcctcgggtacttttcttttcttcgcgagcttcgtccttcacgtcggtgattcagcactgcgcatccactctaatcttctctccaattgaaatgggaattagttaaccaaattaagagaggtgaaattataccctacctaaatttgaggatctcaattcccaaatcctcatagcaaacaaagtgaaaagtaaaaggatattcatgtcgcctagagatagggtgaatatgcattcctaaaagcactcgcaactgaatatacactcccgtcagagtatctgaccacaaacactagatactccgatcaacatgttctgattgacaaatttggtcaactggatagtctggctaagtaccagatattccgatcccctaacaacacctcctaaggagcttgtgtcgagaacaatctcacacaatgatttgtgaaggttttccctcaacaccacaagggaagaggtaattgagtgtaaactgagctagattgttacatcttggtggttgcttagaggctaaagtttcttgttggtttgctagcttggtgagatctacaatcgaaagagatctggcttggctccttggagtgttctaccacaagcgatgacaaatcagagatttaggaacccaatgagaaacatactaattaatgtcttatgtactgatgtttgtgatgcagaagtattatcgttctaccctcatagatttcttttttgctatataaatatgatcagaaatttgaatgccgatagcatgtatcattatactctttcataccagaagaaaccagatcttctaatttttatgtacttcaatttagaacttgtttggcaagactccaactctagctctacctcttctagaactggagcccaactaaaaaaagagagtggactggactagaatgatctgaaaaagaactagagaggtggagcaaggtctgggacgttccacaactcaactccaaactccgctccaagagttagattgaggagttagagctctcccaaacatgtccttaattggtctatcagatatattcagaattagggaggtatgaaaaaagaggttacgattttgcaacttccatttgaattttttttaaatctttacattctttaatcctttcattttaggtactgttcctgcttgatgggaggatttagattgaaacatgtgtaaactccctctattttcttaatagatggcattgttgactttaacatgatatttgaccatttgtcttattaaaataatatgtctcatttttttcttttataacttgttttctcatttaaaaaaactttaagtatggcttatattttttaaatttataatatgtttttaattaagacgaatggtcaaacattataccgatagtccattgcgtcatctatttaaaacggaggtggtaacatgaaccaacctaccagcccttattatgctatttctagctcttttaacagcatttaggatagctacatgcagttctattcatatgctataagatctatgcaaaaatattttccttccaggtcattcatgttttggctaggtttgggtatccgtgaagcactggttgttttctatttctatgtttgaaagcactatttaacggatctcctaagatttgttttgacaaaaaaaacaacaagagggcaaactttacaagagagattacataatttgaatttacaagaagtttatgctaaagtgtgtgtccatattgccaaatgggtatgtgttccttctttaccatgaacatatgcagggtaaaataattcctgaagttggtcttccataggttccatgaaggatttacatagttaaaatttttattatccatatgttccaagtgacgatgacatgacttcaataaaaagggctttccaaactaatttgctgcaagtacaatcatattaataaagttcatatgcaaagtcacaggtgaaaaaaagatgcatcacatcctccagggcagcactatacattgcataatacacactctggtcctccttggacgttgtattgtcttcttttcaacatatctctagtgtttaatctatccattaaaagaatatagagaaatacctttagattcattgtacattttcttttccatatcaattttatcggcagaggtggttgcaagtgttcataaaaaagattgtaaacttttttggtgctatactgaccagtgaccagtactccatatattgtgttctgagattattgtatcttgaattgtactttccatttattgaagctgttgtaaagactaaactgataaaggaagagtgaaattgtcgtctatgtttgcacttagaaaaaaaatcccttgttgattgatcttcatttctaacaaaaccaaaagatcagggaatttttcttccaacatatgaccattcctgttgtctttctagcaaactattgtatccctattccgaatgttattttcgatatagctctatagagtggcaataatcagaagatgtctttccgccaaaggaacctttttcagagcaagcatgcggaggttgctgagattggtagttttctgtccaaactaacttgacccagcgaagatctcttctattataaagtttatccagttatttcatgagcagcgctatattatggtgttccaaattaatgattcttaacttcccttttgtttaggttttttaccctatcctaagctgccaaagaaccactccctccgtcctaaaaataaaccaatctaagatgtgatatgatattacatagtacaattaatctggacatgctatcctagattcatttatttttgaatggagggaatagacttgagttgcataccattttctcggtaaacaacacctccttgctctgtctttatgttacatgatttttttggaaccttcaatgtacacatgtggtaggttggtaatgatgaaaaaaatagaattaccactgttaactttgaccatgtgataaataaatttctatggaagatagcctcctgtcagttctatctataagtggaccacagtcaacaactctggactttgttgtgcaacccagaattcctgctatatgatttattgaaattaattttaaggcctgttgactggacatgagtatgaagaagggacttaagaagaaaaaaaagcttatttttaatatacttttgttataataatagtatcatctacacattgaataactggaaaataaccatcttctcctaagattgttgtgcaggttcaatggtcaatgtacttctttccgaagcttctattcttttgagcgctaatggtgtagagtaatagcggttgaggtaggggagtttccccgtaggatctgatgtcaaggtctctgcacatcacccgtgagccatctctgtgcttccttgaggttgccactgccacggacgaaggcagaaaaatctcaagcctagggctggtctgattggacttaagtattttcacaaatcgtgtggtattttcacatgatttgcatggaatttcagagctaggtctagggctcaatctttaagcccacccccagaattttaaattaagttgtgtattcaaaataaaaaatgggtcaaaagtatgatatttggcatgtataatattacatagtattgatggtataatacatagcatacgtattatgtgttggatacaacctcttgggttaaatacaacaactcattttttatacgcacgcatcacatattatatatatatatatatatatatattgtaattaaaaatatgggtattcatcctaatacccttgaattgtgttggggcctcccccgagcagcagaggccaaggaggtgagggatgtctgtcgcattatttgtgtttatatgctctcggctcacaatgttctcttacatgggccttatccaatgacatgggcagccttcaactgatctgagttacaccctcacagagaagcactaactgatatttgtgatggcaatgacatccacctccctcaactgcctttcacatcgcaaagatgtcctcacaacacaactttaaagcaaaactggcaacaaagaacaacaatgacccgaattgtttgaatattcttttgcactatatttgaaaaaaattaggtactaaatatatttattgtaatttttgttttcctgttgtaacgcacagacattgtgctagtaataaataattcttggtaaattatatgatatatagatggtacagattgtaatatctttgaatacattcagagatatgccaaattatgtgacgcgtggaatggatggtacagattgtttcgacaagatgtgttttattaatgatttattcaaagatatatgacttgtttattgatttgcctggctagattaagccaaattctgatgatgtttttctgatggcgaactcaaacggcgtgtctgaagtggtcttgagaaatgaaagtgacgttttcctggggcagccgtccacttttaccctttactgtgtgatgctacaatggcagaagcgttggcatgtccttgagctatgcagttagcatctgaattgggtgtttcaaaatcaatccttgagaccaaacagtctggaggttcagaagatggtagctgatgagaaagtcagcagatcaatatatgtagtaataatccaagatttgaagcaacggctaagtttgcttcatgatttcaggatcaaatggatttgtcggtcagccaatatggcgtcccattttttagcaaagaaatagtgtgctacgaatttacttcgacctatttctctgtctcaccagagtgtttaaggtcccagattgttaaaaactgtaatcaaaccggttccgctgaaaggaaaaaaaaaaagaaacctaagctgtgatgatgcatgaacatcacttagagttagatttgaaatctatttgctgtttgattcactaaatctttttaaataaatatcaaaccttaaagagtaacgtaattgatttgatattaattttggcacagattttgtgaattgcggccatgaatttcagacctgaggctaaaatccatcaaatcctccaaaacatcatttcacaatatactgatgcacacatggcacatcaccagtagtttcagtgctactttaattgcaacatgtataggcgtctctatgatgaacaagatataaagttgcagacccatttttttcattgtcaactatgatgtctgttaagtcaggtattctccgaaaacttgagataaaaacgacatagatatgcttcgtatacatacacatgattgcatattgatcaatcccctatggaacttgatgaattacatatccatttaagtagctaccgtttgaggcgcctcaacactatcaggaaagtatcaaggcagagtgtgtagtcatcgaaggcacttattccacaaaatttaccacgagtcaaaactaatttgtcccctccaatttgaagcctatcaaaggagcaagcgttggaaacctttacaccatggccaaagttcttgtgtgcctgccaatgtacaacaagtgtcaaaaggatttaacacaatcaattaatggccaataatgttgcgagattagttaaaaggcacagtagtatatttatatatactgtaccatataataaaactatgcgaaaactataaagtattccccacctccccacttttttccaatctgtaaggatattcaagaaacagaacaaaattagtgatagtttccggatggcttaagtggataacatagtaattagcaattaccattttattcacttcaatttccatttccatttaccaccttattaacaccacgtgcgatgcatgtacatgcttaagactgactagtgagtgtcaactatggtcattgccaccaaattattgggacataacagtaaacaatggttcaaaaagagcatgagctgaagggaagatctaagtcagatggtaacaattgatgagtttagaacagatgaagcatgaggaatcctgctttgtttggcctatttgatgcatatccaactgacaacgggtaaggatcagggtagagcaatgttgagcacttttgttctacatctgtacaaactatgaatgaattcaacatacatcaactgccctcatcactatataccatcaaaatacgagcgcatttctctatgaaaattctgtactacagcttaagttcatgatcaaacatcaaatattcaagcatgaaacaatcaacatccgcataaagaaaagaaaataacaaatagcaataagtatggactaagaaaatggagtacatgggaatcaatgataactaatttcaagctgtaatgttgcaagatgctttcaaactaaattaaacttacaaacgatatgcccactattttagcatcggagttgctcatttgttgtgcaatttgataggcacaagataaactgcctgatagaactcctctgataaccccattctaggtctaggagtgccaaagaaccatatagatcttcatattacatagctaagatcaaccaagtggaaagtgcacaacagtaaacatcatattacgtagttactgacaaccaatgaaccagaacctgtcagcccataccttagaatgtatgaacaatttttcatatttcaaactactgtactctagaatttcattaatctgataggaaatgaagagggtggcattcagtcaagtctcgtgatgttaagtggaaaaaaattgctagatactacagcataccattgtgatttccagcatgactaaccaagaggtcaaaagttcccttgagaaaatacaattccttagttcactaattaaactcgacagagagttaaatgcgggtacaagaagtgaacaagatagaaaacaaccttcctacaaattgagttatttaggttctcttaagacaatggcaccaatagcaaccactggagcaatttttatcaaatatgaaatatctacttgcctaatcatatgacgacaagttaaattacagatgaaatacaaaagacttacttgccaaggctttatcattgccatatttgggttattggtttgaattggtaaggcatcgatacataaactctcagtacgaaattcaggtgagaaggcaagacaagtagacaactcaaactccatatggtaattgtataaaccaagcaaaggatttcaagaaaaaaaacaaaaatgtttgattgatctagccatgaatattacagaagaactctggagaacaacggtgtttcttcaaaatcagtaatcaataccagatattatcaatgagactcagcatagaatgccatgaaaacttcatccttgaaaatacaaacaaacaggatgactgttgataaagatgtcggtgtaacagcaaaaaatttcatgatcagatcattagaataaagtaggataactttggttctgtttattctacacaaactggaagctgctaattgtaaaagagttgttattactcattctgcagccaactggtatgtccaacatcattgtgcgtgcttggcaccaaatataattagtgtgtccagcatgcaaatctccccaaaaaggtaaaatagttcttttgccccatagtttagtgtttgctcatttgccagtttccacattcccagtgaatgacaaccagaactagggaccacatgtcatacacacatatggggcaaaagagcaaatgccatcaacttattgtgggacagaagagcaaatctccccttggaaaattggtttaccagccacaacggcaactgatattaagatggtcccagtccagaagggaaaaaaaaaagtcttgcatggtgcaccattcgtcgaaacaatgtttaggtatcaactcaataatctcattgcgtagcataactacaaataatgggatgttttacttctggtgcgccattcatcaaacaatgtttacgcagcataacaaaatagaccaatattctagtggagcgcttagcttgcttgacatacatagctcctaaagcgtaataagagttaaacaaaagtaggatataaaacttaaaagcacggttgcataagaaagtaaagaaactcatgacacagggcaaaaaaggttgcaaatcactaaataaataaataatgcgtgtatattgctacagaaaaactatgtgcacagaaagttgaatcgcacctagctcctctggacatattactgtgctgttgcctcaaatttccggagcatgtcgcagtgcggcgtctcgtaggaaagcccccagtggcgacgctgcacctcaaccctacaattctgtgagagtattgagaagtaatcccgctcaacatgccgttcgagtgttgcacgctcagtgctctggtgtggatactgctcctcaaagttaggcaacttgacatagtatgtgactccacgtgtggtttggaatttgtgctcataagggtaagagcgggacagcgagtagaccggttcagaagatggcaggaagttgagcaacagcagcaatagaacaggcaacagctgaataagcatccggagagtggagccaccggaattttgcgccccatggccatggtgcatgccgccagtcctgaaatgaaacgtcccaaactgcccaaactgtctggtggtggcaggcgccatcccgccaaagaagaagtttctgaatatctcatccggatcaaattcatcctcataaaacccattatacgcacgggcagtggaggcagccctcctgttgtaagtcaccggctcgtccgagccaacaaggtcatagcgcttgcggctctcggcatcgctgaggcactggaaggccttggagacggccttgaacgcatcctcggcaccgggggccttgttcttgtcgggatgcaccttgagggagagcttgcggtaggccttgcgcacgtcctccacagtgcagtccttctcgaggccgaggatctggtagtagtccctggtgtgcttcttgacctggcgcacaacctccagctgctcagacgtgtatgacctctcaccggcgctctcgtcctcctccttcttcttacccttctgcttcctctctctcagaccatcgctcccggttgcttcctccgcggatgctgccgctgctgacgaccgaggtggcggcggcggcggggcctgtggggacgacgacgaggcggaggacgagggcgggtcgtcctggttgaggagaggatcgagcaggtggtcgatggggagggaggggtcgaggcgcttggccttggagaggaacttgacggcgcgggcgctgtcgccggcgtccgccgcggccttcccgatgcggaggcacttgaccgcgtcgtccttgttgccctccatggcgcctccccccgcgcagccgccgcagatctggccgcgcgacggcgagtcaccccctcctcctcctcctccgtgcgatggaccccgatcggatcggctccgcccccaaatccaatctgagaagcgatcgattcgcacaacaaggtggggggaatcagattccgatttccgaacgagccgtggaaatcggccgcatcggatgattgggaggcgcgaccgtgttgggagatgcttacctcgccggagttggagcggagaccggatcggcgtcggcgtcggcggcggcggcgagtcgccgtgggaggggaggaagaagagaggaggggggggagatgtgatgagacggcgacgcgacgaccaccgcgggcggagtcgatatttcccacgactccgtctcgctttgcttcactttcctcaattttctcaggattccttttttttttttttagttttccctctgtttgttcgttctctctgcgagactgcaaatacgcgtgaagaaaagggtgtgggcctgtggtaattgggccaattagaaacctatgtgaggccgtttgtgggtaattagtttaggtttaggaaaccgtaatgatggctccatcgtttgcatatttgcaaacgagtactccaaccatcccaaaaataggtaaacattggtttccgtgtcgatctttgactgtccgtcttatataaaaattttttataattcgtattttcattgttgtgagatgataaaacatgattaatattttatgcgtgacttgtcttttttatttttttttcataatttttttaaataagacggaaggtcaaacgttgggcatggaaaccagggtttctcttttttttgggatggagggagtaataatttgtgaataaaaattttatttgtgtgttcctagcgatcttaaaaaataaagtttaaaaaaaattcaaaatcaactctgaatttaaggttgaaattttaaattttggttgataagtataagtataagagaaaagatgaggcctatagtttcccagttgcttaaaaaaaattctcactcaactcaattggtaaccgtgagaagcacgcggtcacgtaaaaatttttatttccgtcaatagagatatgttatgtgacgatgtatatatgagtacgatgttaatagcctaaaagctcaaagtttagaggagtgacttaaattaaattaaagctaccttgaaataaccatgataccatcgaagattcaaatgggaatattgtgggatactcctattttggtgacaaggatgaagaaaaacaagtggtatcaaaagacactgaaaaacaattggatatatgccaaacgcatgggaaaatgagtgttgaattgtgtcagaattataaatgcgaacacctaaaacttaatctagatcgtaagacaacttatggcctgtttggattggggccaattcttgccctacctatcatttgatagttttgaatagtactagtaatcgtgcacgtgcaatgcacgtctatgttaaaattattggtccaattccactaataagtgaaaaacaatatatttattctaaaccactgatattaacatgaaacttaagtgacaaataatcaaaagccatctgtagtccttttgttatccactgcatttcaaacaaaataaataaaaaatacaaaagcttcacttctcactacatttataacaaagttttacaggtgccatcacaagttaaacttttgcaactaatttggtctaaaataagcaactatagaaccatactctcaccgtaacaatatgcaacctggagattaaaaacaataatccaattaagctaatcaacctgacagactgtcacttctgtcacttctgtccaaggatgaatatctcaatactatacaatcaccactattttttcctttcaaaaaaaaatcacccctattttgcatctgatatacggataagcaaaacattgtggccttgatcggcagcaatggctgctgccgcagctgccctataggtgtaaataccatgtgaaagaagacatgcatagcactcttatgtcacttggccatataaagttttcaactccacaattatatatatacatccctcctgtcctcaacataccagagcacagcagaggtgcatatgaatccatccagattatatatagagaaacaaaccctcttgtaatcaagccgaatttgaagagaaaatgtataacatatgcatacattaattcctttaatatccaaactgaaaattaagaatcaatagtatcagccatggaaaagaactgagttagatcacaaaatcttctgacgaaactaaagatattgaagccaattttctatcaaccactaattgcatgcacaattgagttgtttatatattcatacaacacaaaattgtaaagtgccaacccgaagaagtacatctcgatgtgtcatgcacctatgtttaactgcatgtccatgcatgaaagtcaaggaactccagtagaaagtgatgtttctaccttcacggagtgacagtaacatcaaatgcaaaggttataagtataatacaaaaagaaacactgatctgttcattttgaaagcaacaaactattagcctgaagcacatgtattcacagtaagaaaaaactattgactgagagatcaacttggttcacaggagaaaaaagtatgcttagagctccaactgagacacgaaggagtagctaaaaaaatatgcatcatgagcttaggacttagagcctcctttgcttcttagagcaagtttaatagtatagccaactactagctccaattcatctatagccaatctaatagttcattcatacaatagttacatactacactattaatacctggtcccacctgtcatacacacactgcatcttagagtccgtgctacagctggctataaatctgtagcccgctactcttctctcttctcatttatctacttaaaatatgtttgcagttggcttatagcctgctattgtacctgctcttaggtcctttgcttcttcggttcctcctaactactgaagccaacacatggatgtcacagcattcacattgccatctcccaactcccaagaaacttgcttcattctcatccaccaaggaatcaacctatatgagcataaccttatatgtcacctgaaaagaaaaatgaaacgttcaagtctcaattaatcaagctactactgatcatgggattgcaaccagcgagcatgtatatccatctgaaccatgttgcagtgttttcgttatacatagtgtagctgcagaacacatgcaagaatatgaccccaaggatccataatcatatcttcttggctgttccactgaacaattaatactgaattcattatatgaaaatcctgaaaaaaaaaaggaaaaatgatggttaattggatctcttgagaaaatgacagtataatttatgctcataagaggcaccatctatgaaaaatatataatttagcatagtcgtgacacaacgcaacatgaattctaattgcaccggacctcattcttagtaacatataaattaagcagaaaatcactggacaatgggccataccttatcaccagaagtcatatctcggtaaaacaaatatcattatgttgagacttgagatgatcagcacccaaggaattaacacttatcatttgcacagttgtaaagtaaaacctagaaatgtcttagcaggcattctgatatgggagttgtttagagaaaacatttagagatgtaagttgtcagttgcacaccaatagtgatctgcatctcccatttgtaccattacaccaaaaataacttttagatcacaagcatttgcaattttcccatctataataaatgcacacattcatatggaagcataaaaacatacacaattttaattgccggagtacccaaagtcataagcaagagtaaccgggacaagggaagtagtgttgttgaacctgacagcgccgcaacgggatatatttatttatttgcttgtgatgatgaacacccatcggtgttattattggtggagaaggaggacgatgccccggagctgtcacagcctgattttcgttttaggatttaaaattatttaatcaattattaatagaatttatattaaatgttcattaatttttaagtgaagttaaatgtgggaaataaaattttctaaatataaagcatggctggatttaatttttattaaattctccatgattaattatactatctgaaattttctcggatttttcggagctcaattcctaattttaataatacaaagaatatttcagtaattattcacatattaaattaatcattaaatgagctggtttcaattttgttaaatattttgagtgtccaagtatgttcaagattgttcttggaattatttgagcattggaagtatttttaacaattgaaagatcatttcagtgattaatttaattgggaaaagtaattagaataccgatttttttatttataataactaatccttcacaaattaaataagtagtaattatctgtagggatttaccaaagtagtaaggacgctattgtcatcagcgtccaggtgtggacactgttataatacatgtccagctcgagacgcacttcttaacagcgtccacagtctggtgcaacccaatgtgccttactgccttatcacaccggccgccttatcacaccggccactgtaagcgcttgttgacatctcctgctagcgagccttcgtgttgtcctaagcaacgttagctcgatcactttgttggcgattgagcatgtttaattacttaattatatgctatcactctataatttttgcctttgaagtgcccacgcatgcgttagcttttcctttatctggtccggttgcctctaaaacagatatatagctcgttgttggatcaatcaatttgtagttatatataggtatgtcgattcattttaatatcgctgcatatcgtatcaacatattatggttctagataaattatactcatatatttcaataatccagccaactgtgtcaattacaaatacaggacaaacaatctgggtaggtgttgacgaaaaaatcgaatacaccggcctgggagatctgcttaactccagtgcaggtccaaatcttggtgaaatgcgagcgtgccagtcagtttgatcttgcaactgacaagatatgcaaatagtatatcaaaacagccgatcggctgacaagccgatagagtagttccagccgatagcgataatagccgatgccgataccagccgatagcgatagggtttaagcaatcggctatatgtccaatgtagataataatataaaggcaatcggctgatgatgatgtaataaaataacaatataatccagtataaaccaatcggctagcattgatatgatagaataagcactgatctgaaggttaaagcatacatcggctggaggcccgatgtcatgaaatctacaagattagattaaacagtgaaacctttgttgtcatcggctaaatccaacttatatgtatatgcaatccttatgagccgatgcaacgtccagataactcatcagctgaaaccccgatgaaacccttattggcaatcaagaagcaggctagaaattatggttctaagcacgacttagtagatcaaacttaactgatgcagcactaagtatgaaaagaaatataatatctagacaatcaagccgttgactgagttttcagggtggtagatgtctaagctaatctaatctagcaacgcgatttagccgataccggcagaaaccctaaaatgagaagcagccgatagagctaaattgatatgctaaaactagattaacagagacatatgataaataggtaggcaaatatatcatccaaaccaaagcaatccaagaggtcgaatgtactgatgcagccttgaacgacgccaacgtagacgatacaattgcctggatcggcggaacattggacttatcccttcgccggagatcgaagacgatgcaactccgcatcgggtgccaagttccgccggaacgtaaaaacaaaagtagaagtaaaaagggtggcgatgcgccgaattgtattgatcgtagcgattgatagattacaatgaccccgggtgtacatatttatacccataggttgatacaagtccttgtcggacaagaaagaaactttcctaaagataaaaggaaaagataaagtccttataggacactaaacacactttcctaaagataaaaggaaactaacaaactattcctaattaatagatacaactgccttcttcggactcgatccgtacgtggcaatcatcatgaagcacgtcaactcaatctgacaatgattccaatatcatcttgccggaattggctacatcggcttgccttgtcctattcggtaactgccgatgcacactgtagccgatgcggttccgaagccgattcataccctgtttccgttatcgatttcctcccaaatccgcttcggccttaactccaaatccgatgcatgatttaccaaatttcatcgttaacagtaggtacaatacgttcttgcattaactaggcaaacaaaacgattcaaaccaagtatatatccggacactagataagttcttatacatacgaagaaacgtccacaatctaaaaaagctcacttaaatatataagctagttgcaatgtgcttcttgaaacttttcttagcacttaactacttgtgttgaacttcccgaaaacctaaatcaaacgaaaatgttagtttcaccaagataaaataaggcagctagctgattctcacagagttactgtttgttgagtcactagcttggcctccaccatcttctgtgtgggcactcctatctccatgctctatactgcaaccttttcctgagtatacccaatagtcaaatacttcattgtattgatacttttggataacttgacggaaccatggcaccacaaacaacaatagtaaatctatcaggatgaaacaatcttattgctgaaacaatcaaccgcacaaaaaacctgactagggtccgcatagaggacgtcgctgtcgagcggtcactggtggcggcggcctctagcgcaaggaggtctggacattgttacgaagatgttgacgggatgctggacgtcgttcaatacagcgtccaggtctggacattgttacgaagagcgtccattcctggacgctatagcgtttagcatccatcctacaattaaaatttccctctatcatttactagatatttaattaataggttgttaattattatatataaaaaaatcggaattaaaattcccttttccttttcgggccgaaacaggaaaagttcacatttaatcctccgcccattcttccttctattcggccggccttatcccttcccaaagtctagtttgcatccctccttctatcgggctgtgcaatggaagcccatccaaaagtctgttttgcgtcccctcgctacagtgcatcttcaacctccagccagagccgagctcctgtgcccgtgtcctgttgccgccgcctcctccttccaaatccgacctccccgttgctcctctttccaaattagttgcggaatggaatcctctcaatctcctatacaatttccccacgaaatcctcaaatgtttctatggaaatcctttccaatttcgcggatcaatctttccttttcccggcgaggatcctaaactttcccggagtttctcccgtcgatttgggcccggacccgagctcccgtgcctatataaaggaccctctagtcgtcctccacctatcccctcaagtcccgtcttccaccgtcgctggaaacgctctccccgcgagcaccttctctctccaccgccggccgccgctccagccgcgccgttcgtcgtcgtccatcgtcgccttaggtcgccgctgccaccgttgggttcgcgaggaggagaagaagatcgtcctccacttccccgaagccgaaatccaccggagctccatcgtcgccgtcaacccgaagttcgccgtcgtgttttgatctccaacgaggccctgctgctccttctgtcatcaccaatcttcaccgccacatccattggattcgcagctgcaagcagaagaccgtccaccacctcttctccgccaaagatcgccggaaagtcatcgccaccgtcgatcagtaccccgtcgccactccaacctcgccgccgtcgtcatctgtcgtcgtttgccgtcattcaagtcatcggtgagctcccctcgtcgtgctctttcctccggttcagatcaatttaagtcatccaatcttggtcgactcgatcgagattaatctcagccgtccaaaatcgatataaatctgttcgctcttttcaatgacatattattcctttttaatatatgtcatctatcaaatataatctaatctttttcggaggttgttttaatcttttgtcttaattataaatcatttgtaaatggtttaattaatttggaatagtctttttctttaataggctttaattggaattaattttgtaaattcataattaaatcatatgaaattggaataaggccgttcaagtctcattcatctaaaatcatgatctacatgtttgtttactttatatgttttgtttatttggagtttcttagtctttttctttgttttgcgtgttagcttgtcgtttctgtcgttgcaaaggttcgcgagtgcgccggaagtgttcaagaagattaattgaagaccgttgcaaggcaagtcacacaggtcccaaacacaattcctttgagcatgttgatcctatatttaattctctattaatttcaactatgcatttattttcgaatgtcactggtggtgtgtcacgcccggaaattcactagtaatttccgaacttatttgtgcataaaatcctcgtccagaaatcagccgaggtacacaaactgacaatttaatatacaaatccatcataataataacgttacacttacaaaagaaaagaaaacagcagcggaataacggtctagcgatggcttcagctccactcccacaggcagcttaactggggtataagccaaacatcttctccttctggatcatttttcttcaactgaggttgattgattattgcaagaatgagcatatgacatactcaacaagccacacagcaaatatgcgagtgcacaaggataccaaaggatggcataatataggctcatttgcaaaagcagcatttagcaaaacatttaagagaagtaaaacagtggagtaattaattagaaattttaatcaacactgaacagcacacccatgctgcacaggcccaaccatcctgaacaaccatacccggctgtacagatctaactccaaaccaggagctaaacaaattattaccaggtataacatccataattattgtgagaggtgtgagactaatcacgaaaaacattgctcaacccgcccataaccacgggcacggctattcgaatagttttactctggccagaggtgtaccactgtacccacaagacacagcctcaacatcatgtctaccatgcgtcgcgatactggaaagtacccgaatagaggctgtgacaataccatctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatatttctaatcatgactaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtatatataaagtaaacaaacatgtagatgtcgattttagatgaatttagcaacttgaaccactcaaaaccgagttacgatgatttagttatgaatttcctaagatttaatctattagaaaaacaggaaaaagaaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggtggcgacggggctgcggtggtcagcggcttcgggggtcaggcggccgggcttctccaccctcccgcgcacctaacggtggtgacgacgaccggtggcgacgacggaggcgacggcgcgacgcggatggagctcggccggcgacgacggcggggtggagcacgtggcggcggcgctacgaggcacgggagatcacgggagagggggcaaacgaaagaggaggactaggggatcctatttaaagccttggattgaagagatcggactcctccagcaagaaatcgatccgggaaatcaaaaactcggttttggagataaactcgaaaacgagttcgattcggataagatactcaaagattagctccgatttttgggggtaaagatataggaggataagaggaatatttcccctcaactaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaaggggggagctcggctgggccgacttgggttgcacggccgtgcacacaaaagagggagatgggctggaaagggcccaagactaggaagaggattattattacttttccaattaaattaatcaatgaaatgatctttgaattgttaaaaatacttcctatgctcaaataattccaagaaaatcttgaacatacttggacacccaaagtttttaacaatattaaaaccagaccatttaatgattaatttaatatgtgggtaattactgaaatgctctttgtaagattaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacatggtgtgaacctattcctttgttatggccaatttgcattgattaccctatgtcttgattacctcgggttataatttgactagctggatttatatattggttcagctagatgtattagatattgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcaccctcctctttccaaactggacttttcttctctttatggacggagattggtatggttgctgtccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgccacaaccgcatatccacttcatgcgccgtaagcgggcgaatgggattagtggaagcgtgggcacgggaaacgagggagcgagatagcgagatatgagggagcgaggtagtgggcgcgagaaacgaggagccaggcccagcgatggcaagggtataaaagcatcgagaaaaggatttgcttccttcctttcgccattgttcctcttgccttcaccgcctgagctctaactctttctctgctacgccctactttcgccacacgcgctcgttctcaatcatctcttcctccaccgccatggcacggggctctgctctgctcgacggcagtgtactaccgccttcccgcatcgtgaacgagaggcacgccggactgccgcgccgcttcatgcctgagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggtcggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgtcggtagatctgggggaggactacgacgccgtcctcgaccgcctggcgggcctgcgatcccaggggctcaccggggccatggtgtacggcgattacctccgccgccggattgcgccgctccaacggcgcgcccggagcgcctgggagtacactgggcctgaagactacatgcggacccaccagggagccagatgggactgggctcccgaggacttcaagatcgtagttcaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaaccatctgccccaggagggggtcgtgcttctgggccccgcgtcgggggctcggggagcagccgccctgccgacgcccaggggaagaggaagctgggaggaacacctcccacatctcctccccgagggggcggggcggcgcgtgccagcagtcggcgcccggaggggggcgcgccgacgtcgcagcccgagggggagcgcaagaagaagcggctccgcaagatgggggagacggaaccatcccggggaaacctgatttcccctccaaagtggtcatttaaccgaccccctcgcaggttcgccccattcttattgcgaccgtctttcttctatcccattaagcaagttttctcttacccatcttgtttgtcttctggttttttattctgcttcagcgatgccccgtcacattcctcccgccaccccaagtccggccagtccgaggccgaagatccggcggccgcagaggagcggaggcgagaagctgaccggcgtgaagccgcagatcgccttcgggaagctgaagaggccgcccgggaggccgcccgggctcgccaagccgaagaagctgctcgggaggaggccgcccgggctcgccaagccgaagaagctgcccgggaggaggccgcccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcaaacaccgcagtgctggatgggttcaacgcccaagtggaggccctgcgtgcggaacgagcggagctcgaggccgcatgggcgcgcgttgaggaggggcggcgctcggtggacgccatggtgaggtgggccgtaaggctcaccgccgtcacatctcggagcttgaagcccgcaaggcggcgctggcggaggtcgcccgagaggtggaggaggagcgagaggccgcccttatcgccaccaccgcgatgatcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcaaggaggcccttgagtcccgtgccatggcgctggaagaacacgccggcaccgtggagaggggcttgacggaccgcgaggccgccgctgctctccgggaggcgacgctggcggcgcacgaggccgcctgcgccgaggaggagtgcgcgctccgcctccgcgaggacgcactcgctggaagcggggaagccagcccctcgaggaaggccttggaaggccccaaccaaccggtggggggaacaacccggccctttcgggaaggcgggcggcaggaaggaaccaggccccccggcaatctggaaaggccgtcccgccccgaaagagagccgcacggaagcagcgggctgctgacctcgaggcgcgggaaaaggagctggacgcgagggcgcctatcggcggggcggcccgcgggcgaaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccacatgaagcgcgccggtcggcaagcgggcctctggagaggccagacgtcggtgccccccaccaatctggaaggcctcgctccgcacctcaccaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgaggacgacgcgcgcgcgcgcgtccgggatgccgccgaccacatcgtcaacggcttcgagggctcggcccctcggctcgcgttcgcccctagctccgacgaggagggcgatgccagcggtgaggacgacggtggcgacgaggccggcgacccgggcgcgtcggaatgagcccccgagcccccgtcaatcttcacttttttctttttctttcttctaaggccttcgtgctcttttgtatagatcaacttaatctgcaatcaaaaatgatgaaaaatttctatgttaactttattttgctatacttatgagttgaggatgatttgtgccgtggtccttttgcattttagcttgatttaagagctcgtgctcaagtcccaatcctcagatggctcgggtcggggctagtgcctggggagatccacatgccgagactggccaggccgggaacatggtgaccgagggttatgggtgacccgattgtgggtttttgccgattcccccccggagttcaccatgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaacttcttttattgaaatgctgaaataagaaaagtaagactgtgcatgtgtggtagcccccggccaaccctgcacacccgaggggggtgcggggttggcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccatattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaac

SEQ ID NO: 11452 - DNA, 5216 bp, Oryza sativa
ggggttggcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccatattggtgagagcttgctcaatccagcacgcgtttggacgcggcgtaagacgaggtcgtcgacgcagagtgatcgggcccggacgtggcgctgatggtagcgccgcaggctctgctggtagcgcgcagctcggagggccgcgcgccgccttcgctcttcaaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgtgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataggcctcgggccacttagtgaacttgtcgatcgcaacatacagatactcaaacccgcccagggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgtgaggcggaatgcgctccgcactcgccctcatggatgtcagcaagaagctcaacgccttgttcctgaggaatgcacttcaggaggatcccgttagccgcgcgccgatagagggtcccttctaccagcacgtagcgtttggaaatgcgttgtacgcgttcactcccttggcggtcctcaggtagagtcttatctgtgaggtatgtttggatctcagagatccaagcaatcaatctaagggagtttggagcactcccttcgagtcccgaggcctggactccgacggccctcgggggccggtcaggcgcatccgtctcccctaagggattgggtcgcgccgacggctgggtaagcctttcttcaaaggcgcccggtggggtctgggctcgcgaggacgcgagccgtgagagttcgtcggctatcatgttatcccgcctgggcacatgccgaagctctattccatcgaaatggcgctccatacgccgcacttggcgtacgtaggcgttcatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtttgaggcagctgtgagaggttcgtgctggcctcgggcattgagacagtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggtctcactaataaagtagacaggcctctgcacctttcggcggggccgatcctcttcgctaggggccgtatccccggggtgctcttcgtccaagtggcctctcggggcacactcgtctcctgcgctgatgacctcggggtccgaagatgacaggtgcggccttcccacagtggcctcggggccgtcccgggggtcgggggctcctggcgttgtcagacaagcgggcaaagggccagctccggtcgtcaggggcctcaggcctccgttcggctcgggggcctcttctccctgctctctcccgggtcgaatcagcacagggttagcctcggggtcaaagggtggtagatgcggccttcccgcagtggcctcggggccttcctgagggtcgggggcaccccggcaccgtctgacaagcgggcagagggccgactccggtcgtcgggggccttaggccaccgttcgactcgggggcctctcctccctgcctgctcccgggccaagtcagcacagagtgggggtgcgcagaatgaggattgtcctcatcgcgctccacaaccaacgctgcactaactacttggggggtcgccgctaagtaaagtagcaggggctcatttggctccggggcgactagaaccgggggagagctgagatatacctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaaaaacccgagaagcttgcccgcaggtacaccaaacacgcacttatcggggttcagttttatgcgggcagagcggaggttttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagaatatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaagaaggagacgagcgcgtcttcctatttgtcatccagaagaccaccgatccgtgtggtcttggatgggccgtcgcccaaggcaacctccttgaccgggacctcgtcgcatgtggcaatccgctgcctcggggcggtgggggcagaggggccaagcctctcgtcaccaccctcgggcttggacgcagcagcgaggcggtcggcgcgctgctccatgcaagcaagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataattggctgggacggtcggagcaccatccccggggccttgatagcatcaaaggccgcgggggaaaggatgttgagagccgctcctccatctatgaggacacgtcccaacttcacgttgcagatggtgggggaaactaccatcgcaacctgccctccccgggcaatgcacggtgggtggtcggtctggtcgaaagtgagagcaacctctgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggccatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttgtggacggagcaccacttgctgactgggcgctcccggctgggagtaccagcctctttctttttgtcgctcgcaggcctcccctttcgggtggcccgcggagcgctctcgacggcgaggacgtgcccctcgtcgccggaatgggccgaccttttcttcctcctcctgtcacgccgccctgtctgagcggcggatccgggggcggccgaagctgccacaccggaaccggaggggttccaggtccaggcctcctccttacgagccactcggtctgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcg

SEQ ID NO: 11453 - DNA, 8491 bp, Oryza sativa
ccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgtcctccgttgcgcggggagtacgccggctattacgccggcgctcgatgttgaggcgggcatccggctccccatgctgatcctcccgagtcgaaggtgtcgacgagggagtggcagccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcggcgctccccatcttgccgtcctcctgcaccacctgcaactggtgatgccacggatttgtcgaccttctcaagcgcctccccctgcttagggctttggcgcagaggaggtgggggagtacgagctcgacggcgtggattcggctccccgtcgtcgccgctcacactcggagagaggtcgtgcgcttctccttgctcggccattaggctgaacaagaaaaacttggcgcccacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcaccctcctctttccaaactggacttttcttctctttatggacggagattggtatggttgctgtccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggatgaagcctggtataaatctaaccagggctaacgtgccatctctaaaagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatataattgcttagctatgcttagaaacattagcacacgattgggataactaatgttttactattacttattgatggatatttaattgtagctcacgatggtcaatcgtgattgattaattaatttgccaactaaaacttgataatggtgggttgtgagcatatggttttgatggtcgtgctcatgacaattaaggaccggttcacgagtttcggttgtgaaacattaaccgtgctaaccacaagccagcatgggcaacggctttaccttttgtatagcatagttcattgcagggtaccagactgagaagtggcggagataagcccacgggggtcgctggggagtccatgccttgtttataagggattgattatgatctaggaacggtgcgctgtggtggattgtgttatgcgaggggtactgtcacagctcctttccgaggtaccgtggtggtattgaggcgcatggtgacatgtcgtggggctgtgtcttgtgggtacagtggtacacttctggccagagtaaaactattcgaatagccgtgcacgtggtcatgggcgggtctaacaatgtctttcgtgattagtcccacgctactcattaataataatgtggtaattgatggtaattaatttagctcctggtttggaatgctatattcctggtttggagatagatctgtacagccgggtatggttgtccaggatggttgggcctgtgcagcatgggtgtgttgttcagtgttgattaatattgatgattaattactctactgttttacgattctcaaatatttgctaaatactgcttttacaaatgaaccctatattataccattctttggtatccttgtgcacttgcatatttgctatgtggcttgcggagtattccatgtactcaccttgcaataatcaatcaaacctcagttgaagacaagttgcgaaggagaagacgtttggcttataccccagttgagctgcctgtgggagtggagccggagcttcgctagaccataattctgctgctattttctcttttcttttgtaagtatttacgttattagtatgatgaatctgtatattaaattgtcagtttgtgtacctcggctgattcctgaacgaggatttaatgcacaaataagttcagaaattactagtgaattaccagccggataggctaaatctaccgcaggggtgtggtggcaggggatgctggtagcggcgagcgtcagcctcgtggacatcgagcaacctctgagtttcgatggcgcggggacgacgtgcgttgtggtgggcgtcaacgcagccgaggaggctcaacaggacttgggccaaacctctgtagctttgcccatgccgccatccccaccctctcccctcctcaactgctcccctctccggtgtcatcatcgaggctgagactggtggtggtgccggtggctagatccgaagccttcgcatggcttggtccggcgcctcagattcgatgctgccatggctggtcagggaggaagaagagagctcacatcaagggcacataagggatgagtaggagaggacatatcacgggcaatgccagcagtagcaggaggatatgatggatatgcgatgcgggtgaggaggtgattgaggggagcactctcgcccctgcccctcaatggcgtgagctgcacatcaatcgcagggagagaaagagcgcgtggatagtgcaacggataccgcgggcgcggggcgtggatggcgcgcgacagcggtggcgatgaaggcgcgcgctagcgcggtggggatggggatggggatggggagggttccgaattggtgattccagctgcccacttttatctctttcacccgttagatttgatttcaccggttggattgcaagcggtgaactcatcctttttatattagtatagatatttgtttactatttggactgaggctaaggccgtgtttagttctcaaaataaaaacttttcacccatcacatcgaatgtttggacatatgaatagagtattaaatgtggggaaaagaacaattacacagtttgcgtgtaaattgtgagacgaatcttttaagcctaattgcgccatgatttgacaacgtgatgctatagtaaacatttgctaatgacagattaattaggctaataaattcgtctcgtagttttctaacggaacatgcaatttgttttgttattaaactacatttaatacttcaaatgtgtgtctgtatatccaatgtgacaaccaatcctaaattttttcccccactaaatctacctaattcaataggacttcaaaccgaaacagccatcgttagctctcagttcgtcaagtagtcgtgactatgagtcaattctataaagattatagttttcggtgaagtacggatgtgactatgaagatcatttgctacagtaaacgcagcgctctttgccacgctaccaggctactgttccactgttcatcttatttctagccgtccgatcagtcctttcgaggcgtgctggccatccgtagcattaggatagcttttctcctcatccatcgggggaaaagtgttggaatgtaaatcatgtctcctctatcaccggctccctttccttctcccgatcatggtttccggtcatgtttccataaatcggtagagtgagtatggaagatagaggcctatgcatgtaatgctccatgatcaatacaccatcgcgttgagtcattctgtctatcaaaaagaaaacgcggtcttctgcttccctgcgtccgccgcccgacgccctcctgttaacttcgtcggcggctacccctgtcgctgccttcatgtgtgctttcatctccttctcgatctcttgcgtctactgccagtctgccgcgcagccatgtatttctctgccatccttgccatcctcacctgctgccgtgccagaccggcatgtacccgttcgctatggttggcgacggtctccggccaccggccatatctgtccaccgtatacggcctccatttaagctgaatcggagtcgtatcgcgcgcaattgctatcctcctccgtcaccttgcctgtttcctcccaaagacccaaaccccgtcgattcgtgccttgctactgtttctaagtcctgtgttgttcttgctgttccactgtccctgaaggtactccctccttatttatgacgccgttgacttttcgatcaatgtttgaccattcgttttatttaaaaattttatgtaaatatgaaaatatttatgtcatgtttaaaaaacatttgatgacgaatcaagttataataaaataaatgataattacataaattttttgaataaattttttgaataagatgaatggtcaaacgttggataaaaagtcaacggcgtcatgcattaaaatatggaggtagtatttgtttgctgtcttaattaaaatacttgatatgagtgaacataaatgtgttgtatatataggctaagcgcattgccattgcaatgatggtattccgtaaatatttgaggaggtagcagctacttcgcccggcgaaaaaaaatagcagcagctttttttggagggccgccttgattagccttatgtacctaatttctgaatttaggggtgcttttatagttattgatatgagatctgtgaacatagaggttgttcattttgatgttagtttcaaccataccattttttttcaaagttacctaaaaatggctatgtttagtttgttgccaaatttgatcaatacataagaaataataccaaaattttggcaatattgccatcttgccaaaattttgacattgccaaaacttggtaatgtttattttggctacaatttgaacaagcccataattataaatgtggtggacttgggttaaaaaaagcttttatactaacttaaggtattaatccaaaaatcgccactcaaagctaacagttagaggcactgaactgactctgtatcaacattttgctttccagtttaatctaacgtttgcatctttccttttgttttccttcaaaatttttggctttcattgatcataattttcactcatggaaaaagaacaaaaaaaaattgtgatgtgctggtatcagtggcatttgatagccgtttattttggataaaaggaaagatcatgcatccttctctattatcatgtacttccttttgtttcacaatataggtcattctaacattttctatattcatgttaatattaaatgtaacatcaatataaatatggaaaatgctagaatgacctgcattgtgaaacgctgtttttcaccgtgattgagaagtcctatattcattttggatattcacgggatggtatcaaatcatgtttcccacatatgcattgtaatttttcttaatgcagtacccgttagacatgtacagtgatcttctgttgttattctttagtagattttatcgaaagcagggaactttctctaggaaaatccattacccactccccagtggagagagatttgatgccctgatgtatgctgcactctttctccaatgggttttttaattttcatggttggttctgatttactgcttgctatgctcatcgtcccttttctcctttgtttcacagctttacgcaatatatatttttaggttcttttatgtttattttgcctaaacttatgccttttgggtaccttttctctaaatagcatcgaattcaaccaaatgttcgatgctatttacgccaagtttagttccaaaatttttcttcaaacttttaaactttgctatcacatcaaaacttttctgcacacataaacttccaacttttccgtcatatcattccaatttcaaccaaactaccaattttggtgtgaaaaacacacccttagtatatactacactacatggacagttgtcctacattcgatcaccggtacggtgttgttttttctttttggttatatatgcatcagggaactaattagccattttgtccagatcaatcttcatttccacattttataaatattgcgtgcatgcttaccattatagtactcttcacgatgttcccgcggggtacagcctagtaaataggatgactgaaataaggttcgagtaaatgagacatgttaggttagctatacgtatagatttggaaagaggtaaccaaaaccaaattcaaaattttcaaatccctcaaatttgtaggcccccaaacctgctgcctactgcctaggtttccaatttgaaaggaaaaagtacacgaaaggtcccttaacttatcatcgagttacaaaatcgtcccccaaccacaaaaccagatatataaaatccctcaacttacaaaaaccgttcactttaggttctccggtggttttgaccctggtttagtccgacgtagcggctgagtcaacgtgatacccacgtgagccctacatgtcaggatgccactttcccctcctttcccttcctcctcctctccccctctcacttttctcctctgggcagggcggccggcaggtgaggaggaggtcaccgggacgaggcgagagaggaggtccgactgccggcgatgcggtgatggcgcccgccggtacaaatcccacctctgcggcgccatgtcctcctcccgcgggccgtcgtctcctctgtcccacccgaaccctatcgatcccttcgccgcggtagcggcggcgacagcggaggcgccaccgctccgaaaccctatcatcccccatgaccctccctcgccggagatggaggccaccgcggaggcgctcacctgggaggggtgctgtgttggcggaggtgccgcgccaagcatctcgttgatgtgtactggcggttctattggacgctcgggtggagctgcgggcgtggcatgggcgaagcctgctcgaggcagagcagctgccgctgctgccctccgcgtccaaggtggtcaggccggtgtccgcgatggtgccgaggcggaagaaatgcagcttcggcgggtgcaaggtgcggaccatggctatggccaggttctgccactcccacatcctctccgatgaccatggtgatggcatgtcccttccgccgcgctcttgacagacggtgtgggtgatgatgtggcatcctgacatgtgggtcccacgctgacttagccgccacatcggataaaaccggggtcaaaacaaccgaaagacctaaagttaacgatattataagttgaaggatgtcatgtatcaggttttgcggttgggggacgattttgtaactcgatgaaaagttgagggacattcggtatactttttccaatttgaaattgctttcttccaaggccacaaaaaacaagtaataagttcaccggaggtccctcaacttaacagcgagattttttgaggtccctcaaccacaaaaccagaaattttcgcccctaaactcattcaaaccgttcacaggaggtcccttggcagtataggtgggt

SEQ ID NO: 11454 - DNA, 1617 bp, Oryza sativa
  unsure (1)..(1617): unsure at all n locations
nnnnnnnnnnnnnnnnnnnnnnnnnnnnnnnnnnnnnnnnnnnnnnnnnnnnnnnnnnnnnnncccggtgaacttagtctcaaaaaacaatcgtaattagcaggccgccagcccagcccacctacttctcctacacggcccaactgccacgtcagctaaccacctcattcaatccactccactccacggagccaacccgagctcgcgagatggaagctcacctccggccgctctccgccgcggcgctcctcctttcccccgctgcgccgcttcccaccgccgttgctgcttctgcgaggagagcatcccccggtggcaggaggtggagcagcgtgagggccagcgcgggcggcgggggctggctgtcgggcctgctcggaggcaagggcggcggcggcgcgccgacggcgatgacggtgacgccggggaccgtgaaggcgggggaccccgtcctgcacgagccggctcaggacgttgcccccggggacatcccctcggagaaggtccagggcgtcatcgaccggatggtcgccgtcatgcgcaaggcccccggcgtcggcctcgccgccccgcagatcggcgtccccttgaaggtaacccgcaaccgaggacacgattcgtgcgatcgctcctgcattattccattgcattaattgctccaaattactccactaagtcgtctactgttcaactgtttaattacctgcttatgtttgttcctgattgacacatggctgaattgctcgacctgttaaaatttcatagattatcgtcctggaggatacccaagaatacatcagctatgctcccaagaaggacattgaagcgcaggatcgccgtcctttcgatcttcttgtgagtagtagtacatttgtcctatgtagttgccttcaccaacaattatcattaggcaatattgccgccttctcatgccgttttattttccttgtgtcccttggataccaggttatcatcaatcctaagcttaagacgacgagtaaaagaactgcattgttcttcgaggggtgtttgaggtactcgctagaatgcttctttgtgatgttattactagtttctcattatgcattgtactggattacattgtgcttgttctcatgtgtcttctggggatggcagtgtagatggatacagggcacttgtcgagcgacacctggatgttgaggtttcaggtttggacaggaatggacgccccatcaaggtagaagcttcaggatggcaggcacgtatcctgcagcacgaatgtgatcatcttgaaggtacattgtatgttgacacgatggtccctaggacattcagaattgttgataacttggatcttccgcttcctgttggatgccctccaataggtgcacgctgaggtggagagcattccacattttaaaatttccaagtagagataattgcactctatagtatacataaaatttatcccaagtataatatttgcattgctgcttatttctgtgattgccaattttccatgaattgatttttcaatgtctgttgtggtcatacacatgcggagaatcactgccttgtatgttgaattgacatcatgtggtaacattcgttgttggttgtaagatgttcgctcaa

SEQ ID NO: 11455 - DNA, 3056 bp, Oryza sativa
ttcgtacaacttgaattttctttcatctgttttgagatttgaagctagttgagattcttccaagtttatgtaaactaatgtggttggttaaattatacaaattgcttttggtggaatggttgtgtctctgtctctcaaagcagcatgtgttgttttcctaaactagagtagcaaaaggaaacatatccatgatgggtgtaacatgattatgttgtctgatcatgtctcagaaccagtttgtttatgcagtatattatgatataatattccttctaacatattaaattcaatacctttctgtattaattttaggatagcttgatgggtggtggaaggtaagccatatataatttaaacccttttgaaaatgcaagttcgcaaagagccttgaacgcaaggaagtgaacattatgtacaaagatagaataagaaaaatgagcactaatagaagttcacaagaataaatgaacagtttgtcattatgatgtatcatttaatatgtaagtatttctccaagtgtcttaaaataatattttaaaacacccttacaatcagttgtctggataatggagtgcatctgttacttcctactgtaggaaggaattatgagacaaaaagctaacaagtatgtacttataagataaattgaacctgaaggaaacagagttcatcagttacgacagaataatgaggaacttcacacatggaccttataacttgagcatcagcatttaacaatcatgacaagtacaaagtgagtcatggtgcagatggaggacataaatgttgcaatcaagtggccacacatgacacattagaaatcaacttaatccttcgaaaccaaaatgttacatcttcgtagtcccaagtatattgtagtctacttaaagccccaagctctgaagaatggaatgcttgactttaaaggcatgcatacatttggaacagtgttttgaagataccaattttctgattctgggagatgaaggttcacttgtttcagaggcaccaaattgtagaccactgtaaagaaaaataaaacaggagaattttcagatggtatgacaatcatatactgtaggcatagacatagccatgaaattaacacataaatcatgtttgaatcagtgttcatgccctcaatattcgttcaatttcgaaacaggcaactcccaaagcattcacctactgcaactgtgcaaaaccaaaggattgagttttatacgaagtagcagttgagattttctttgttacacataccttcaaacaatgaaaactacaataatgtgagaattagatataactacgaaacttttaacatgttaaataactaatctacaggagtgttatgatttcagtctacctaccatcacagcaagccacaagaaagagatgcctttattttttaatatttgcctcttttatgtattttgtcctatgatataggggctacgggttcaataatttgttctcattgttcattggtctatatactacagtcctatcattgagctttgtaaaagataggctggactacatgaaattgagtgctacagcctactggtatgaaactgttgccaagtgtcttaacattatctccaatcctgttgattaagagaactcctgtgggtaacaaaagcaatcatcacatccaggcttgttacaaacttagacaaagtttccagtccattacctgggctgaaggagcttgtcatggaaaatggaacatttgtcagaactctcacataggctggtcctactgacatccaaaatatagaacctgagctgcacagtgaggtggtcgagtacttgagaacttccttttggtcataaagattggtcattgggatccttcaaatcctgggcctgaattggccacacaactagcccctattggcacctaggctttgttgtcccaattcaattacaagggggcacccccaaattgggcccccccccgggggcccccaaacccaaaaaccaaaagggggctgaaaccctggcacccatggtctgcggttctccatatgtttattctccctttttaaagtagaggaaattgtcctttgcctcacccgctcattgcagagaatccaaactcataatccatcagtttagttaattggtgttggactatagactatagagattctggttgcttgtgccattctccaactctgctatatagatggctttaggaagacccatactgattcagaactaatcatctttgggagaggagagatactagctacacattcagattcagagctaacatccgcagtcaccattgcttcattggaggagagatcattgggtagcaatggcagcccaccatggtagcagcaggaagacaaaggcagagcagtggctattcggtggaagatggaggagaactgtgaaggagacaaagcatcctgttgcctctgaagccaagcctccagctccaacatttcctacagccattcagaaggatggcgacatctgccttgagaagtccagagttcatcttcctggcctgggacagagggagatcatcgatatcgcgcccgggaggaagtcaatgccggaggtggagatcaacatgaaggaggtcagggagatcatcgatatcgtgcccgggaggaagtcgatgccggaggtggagatcaacatgaaggaggtcgtctctgtgcttggtgtgaaggtgatggctgcagacatgtcgccatttatgcagctgcatgctttccggtgtgctaagcggtcccatgatagcttggacaagttcagctcaaggcagctggcccatgatgtgaagaaggtgagcttatttttttttctttcaatttgtgatctttcgcttgtttgtttacttttgttttgtattctgaaagggattgcactgattccgttcattgtatacgctccttccctttgtcttttggacgggttctttgtgaaatcaaattttagaaacttatcatttatgttgtcaattatgagatgcacttctagcatcttctgtatcatgcaatgcacatagccttaatgctgaaacacgtagtaaaatcatt

SEQ ID NO: 11456 - DNA, 907 bp, Oryza sativa
  unsure (1)..(907): unsure at all n locations
atgacatatctcttgtctcaatggtcaatacacttccatcatgagaaaaaaaaagggtaattaattagtctagctctgtgagagtgaagaaacaggggaagaaaaccacctcaaataattgttttgtccgtgagttgcaagttgcagctgaacaagtactgtggttggatggtgctgatgaatactaagcaccaataggaaagcaggttgtatatgtaaattaattaattaccacttggaaagtgatgtgatgatgaactgttgtttgggtgtagtagttgttgttctccttggggacagctctgacagaggctatacaacaatcgctgtcaggatcacgttgtgagattcctgattagtagagataatcacgggctaatacggttgatcaaataccacctctcgctgtgatgatgaggtagctggttgacaattgtgtctagctcttgtagtagtggagtaaacaatacctggatggatgatggatctcgtcatcaccaccgctcactgtttccaggttctagtccaagctccatggttagtccaagctctgggtttacaagccaagaagacttgttctaccacgtgatggccatcagctcctctggctgtgcaaccatggatgcatatgatgcccggattggttgagtgataagctgtaaaaatataaagaaaccaattaaaaatatttatagctaaaattctattttacccaccattccaaaatgatcatcagattacacaggtataccaaggccctatgtagttcacaccaaacttctccccaactcctaactttccatcacatcatatcacatccaaaactttcctacatacataaactnnnnnnnnnnnnnnnnnnnnnnnnnnnnnnnnnnnnnnnnnnnnnnnnnnnnnnnnnnnnnnn

SEQ ID NO: 11457 - DNA, 3844 bp, Oryza sativa
ttaaacttgtcaggaggtttcacctaggtccacgaacttgcaaagcgcacatcgagatccctaaacttggtttattgtatcatcccggtccaaaaccgcgtttgaccgtggtcttacctacgtggcataccacgtggatgatgacatggaattttttaatatttttttctcccttcttctttttcctcccttccttttctttctctcctctcccgtgcctccgccagtcgacgcgggagcgggggcgaagaggggggcatcggcgagctcggcgtgagcggggcggacacgagctcggtgtgagcggcagggtggcagggcgagctcgacttgagcagcgatgactgggggaggaggacgacagcgctgcgtgcgtgcggggggaggggtgtcaccggccgcggcccgggggaggtgtcgccgaccgcggttgcgcgtgaggggggaggcgtcggcgagcaagacgcgagcggggcgggcgcgagctcgacgacggcagcggggcggcagggcgagctcgagctcggcagcacgagcttgatggcgtcagcggccatatctagctccgtgtggcggaggacgactagctcgagctctctcccccctccatcggctagctcacccccaactatcccaaacttccaactttctatcacatcatatcacatccaaaattttcctatatacataaactttcaactttttttccaaacctccaactttccccaaacttccaacttttttttaagaaataaacacacagccctactctttggccggcccggcaaaaaactgagcagcagccgccatgaactccccaccctcatttctcattactgcaagagaaattatttattttttagaccttttaatttttagattttaaaaatagtccttttcaaaaataaatttttttggccacgccagtcgaatgggccaacgtcgactgttgataggaattccttcaaccctatctcaaaaccaaccttgtccttgtcgtcaaatgtctcctgataaagctattaaaagctaatttgttagtctgctgtactagtagcagtgacaatcattcgaagtactgattttgtatatctatggcgtgccacacaaatactgcggacaaaattttttgtcatcggattcttttaggctcgtgctgattttaacgagagattgggaatttaaagagatgggattgctaacttctttgtttgatatgtgtttgggagagcacagaaaatgtggtggtttattaatgtataattaattaattaattaatagctaaaaataacttgaaaaatgaattaatatatttttaaaacaactttcgtatagaaattttttgtaaaaaaacacaccatttagtagataaaaagtgtgtacgcgaaaagcgagaggaagaactcagagttttagttggatggggatcaaaaattaagggataaactattgcttttaatacagttaaggggtaaaagttgaggtatttcctctttgcattgtctaatcaaatatcaacctatcgatgatatgggcctaggggtctcaagactagagggaggaggctgcccccaataccacgtggccctcccccgaggggagtcaggcccgaggtgaggcggaggccactccctcatgtgactaggggtcgggctcccccgacccccttagcgggtcaccacgtgcggtaggttaggtggccaccttcgagcgctcacctacccgcattaatggtgacttgagcaggcgcgccacgccgcattttatatggcgtgtaccgcgcgctaaattggtctgtgactggtcaaatgaccgacgggactcgaggtgttaggcgtactactgcatgggtcagggggcgtgcaccttgtcttgtcccatcggtcatgatgacgagaggtcttaacctctcatcccggccagagttggtccatccgccctggtcaattggggattccgttttccggtgcaaacagtgacccagaagtctccacccattaatagcagctgacatgggagcccctcgtgtcaggcggcaagatttgacaggccctatcatcaagatgacgtgcgcttgctttccaagtcaagagacaagacagacacttaatgcaaaacacttctccaccggagctaggtttttgggcccatgtggtaaccccttgaggtataaaagaaggttcaggcctagtaaaaagggggatggatctgggacgatccatttgacgctctagagcagtctctagccccggatgatcaacaccacattttactccaacaagaagatcttgtaatccttcactcaaggagcatagaacaggagtagggtattacgcttcttagcggcccgaacctgtataaacccttttggtctcatcgtctttgaggggcttgaccccctcaagatcacactgctttgctcaccgaatccttgaatctcacccgctgcccccggtcgaactcacaaaggagggcctcacggcctcccgctatagaaggtcactcctcgacacaaccctttatcttaatataaaatcttatcacaatataaactcccacagcttctaccaaacaatggattgataaaaagaaaatcatgatatcctcactactaattccctacctaaactcctaatgctctctcctaaaatttccaaaacatgctatggtattaaaaacaagagtttgaacgggaaccattggcaggtgtggtgaagttacatgagtatactcatagaatttaaatcttggtacccacaaataagttgcacaccagaccgagatggcacatgcggaattggcatgatcctttgagattgttatggatcctcgattttttcagcatgtcgttccatcgatttataaagtggtgctttgaagacggaacttatggcttgtgttgagggaatctatcatgccatgcaatgggcaatggacgatgcttcctatagttgtggaaacatattgtagtgggatgatcaatatgcggttttctaaggagttagaccgaccaatgccttttttttaaaagaggttgagttccttatggtcggaaataaaaaatttgtattaaaaaaggttcaagctagcaaattatgttagttgtgaagcaagctcaaagtttttgtgggtaactcttgtaaactcatctcacatgttgtgagggaggatttatcttccgattaataaatttcccgtttcaaaaaaaaattatggtataagttgcataaaatctcataaccccaggtattatgacacaaaatttcgcaaaacaacaactatttatcatttgagtttgatctgcgaaactcacaatcatatctcaaatttatgagttatttatccatcatataaatgttacatctatgtaagattttaatagagcatgtcaatttggttaacggcataactgctaagctttaagactataatacatatgattatgtgccacatcaaaatctaagtggttttgtgtaagttgaatcataatagactatgttttataaaatttactctcaatataaatttagtaaatcgcacttctgaatatatgaatgcggtgggtatgtcttgtgtaatcggataaaaaaatttcctaatctgtttggcacagctccagcttcagctcctctcctcctggagctggagctcagccaaacagttttagctctaccaaaaatgggagcggagctgagtggagctctatcacaaaataaactagagttatgaagctggatttagacagcttcacaactccactccagacctaactcttaaagctaaatctagcagttggaactgtaacaaacaggctgtaacggcaccgtaataaacccaacgtcc

SEQ ID NO: 11458 - DNA, 915 bp, Oryza sativa
aagcatctcgcgccctagccaagccagccatggcgccgtcgtcgaggaaagagagggcggcggaggcgagggcgagcacctccaagccgtctcctgcgccggccccggcgccggcggtccaggtgcagcggcggccggtgggcgggggccggtggacgagccgccggatatcgttctacgcctcccgcgccttcttcctcctcatcatcctccagatcccgctcttcaggtcgcccccttctcccctcccccaatcccctctgatttacctctgtttccgtgtcgatcgtgcgctgaatcttagctaactcaagaacgcctgattaatctcgtggacgctggtgctgcttggcgacttggggcgtgattaccagatcaagaacggctgggacgcagcacacattcgtgtaggggatgcagggtacgggccttagataggcataattgtggtagaattccatcgaattcctcgattccatgcaaagcctactgccctaaatgttgtgttgatggggaaaggtaggcggtgtactcacatctcgtcagttacccttgttggacaagaagctgttaaagcctccatagtttcaagcggttaaaagcagccatagtttctcgatgtgcagggtttcagtcctcgggccgaaaagcatgattcaggttgcaaaatttggtagaaggcgagttcaaattaggcaaaatttgccacaggacactcaaaaaatgtgtaattggctgagagacaccgcaaaaacgtgacacggctaatggacactacaaaaaaaatttgtgtaattagctataggacaccagagacaatattttataatttttggtcaaaagaggtgagcaatttttcgaaatggcgagattgcccttggcgccatcttcctccacctgaaatcacaaaattag

SEQ ID NO: 11459 - DNA, 3595 bp, Oryza sativa
  unsure (1)..(3595): unsure at all n locations
aaacgctctgctgcttgcctgcttctgttgcgcaacagcagttgttgaccagccgccgacgccgacgccgacgaggtcgcgcaggcgccagcgccgcgatgatgaggacgacgactccgccagcggaggcactcttgggaacctgtcgtggatgggcgagccatgggaggaagatggcgccaggggcaatttcgccatttcaaaaaatttctcaccgcttttgacccataaattataaaatattgtctccggtgtcctatagctaattacacaatttttgtagtgtccatcagccgtgtcacgtttttacggtgtctctcagccaattacacattttttgagtgtcctgtagcaatttttttttttgcggggaatcctgtagcaaattttgccttcaaattaatctagttttgtactgacgtgggaaattgtgtctatattctgatagaactcggtaagagtcaggttgtgacttgatgagaccatatcttggttccccttaaaccctggatcggcttgttcttttttgtcctgaatcgaatagtttcttgctacggtttctgtcataaatttaccaatatgagcaaaccatgtagcgctctcaactatggttgcctcaaaatggatcctgtatgcatatcactacttgccagtaggtttgattttagtgcataggtgtgtatggtagtaacagattaatgtggtagttcaacttcttccctgctattgctagattgatgggctacttttttgttgccattcctgactgctcaatgtggttcagttttggactggatctacgtagagggaattctctcctatcttttcatatattacattgtttcataagagtcctataatttcatatcaagattttcccatacctgtacacgtgctagtgcttttatctggactcgccttttcctcctgagcatggattctaggaaattgtatgttactttgcttctgtaaccatgcttgcttattttaccaaattacattttagtttattgcttaaggttgtcatgattgataaggtcgattttggaaactaaaatacttggaagtacttttctgagtaggacgataaatatactaagtagattctgcttaccttcttctgccatttcagggtcccttgtagagcaggcacatgcacaacgcccattcaagttacatcttcgcagttggtctcaaatgagatattcccaccatctgttgtgaaagcccttctcttccctggggctatagcaagcaaccttactaagagcatgacatttcctaggtggaatgacctgtttgatatttacaatttgacagaagccaagaccgcttcagcagtaattgatctccagcgtctagaggtactctttttttttttttaataactggccaactttcttaagcagataattgtgacaattgttacactttactctctttctcacttctcaaccagattcttgctggaagctacttctgtgctgctggagcacttgttggtgtcataaaccctgggaggatgaccttgtttggtacccttttggttatctggggtctagtgaaagaagcgctctttgggaaaccggtgaacagtgatccaacacaatcagttcatgtttatccgaccattttaattgcactgatttgtgcattcttgtcaataacttacaatgtaaagaagacagtaagaaatagtcagtctgtttcaatcactaagcctctgcaaagttctgccaagtcgaaactgaagtagacacttcattgtctatttgccccttcatccttgtagttcatttccacaaatttattgttgaagactggcccaaaggataacactactgtggttcttgtgtaccactttgaatactgtaaccttcagttttcacctttgtatcaaagacttatatctataacttttattgcaagcatattcactttaatttccctcgtatttatttatgtatatgctgtttacactgttaagactactggcatcatgtcacccttcctcttgaaggatgatattttatctttttgtaaattccatctattacttgctataacctatagctctgaagttctcagatacatgggaagttttcccacagtataacttgttcaatattcattttctttgtcagtacaatcttgctttaatcctctgataaatcaagaatttatgattaccattttagtttaactatttaagtttcccagtaactttgttttcacctatattctcacactggcccaatggacgatgtgtccttctattttattctgcatttggaattctacacaagaagtactttctgaactgttagctgatgaatcgaacaaaatggagttgaagaggacaggacacatgtatctgtcagaatttgctctatcatgaagtgatacatcattagcggcagtactgctgtcctagcatttgtatacttgtattgtgtaaagaagggcaagaatcaaggctgcatgtgcaagtggctcgtctcctatctcttgctctctgttgatgtctggttgatgatgagatcagaggaaaggagacaggctgagccccacccaaaccccatgtgagcattgtccttttaacctgtctgtatttttgtacactctgctgcttgcccttctggtgaaaccagacctgaactcttttatctacccgactgcagcctgaagctgattaacaagtctgaagaagcaaacaatgccacggagctactggatttgtcatgtagaaggggctgaagagataagctgattcggtcgaaatgttaggtggtttctcaagtcagctatcatagtcttctagaatgctcttcttgtcagatttctctcttggcaagagataaaaacaggcataggctcctcttcaataattgagatcccttctctctatgttacttcctcctgctgtcataatgattgctatggttagcctgtcaaggttatacatgagcctatttggttcttgtttttactagtataagtggttgcttaagatctaaaactatccttccacctagactacattagcctctgctagcttaatttgtcaagaagccctgcttttgcagttcacattcttcccaagccttcctacagactgctgttcagacttcagttccatggttcagatgtctatacagaggtcagttgttcttctgttacttcttgaaattaattttagcatttactggtgtttagtgtattcagacttcgagagctatggcaaaatgactcaaaaatgtttgcagggctgctaccatttcacctccttgttccttatccttgccatttgattgtgtgagtggtacaagtagaagatttgcctcatgtagatcccagtattcatgctttgcctatagtgaaagactatctccaaatgttttgaagaccaacagtgtcgtcgatccctctgaaccgaagattttggatgcgagttcttctgcttcaagaactggacaatatagtgcaactactcatctatcaggtacaattggagtaatgggaatatctgcctcttcctctctcagattcttacagnnnnnnnnnnnnnnnnnnnnnnnnnnnnnnnnnnnnnnnn

SEQ ID NO: 11460 - DNA, 243 bp, Oryza sativa
ccccaccgagtttctccaggtctatacgacggggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatga

SEQ ID NO: 11461 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnnnttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttctttttccattctgcgtagttatctccttttagggtcggaatatctt

SEQ ID NO: 11462 - DNA, 318 bp, Oryza sativa
ctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaataaaggctacacgagctgcggcccggtagtcgagatgtcatggcacagggctggtgtcctgctgctagggggctcaatcctgcct

SEQ ID NO: 11463 - DNA, 392 bp, Oryza sativa
taaagtccaaaaagaagaattgtatagctctcccaaaagaaatttagaaaaatggcactgaaagaatagatggtgaattgattcatttttcatacaaaagcaacatctcaaactaccattccaattccttctagccaaattatctttagttaaaacaatccctttaaggagataccacataaaaatcttaatcttaagaggcattttaagtttccaaataattttatttctttctatgtaaccattattaattaaagctaagtacatagatcgaacagaaaattggccattttgatgaaaattccatctaaaaatgtcatcctcgtatgttaagttaatatgcacaatggaagcacacaaattatgccatctaattagattctgaccaacta

SEQ ID NO: 11464 - DNA, 3606 bp, Oryza sativa
gtttttctgctcttcattgtccatgtgaatttttttccgtatattcatctaatgacctcttaacttgcacacttagcttcttcaaaatttcaatgtgcgctgatctctcaaaccaaatgttttttttgctatgtttacatatgggtgaagtacagattcctaaccttgagctcggtgatgggaatccaactctattggtacgtgtatcaaggttatgggaatatcatgaccaggacgatgaaggcgacttacgccatattggtcttgttttggttggtgagaaggtgattgctttgcgaactttatctgctgtaaaacctgagcaatatgtcatttgttttactgacagtattgtttcattagggatatgccattgctgctatgatttatcctccatggggcaagaaattcaaaccactgatcagcgaaggcaaggtctacttgcttacctactatcgggtcaagccatgcaccaaacattacaggccagttgacaacaagatgatgatcaatttcaccagatggactggtatagaagaatatgttgacgtacaagctggctttggtcactatgcttatactctcacaccttaccaagagctccgctctcgtgtcgacaggaaagactctttcacaggtactgcagatatggttctataattggttatctattatattactacctctggtttgctcacacatgtgttttgttcttgctctcaaaataacagatgtgattggagtgatcactgacatatcatctgtgacaactgttcggacacgtgttagagacagtgacagtttaaaaaggaatgtctacatgcgcaatgctgagttagcactcatcccttatttactactccatattattaatgcattttctgatgttttctaacccctctcaaataatctgtcatctacatcagacaatcactgtcataacatttttctttcatactgggcatattgccttgccctgacaactgcttttattccaacacaccactgttttgggtttgagactaactacttaccataccacaattcctctttgatttcttttaaacatacacaacatagaaatgagacaacaaatattgtgttatggggagaaagagctacaagctttcctgcagatgaaattctcagtgctggcaaggagaagccacagatagttatctttgttggcacacttgtcaggggacatggatgtaagtcaattagcttccttgcttgcattttgtcctatgttttcagctgttgttctcatagcgtgggacactgttgttatagggaatgtttcgttgtcgggtaactctgcttgcaaatggtacataaatattgatgtgccagaggtcaacaccctcgctgctaggtttattctctacacttcgctatcagacaatgttctcttagcttactttgtcctgattttttgagctaaactgattctttttgtgcagtgttgaagggaattacgaggcaatcaaatggattgatctcccagctgcacctattcttcagaacaactgtgaacagaagacaatcgctgagataagagacccgcacccttttaagttcaaggtgtgaccttgctatagtcacttcatgaacttataatctgcattatgccatgaactgtgttaactgtttccgtctgatgttaatagaaacatgaattctcagtgactgtcgtgataaagaaacttaacatggagtattcttggtggtatactgcatgcgatatatgcaagaagacagcaaagccatatggaaatctatataggtgtggaaacagcacatgccccccaactggctcagcttcacctaggtgagtcgtgataaagcaattgaagcaatacagacaccgatacattacagctaatgctacattacattctgtaggttcaaactcagtgtgatagcaggagatgacacaggagatactacatttattatctttgggcatttagcgcagaggctgattggtcgttcagttgaggcactgatgctggaaaatccaactggcaagggctgcatatccagagagatcactgatctgcttgagaaagaatttgtgtggaatgtgagtttcacagagaacacggtctctagcggcattgttgcttttcaagtgaacagagttgttaagggtgctcagagtcattcccttgctctcttgcaatctccatctggatcccagacatcttctctgatgccttgcatggctctatcgccggttgcatctcaggatacttccattggccagcccatagcagccagcccatcagctgggttcagtgatgctcaacgcactctgagtagcccaccaatcaatacagaaaaggataagaacacaggaaatgaatatgcatccaagagtcctgcacaggatgctggtgataatgaagattgttatgaggtcagtttgttttatgcctgactttgtagcatatatatattgcatatcatatttgctaactctatctactgtcaaataggatgatgaggcagtcagccttacacaagtggcttctgcccctgcaactaagaacagcacctcaaaggcgtacaaaaaaaggtacatcacttcatttctttatccatcagagtaccgggtgcaaacctttctgccaagctaactggaaaccgaaacacacaaaaacaggcctaggccatctcctggaactggtgctgctaagaaactgttcaaagatgatgctgctgatgatactgatggtgccactggtggcaggtataatgatagtggttgtctctgacggtatatgaaagatcttctgcatctctaacatgatgtttcctacatacttgcagtgccatcagcaaggcctgatacatcaagcagaatggctattgttttttgctctgttagccttgatcctgagaagcccagcattactaaaaggcttttcttcacaccgatcaaaaggaatctatggctaatgttattatgataattctagagactgcgttgttgccgtgttgcatgagtgcatgtcaaaccaattaagctagacttactccttttgcaaacagacttttaggtgaacatccattatctatgtggctgggattccacattatcatgattcatcgtgataatgctgaatgctgtcagatggtaacaatctgtagcttttgcaatggcaacataactctgtatggctagattatcatgatcagtcgtaatgatgttggatgctaaacagaatggtggcaaatattatattctcctcgcatgttagcattgccttcgcatagctggtattgactgctattaaactatcgtaacatgtgtgctatttctcacatagaagcgtgcaaaaaacttatcagctccagcgttttagatagacataacaacccaaatcttaaaccacacaattcacatggcaaacaaaattgattcgttctccaaaccgtaaccaacatcacccaacctacacagtatgaaaacaataaacataattatgctcagctgccacctgccctcgaaaagacttggaaaagacaacacaggtagcagcatggcagctattcccctattctttccagacccccatactctaatcctgctctatcact

SEQ ID NO: 11465 - DNA, 666 bp, Oryza sativa
acttgaccacctcgatcttccccttgagcagcgcgaacagcgcgatgatcagctccgtcgcgttcccgcacgtcgcgttcagcagcccgcccactgccccccatgcatacaccatcatcaacacaccacaacagcaagttcaattacttcatatacaatgcttaggctgtgtttggtagctcatttttttcttctccgtgctcatttttttcaaactgaaaaaattttgaaaaaaattgatttaagaaatcgtattaatccatcttttaagtttgttttagttaatatttaattaatcaagagctaatagatccatccgttttgcatgtggacaaatgtagcattaattatttttggtttctctagcaaaatatgagacatttttctctgatcttttataattttaaaaaaaacatttgctacaacgaatagagaaacaagtgccattttttgatgttaagaaagatgattccatccacgaataatatgaagtcttaaattactttcagtttgggactgatcgttgtgacttaccggtgggaccggtgtagagtgcaatctgcctgcaaaatttcagtagcaaaatgcaaaatttcagcattcgaattataaacagaatttttaaaaactggacataaaaattgcttctgtaacgagtagcttact

SEQ ID NO: 11466 - DNA, 751 bp, Oryza sativa
agagagaaacgaaaaagacaaatattgttagagagtaaggtgtgaaccatttttaatagtgtgggggtgtcaaaattaaatgagtcgagaaattgtctaaggggttaagtgctccaagggaaaaagttagaaagagcaaaatggacttttttttcttattaagttataatagccttcttctgatttctctctttttagagccacaactgatcgacagcattgctcaataatacaacaaacgtatactaattgtatctgctaatgatctgcacctagcaagtgcatgtgaaaaattggaaaagttggacagaacaacaagatcaaccagtgatcccctgcctctgtctatcagtatttatatatctagttttgcattattgtgagatcactagtgggcatgagatgagagggcccatgcatatgtacacaaacagaatgcagctgccgtagtagctgaagctcctggaacattccccactagagaggggaaaccccaacttcaattcctcaccaatctcatctcatctcatactagtactacactttatctcccccagttgatgctgctcacttttcttagtttccacgtcgcagtttctcttctctcctctgacccctttgtgaccgtccaacgacaacgcatggaggccgggttagcttagcttaattaagtgctcctacctgctgatctgatctgatcactttcttgtgtgtgcccttatgactgacagatcgatcatatagtctgaat

SEQ ID NO: 11467 - DNA, 1450 bp, Oryza sativa
aagggagccaacaagggagcagatttggaacatattatgcacctcctacttacatagggaaaacacagatgactcatagtgggaaaaccctgaagaaattggcatcaaagaaagattcattgctgaagaaagtagaaaagacagaatgtttgtactactatggtgctctgggggaagaaggaggaaaatctagtcatagaacaagagtctcaggagatggtgacaccggtcgagatgcaatctcaagatgagggaggtgaaatgacaaatgagaagctattaatgcatgaatgttccccaactgatgatgattttgagagatgtcagattcccactgattctgacattgaaagacttagagaggaagaagataatgaagaggacaatttccaagaggtgtctaacaaaaagaagaacagggctaagaaaacagaacttgcagtgacttcaaggatgaatctaagacaaagggagatggctgctaacccaataaccaaaagaactaagatactcacctagaagaagaacttggagcattaagctacaacaactaattaatccatttgctatatttcagttgttagattcgattgagttgaataatattactattgcctctaacttaaacttaggtagtacctctaaagagagaaaataatatagagactctaaaagcaaggaaattgttcaggctagactaggaaagctaaactggaaaaaagagatttaaaagacaaagacacaagaggaggtggtggagtcagagacagaagggtgagatgataacaagcaagaggaagaaaaagaggagataattatatgagaaatattgtaaaattgcatttttagatcagttatgctgatttaatgtatcacaataggagaaaaacaccttggtaggtctccgctgctgacatggttgttgtcagggttatggataccacataactaatagtagttgactaaatctcagcaggacccaccacataccatgtcctatacggaaacaacctgcggatataggaggagttccagataaggaaagacaaccagagttctatatggaaacgacaaagactactcggattgtatccatattggtttccctaattctacttgaacaaggggacacctatgggtataaatacaaggccccctaggaggagaggggagacgacgatacacacccacaatcaacagacacgggtaacatagacgtcacaaagctgtgagccaatacaagccaacatacgccaagacaagacgccggatatcgacttcagggattggcacggctagtcccctacggtgtctccggatactatcaggagagacgaaagcgctatctctgatctcgccgggcacgaactcgaggaggaagactaccctgttgtcgactacgagtcagatcttcagaccgccatgtcgacaacagttagataggctaccc

SEQ ID NO: 11468 - DNA, 959 bp, Oryza sativa
atctgtacagccgggtatggttgttcaggatggtcgggcctgtccagcatgggtctcctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaatttccgggcgtgacagtagcgcccgttccgtcgtggcgcctagcggaaaaactatctcttaaaaaccctagttgcgaaatctgtttctttgcttgttgtctagtgtccgtgccatctcagatctcaaatccccaatctatcgtcgagttcaatcccgaatccaaatccttcccaaatcaaatcgctccgcaaaagtctatttagcctccctcgggttcgatgggccgaatccctctcggcccatctccccctccctcccggctctctctctctctctctccccgctctaccgtgagccgcgccgagccctccctcccgctctcgctgccattcccgccgatgccgcccaaatagtcacgccagccgcgcgcgcgcgcaccgtggtggccgaccggccagtcaccgccgccgtcagcgcctgccgcgcttgccccgcgtctgccgcccatg

SEQ ID NO: 11469 - DNA, 5184 bp, Oryza sativa
atcgccgaccgacgccatcacgtgtgccgaaggggagtcggtgcgcgtttagacgcggaacgggactccggacgcaccctctccttcctcttccccggcccgaggccggagagatcgctcccgtgccgtcggcccatcgtcactgcgccccgtccgcacggtagtgcatctccccgttctccttcctcaatccatctcttccccttagttctcggtagtagcatgtgtagcctccccgtagctagccggcgccgccccgactgctaccgtctctcgccgtgtgctcgccgccgtcgccgcccgagctcggcaacgcctctcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgtcggttgccgccaccgcaatccgccaccgtcaagcatcccccgtcgaatccgagccattggctcgtctcccctcgtcctgtgcaacatcccggtgtgctcgccttcgcctgaattgccatggttcgctccggccctcgccgccgtcgtccgccgtccgttccgaccggcgtcgtcgtctacctcccaccggcccgcgtggcagccacataggcgccacgtcggcgccacctcgggcgtgaccgggtcaagcagaccccggtccggcggtttcctcccggcccctcgcgcgcgcggtccaccgcgagccgtgaggctgcgagtgggccccccgcaccgcgtcctccgcgaaccgcacgcatgcgccgcgcctccctccccaaaccctagcacgccccgcgtgcacctcgctcacggtgagccgagtcgacgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtgtaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagtcgtcccgtttcgcgtgtagtttcggagcccgaagacccgcagtgcgaggattttgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattagcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttggattttacaaaagacttggaaaacccgacacctgggtcggtgcttgcgaactaaatgaatttccaaaatcgcggaccggggaacgtaccgggtgtacggtttcccgttcttgcacttaaggaccatttccttggaatttcatccgaacacatgacaagtacgaccacatgggtggaatgggacacccctggctgagtaactagcttatcgggggagccatgatgctaagagacatgtggattcgccggggtggtgtcggagaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctcgatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatttgcggctgatgggatcagccaggcccgggtggccgtttgaaagctgttggccgggtgccaatcttggtcaattcaaaagactaatacattgcacatactccgaccggacgagacgcactgtctcatccgtgtcgtttgagaagcactcacttagttgtttcagaaaagagttcaaataaaatcaattgcaaaaacaacagcctttctctgaagcctgcattaaacacttatttcccatggctggctgagtactcccgtactcacccttgctctatataaataatcccccccagttgctgaagaagatgaagcggatcctgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttgcgctcgggactagttcggggcgtgacaccatatatgagagacaccattcacctatacttcaaatacaattttctaaactactcatctaatctacgatccgattacaccgttgtgttcataacaattaaatctttacaacaagatctcacattattatattttgatgaaaaatcacaaattacttttatgatatgtctaaattacttttagatttcactaagttacttcttagacatacaaaagtaaattcagaaagctttaaagtaatttacatatattatagaagtaacttataaaaaaaagtaactttaattaatacactttttcattgaacaaattatcatatatttaattatcatatatataagttactttttgatttgattaaaatacttcctataaattcataatgctctgaggtgattacttttattattgtttttagttaatttcataatttgtgctgattaatttaatttctagatagagtcatgtttttatctctacaacggatttacttcaaataacatgccaaagttacattcgttttgttctaagttatttctataatatatgtaaattacttctaggctttactgaatttacttttgtatgtctaagaagtaacttagtgaaatctaaaagtaatttagacatatcataaaagtaatttgtgatttttcatcaaaatataatcatgtgagatcttgttgtaaagattaattgttacgaacacaacggtgtaatcggatcgtgtaatcggattatagatcggataagtaatttaagagaaaatttcataagaagaaaaaaatatgcacaacctaatagcaaaaactacttgcatgcatgtctgtaatgctactagtacttttctcacgtaactgtccgcgtcgctcgttaagtctaaatcgaaatgcctcttgaaatagtttttgcgattgctctatgttcattttttcttatgtgaattattagagctatttcttctacttcaagtgccaagttttatgtttccatattataaggttcataacttggtgattctacggaaatttagttcatccagattggagctaaaatgaattttatatgcaatttacaagttaacctatttttctgttgattagatattcactaaggcattttccttatattttccagattttaaaaacatagggcccactggtcagtgagagatcttttgcagaaaggtccctagagtgtgggggaatcaaccctcactccaaaaacgtgtctatgacatagtttataaagactcccccattttcttttatatttacgtttcagttcttgaccctcctgtcagtgatttagatgtttacatactgagacctacagttgttcgaattctcaaaacaaagtccctgcttttctctacctcgttcattcgatacagaggctgagcagagccatggctgagctcgatctcgagctcaccggcggcaataggtggctcctttggggttgaggtcaaaagatgaaatgaagagcacgctctcgggattccattcctctacttttctcggattgcggtcatcggagtaacgccggcggcgagtccgagcggcggctgtgcacgggctgctactgcatgtgcgcctatagccatgtagtgatcaaatggatgcatgaatgtggcattaggaagtgctatgacgctcaccgaagcttgaccgcggcttgaaaaggtctggacagcggtgacagtggaggagatggctcggcggcgatggatagcgtcggcttcacggcgacggtttgttccggtcttcgggctgccaaggagaggaggggaatggatcaaagatcatctaaggatgcttcatatgcgaggaattgcgccgaagctcacccgagagcgaggaacggacgacgttggccggcggccggacttgaggaagaaagagagaatctccttgtcggcggctcttcagcgcgattaccttggtaggccttctcctggaaccttggcgacgatcatggcgcagcggctcagtcggagatgcactggatcatcgggaacggctaagcgaccgatggcggcgctctggacaccgaggacgccgacgagctcgacgcaatgtgttcgatccatggaaagggaaaataaagaagaggactgagttaattatgatccgtagatacggttgttaggattataatatggcgaagctcactagagaagatttgtaacgaatcaaacacctttggttgagagaaaggattggatgtttttggagatttcgagggagttcttcatggcttttcttagaggaacacgatgagggatagatggagattagaatagcgagttggtttggtaaatgg

SEQ ID NO: 11470 - DNA, 14027 bp, Oryza sativa
  unsure (1)..(14027): unsure at all n locations
gtagatgttacctaaatgaaagatggggtatggggaaaaatgtgagtgaatctctcttgctctttcttcttttgataaataccaagtggattcaatggtgtgtctaacccaggtggtttgctaaagattggatggcatatgggtccaagttgatgtatcctaggtgtacgtgagaggtagagtagtagctagtttaggtatgaaatgatttttattcctctctctcacctttagaaaaatgaaatataaattaaatgagaggtgtgtagatgatgtgttggctgtgagtgtatgacacatgggtcccacaagagcatagtcccacatgtaagagagagatgtgtagaaggagaaacctagaagctctaaattttgagtgttaaaactataccaacatgtagtttatttcctactcctctcttccatttaatttagaattttggggagacaaggttgctacaaggtagacaagaatttgatggttcaatgtgccaagttccaagatttaattactttttgagttaccatggtaatttagtaaataggcctaagatactatgttgactgcagtctaaatactgtttaagcaaattatggctctcatctcatgtggttacattttgaatttaattcagccattgaaccaggtggtagagcacactatgattagcattctgactaagtggtttagctagataagttatgactaaattttggtgaatgttcaaagtatgctaaatgatatgctgttttttccagatttctagatgagttgttggaattatttgagataccatttgatgtgataaattcaaactaaaattactatagactcagaatgttgtgtaatatttatgagaattttggtgctatttattgttgcttaatttagttttaggaatttttgtttagacatgacatgcatatgaaacctattatgagatgcaccaagaatatccaaaaacaaacctaaaataataaaatgcacataccaccaagtatatttatttccatttaggtttttcttattttaaaacatatatttccatttgtttgcttttagttcgaatattttgcttaggttagaatgcaaaaccaaaaggcttaaatttctatttaaaatttaaaccaacttatttgatttggaatttgttaactcaagattttataaaatctaattttggactagctctaatcttgtcccaacaaaactttgtgttttatcttattcacaggatttaaactctaagatcaactattatatatgctctcaaatgctttggttttcaaaaagttttaaattttcctaaaaaattttccttcgtgaaattcctggtatcttacagccgattattgtaatgaaccaacacttacagcaggtacaatcactgcaacaaatatgtcttataaagacatttttgtaatactatagacacatttttaaaatgactttacagtgttatagacaattcacagccaattcatatagacccattcccaacatcacatcagccaattcacattcatattccatcatagcatagccaattcacaaaatcaaacacatatacattcacatccacaacccattcacatatatatgtcattcacatccattattctctccaaaccgccgacatgcatcaaaacctgtaaaactaagttataaattggaacaattttatatgtaactagaaatgcaaatatatacagagacgagctacctaggactttactctaaagaatttaattgtattacaaagaatatttacaaaaatcaaatgtttgtcgcatatgcattgcaaatgttctgccattccgagacgagctaactaggacttcactctaaacatccctttcggtgacaagatatcatctagtatgaattgtgctatctcctctctaatgatttcgaagttaatttccggaatgcttgaaataaattcctgcatgttcggccccaagttagtctacatacttgtaaatttgtcgtcctatgtgtgtataaacaattgaaatacacacctcagggtcgagcaatgttaccttttctgcgaaactcctcatgttatggcagacatggaacccgcactagtcgccaacttgttgatgtattgggaagtctttcttgtgaccaagtttgggatgcccatccttatgcctcccgcctcttgccacatattggttccatgcctcgttcaaggcagatttgatggcttgatattggagttaaggtagtgtacccggctccacttcggcgttattaccagaagaatccagtgtcgcctgcgaaattattaaattgctagttacatactacagttgtacgcgtctagtatttgagtataagtacggtacatgcttacagttgattgtaggcacacataatgaagtccttgtcttgacgggcaaataaacagtccttgatatagcccaccatgtttgctcgatcgtttttcagtgttgtctcgatgaagacaactggatcgagtaaggcaacatggggtgctttacgatggacatgcttccaggttaacctacgagcaagacaagagtcagggtaagcttaattcgtggacagtcactaccatatcgcgtaccaagaaatacttacaaggagtagcacttaaggaggttggtgtcgatcgctcgcaccctgtagaggtcccatagacctttgaagtctacggcgatgaaggcagtaggcccgaggaacggctgaccatcatgctggcccaacatggaggtctctctattcttcctccttgcgttggacttctccatgtagtacccgtgcaactccttgcatgcagggcccatcttgaataaggcatcgtctccgaccaatggcatgcccaatgttgaattcggctgnaaggctttggagaagcctactggcgccttgccaagatcaagttctttggggagatggcacctttatttttcctctccccgttccagcagcttttctgcgtgtgtcaagcttgggtggagaagatttcaccctcttgcttcttttggcaggagggggaggtgtggcctgctgtcaacctccatactgtcgtccccaaaatcagtatcatactgtaattggatgtcacgccctgaaattcccctttccagctttaaaatttgtaaaataaatcgtccgaagaaattgttgttcttaacctagagatgaatccctaattaataaatgcaaaaaataatcggaatcgacatgtggaattttttcttggattctacatgttaaaatatgctaacaggatttttagtggaattttcagagccttggaaataattttaaccaattaaaatgagtaaagggtaataataaatctctggaaaaatccttttttctttttctttttctgcattttttatatattnttgggctattggtcaagtccattcgctttctgtgatggctttccttagggtggggcaagtccaagcagattcctccatcctccataacccatcagggttacggacaggtggggcccacctgcggccccttcttccacctcccgccgtcgaaaccgccgcctactgccgccggtttccccgcttcccgcgcccactccgaccaataccgcacgcccacgtcgccgctcaccttccccacaccttccgctagctcgcgcgcctgcaaatggcgggggatttgctcttttcccccactctctctctgctcctccacttcccccacgtcgccggctaaatcggccaccttcccggcctcgtcgcccctcccgaggccttataaaccatccctccattcccctccaccttttcctctttccaccgctccctcccgtgccctctatcgctcccacgccgccacacccgccgncgncgncttttccactcctccggccgccgctcgccgccgctggagccgccacgagccaatccgctgccgccattagcttcgccgccgccaaagctaccccggccgccgcatccccatccaatcctgccgtcggggcccgcttctccccgcgcgccggtgagtaccaccatagccgccgccgtcagccatggctctcgctcgtcgtggacaccctctctccctctaacctctcacacttcctctcttaaggtgtcccggagctcggccgccattcgccgtcgccctccggtcgctcatcgtcgccgtttgccgtcgtctcctcccgcgccggccgaaccccggtgagaactccctccccttctcttcctcccgcgcgagccgccgctccccgcatgcgcgtcgccgcgatgcacagtcgcctgcgtcgccggccgccgccgttggtggccgcttgccgccgccgccctcgccataaccggccggctggcttgaagccgagccgagccaggccgccttcctccttcccccatgagccgccgcccggtgggccccacctgccagtacccctccctcccccttgagccgctgaccagtggggcccgcatgtcggcgccgccccaccccttgctgacgtcagccctgggatgaattattgcgcaataaatacattaaggctttttctttattagtaaaaacacagataatcttcgaaaaatcataactaattgatccgagcttcgattaagttcattcaagtctcagtaaattcataaaaatgtatagaatccattaaaaatggttttgtttcctgtttcagtagtcttatagcatgttttgcttgtgtgctttgtttgtcgcgtaaattttgcccgtttcgtcgattcgcggtttctcgaagacgttgctgtggttccatcagtgcgagagcaaggcaagtcatacattacaattgatcatattgtccccaatttacaaatgtcccacatttctattaaatattgcattgttttacaatatcatgtgggatgggtcctattactcagctatatgttgtttcccttacgccattgataacttgggtattaaaatgactagatgttggtttaggagatgcttagccatgcttagttcaactagtgcacaaaaggggatcacattaaagcatagactttgattattggcaatagctttggattagtgccaccgcaatggtgttggttaattaaaatacactacatggtgggctgtgggtgcatggttttgctagtcgtgcacatggcgattaaggaccggttcgcgggatgccctggaagaacttatcgtacttaccacaagccagcctgggcaacggctgggcttgtagtgtagcttttctctagccgacgtacccaggcgagggtgggcgtgatggagttgggtcggccggggtgtccggttgatcggcttccggattcaccgcggcacaaaaggggggctgcccgttgcctgctggggacgggcgtgaaccctaaggtgtggtgcgatcggttagagagggttatgcgaagggtcctgtcacggcctcttttcggtatgtcgtggtggcatgtcggcgcacaggaacgtgtcgtggggctgtgtcttgtgggtacagttgtacacctctgatcagagtaaaactattcaaatagccgtgcccgcggttatgagcggtcgaccagattcaccgtgattagtctcacccctagtttagcttaatgaactggtgtagttcaggtggttggttgggcctgttgcaacgtggtgtagcattggacagtgattggttaatactgctatattgctacaactgttttactgctttcaacttctgcttttaaatgctagctttatgcaaaagaacctttagcccccttggatatatcctgcatcatacctcctcttccggtacgacttgctgagtatagtgggtaatactcagtcttgctcttttcccccacaccagagttgaagttcttctcagttggagccgtctcagagaggttggttccgtcgctgccgtcaaggattgcctgtggaatgaagtcgccttgctgctgaagtcaagcttcccggtttagctcgcttttatcttttccgctgcatttgtaatcttttatatttttgtaagacgtggatctgtatgtcaacaattgtcgtttgtgtaccctggctagtcctggacaggggtttaatacacattcagcttagaaattctggttcttaaatttttgggcgtgacattggagatcttcatctctttgttcaacggcaggagggagagatacaacagtttgatggggatgcgtcggcggcggacgagaacttggcgctagccttggagttatattgatctcaatgctgtgcttgggccattgaataaaggtcccacgtgcagccccaaggatcagaatctcgtcattaggtgagtgtgggatagtgtagccaacccaatcgggcttcactaagtccacctgaactttggcattgccggcttgcagctgcgccccatacactcgggtctccggtgtaggcttgaatgcttgaccctctatggcaggaattgcaaatcctggtgtcacccaatcgactagggtacacgatgtcggttcctgcgatagattcattagtgtccttagtatatgttgcaatgtattgtggtgctaatacaatatatgcgttattaagttgtttttaccggtatgtggtccaccgcggcggggcctttaggctgttctgccggagcctcagttgatgcgcagctgctacgcctctgcgtgggtctcacttgtactatgggaccgggagtggcatcgatcgacctatccctgatgcgtgcctccatccgagcctccatacctaacagctcggcggtgaactcttctctaagctcttctttaagctcctcccgaatttgggccttaatgcgtgcagctttctgcgccttggaaagcttgtgcttcttgtaatgccacgcatattggggaaacccaaacttccatggaacattggaaccaatgccccttgttcgtccccggtgttctccgtttcccaacgcttttgtgaggatgtcatcctcgcgtttttgcgagcagacctcttgggaggcctgtctctcagcattcagttcgacctagggtatagttaggacgcgttagacgaagaatatgatataacataatgaaacatattctatgtgttcaacttacgattttctggtacaccgcttgatcttcgggatttgggaacgaaagagttctgtcactattcttctttacccttgcccttgcccagttccttgcccgctggaacgggatatcagcaagcacttgcggggtgttagattccgctgcagcttcatcctccttgtcccgttctgcctgtttccccgcgtagcctccggtgccaagccggtgcgggtgaaggttccttgcctgcagatcacggtaggcctggctttttacccgagactctttcgttggtttggtgggcatggaactcatcccacacgggtcgggtgatgaatgggtatttctcaaatggttctggctgggcggggttgaggacgtactccgtgaccagcgttgtcttgaaatttttccaacaattccctatcttgcggatagcctgccgcttgagtcctgcctcgggctctgtagggtatcggaagctttccttgaactgcctccaggcctcttctttttcttcttgagggaccagatcgatgtggtccttcagaatagtgaagttccgcctccctaggattccgcatatcgtagggaactttttgacagctttcgtcggagccatcggatatccaacatcgtccacctctattatggtgtagacttccttaggaatcttattctaggccctaggattccggctcgatgtagtggtcgttgacatcggttcgtcttgctgcgacatgtcctatgtcactgttgtacggggagaaagtactttttaaacacaaaattgcatctacacacattctctgatggtttgatatacctctatctcctacctgtgttcgcctcgttgatggaaccatagcatccatgctcaatagggccagagcagccgggaactcgacgtcgacatcagtatcccactcgaacttgctatcaatgtcactaccataagatagtggcaacggtagcaggttctagtgggatatggatgtcgaggtcaagatcccgtctgctccggccctaaggaatatggatgctacatatctgctgacgaggcggacgcagatagaacacacaggcaaccaaaacccttcctatccaagatccctaacgttatcataagcaaactcctagattgcatccaagatcatttcgttatggaacctttattcccatagatacagcaaccatctttggatactgaatttatgggaatggggtttgtcggagatatgggcccgggggtatgtgaagtaaggggaagtcatcttcccatccagccgcgtggctctacagcctggccctactcccgcacctcgcgagttacagaagcggccgggggggcctcggggtgccacgttttgcccctcggactctctcgctgcttcgccccggggccctcgcccagctgccatgtggcgggtggagcgagcgggaaggggacctaggctgaatagccatcaatgcgcggcgccccaactatccctcactgcgtttaatgcagtaagggcagacgtgcggtgccgcctagctgacccccatcaatcggacgtgaccagtctgtgaccggcctgtcgccggtcacgtcggattgaacgggcggctatgcccccccccacgtcgcctctgtatccagcggagtggaggtaggtatgacccgtcccgtcgaaacgtcattcggaggaggaccaccacaagtcttcactcatttatgagagaatgacagggctgcctcccgtgccaagcgggcggctgcgctgggtcccactccaggaagggctgctgcttagcttccaagcgaaggcacggatcgtgacctggtcaaggtaaagtgggtccccctcccatggaagggtaggtagaggcgatgcatgtggtatccccttgaactataaaaggaggaccttgcccaccgaacaaggggacgattctgagaaaacctaaactctaggagaacaagggcgagagagctcatccggagggaaggcgtccttgtaacacttaaccataatcccaaacacaggagtagggtattacgctccacagcggcccgaacctgtataatccgattgtgtgcaagcacattagcagccttaggggcggatacgtgatttctacgaagcgagcttcttcccccggccgaaccacccgctatcgagggacttcccccgacagctggcgcgccaggtaaggggcagtcgcacactttgaagagaagtcattttcttctgccccaagtttcccggggcccttgatgatcatggtcgaggtcttggaggtggaggaggcggtggcgtttacccccaccccatccaggagtggggactctagtgggagccacggccctcgtcaccgtcgccacgactccccaactccttcccgtcgcgaaccctcgcggagggaggattccacccgttcgagtggtttcgccctctctctgcccctgggcgaagggaggccaccagccagcccaagccttgcaggtcatcccactctcctggccttttgcggtctgggggctagacatccttggaccattcaaggcggctcgaggtgggtttcagcacctatacgtcgccggtccacccccgggacgacagagtgctgctagatcccccgcgagactggggcctgctctcggccctccttcggcacgaccagccccgagcgcgccccaaatgcaagggggagtggctgtccctctcgccccccgcctcgggtcctagggtagatttggcctcggcctcgggctcaggctcgagcccgtccccaattttggccttgacctcgggctcagggccgccttggcttccggccttggcttccgagagcgacctccctcgccccccgatcccgggtggcgctccgcatgcaccccagtctcggagccacccccgggagggacgtcaccaccatcgcccgcagcgagtcgagtcccggctgaggttggctcggggccggacccggtatgcggccgtgggcccgccgaggggctgtgaaggcccccggccttggatcggccaagcccgggccgctccgatcgttcggatttggtcccccgcgaagggtcgaaccccgagaccccctgggaaggaatctcgctgcaagagaacccggatcgcgttaatgaaggaaaagaaacggagggaacaagaaacctaagatgagtaaaaagcatcgaagtgggtgccggcagttgtacctgcagggagggcggttaaaagtccacttcgggggctcaatgaagctcccccgacacggctccgtttgacctatcttccggagccgcttcttcttccgtccggcctcagcaccggcggggcgcttgtggcccgctggcggtcggtccgccacgcgctcggcgccccctccacgcggaggagagggcggtcgagattcggaaatcttccgtttctctttcgggtcgctagctgagttcgtccccgggtccgcggtttgtgccgggagacctggagctcccacccccgccgggtccgcatgtccgactcccgcctgcggtcgcgccaacgccacccatgccggcagcgctaccaccggtgccgccccggctggaccagcccctgccaacgccgacgacggacatcacggccaagatgctctcccggtcgcggtcgcagcgaaggggaaggatctcatctggaattagcatttgctcggcggagtctaggcccagcacccgttgaatcaccatcttcgcgtcctcctccccccagtcccagcgcgcacccacatgcgtacgcatggggttgttgggaccagtgtactcccacacaccacgggatcgatcctggagaggtgcgatccggcggcggaaatagtcaccaaagaccatcgcccctgtgaggcccaggcttcgcaggcccctaaggtgatcccacatcgcgtcgtactccttgcccagttccgaaaccgccagccatgcggcagatctttcgggaggaccggcgggaagccgaagtcgcgggtggtccggcaacgcggtgtagaactagtccttcttccagtcctcccatttcttgcggagatgactctcgatgtattgtcccgccgtgcctggccggggctggaagtaacatccccctaccaccgcaccttgcagcagctgcggaatgaagaaagactggaacagccgcatcgtcgggcgcaccccgatgaacatatcgcacagatgtgcgaagatggccagcgtcatcacggcgttgggtgcgagatgcaaggcatggatttcatagaaatccaaaacctcatgaaagaatccggagaacggcggaatcaaccccgccatagagaaggacaggaggtgcacggatcgctccagataccgtggccgcggccgccactcccccgccctcacgacggcgccttccggcatgatcttacgggggaggataaggtgtctatccgccgtaatgcgtgatgccgggagcactgtgtcaccagcgtcttgagccatgatggctggtggagaagcggcggagggcttggcgcgcgggatattgtgaagtggcgagaatattagggcttaaggagcgagaaggcaagtgggcagttggcgaaaggaagaaggcaaagtccttgcctccgtatccttttatcctcgcctcacccacgctcacctcctcatgagttacagaagcggccgggggggcctcggggtgccacgttgtgcccctcgggctttcgcgctgctttgccctgaggccctcgcccagctaccatgtggcggggggaacgagcgggaaggggacccaggctgaacagccatcgatgtgcggtgccccaactgtccctcactgtgtttaatgcagtaagggcagtcgtgtggtgccgtctagctgacccccgtcaattaggacgtgaccagtctatgacgggcctgtcgccggtcacgtccaattgaatgggcggctgtgcccccccatgtcgcctctgtatcggtggagtagagataggtatgacccgtcccgtcgaaacgtcattcggaggaggaccaccacaagtcttcactcatttatgagagaatgacagggctgccccccgtaccaggcagggggcggcgctgggtcccactcaaggaagggctgctgcttagcttccaagcgaaggcacggatcgtgacccggtcaaggtaaagtgggtccccctcccatggaagggtagatagaggcggtgcatgtggtatccccttgaactataaaaggaggaccttgcccaccgaacaaggggatgattctgagaaaacctgaactcatacggagggaagacgtccttgtaacacttaaccataatcccaaacacaggagtagggtattacgctccacagcggcccgaacctgtataatccaattgtgtgcaagttgattagcagccttaggggcggatacgtgatttctatgaagcgagcttcttcccccggccaaacccacgaaaggggggtctcacgacctcccgctatcgagggacttcccccaacagggttccataaagaaatgaccttgaaatcaatctaggatattggtaacgataacagatttctacaaatgttgtatttgaacgaaatgttctttttaccaatttgtcttggtcggtaccgtgcagacagtaacccgaccaaaccagatttggcgaccgggacacttcatattctcctaaatgccataattttagtaacttcatttaataatagatttctatgcatatccatcccaattccctcaaaatgacccaaaacccaaaacagtcacatatatattatttttgtacctaaaaacacaagtcatgacatataataagtttggcctcaattttgctcaaaaattatgcatcaattaccatcatttgcaactgcccccactgtccttattggacctaaaatatcccaaaattttgcaaacaaccatataaaaacaagtgtagagggtctgtccttatgcagtaaaaaaatagccataaaaaacataccaaaactcacatttcctccaaaataattcaaccatcacagcccacatcaattcatccatcccattgaacccaaaatatcccaaaaattttgcaaacaactatataagaacaagtgtagagggtctgtccttatgcagtaaaaaaaacagccatagtaaaacagccataaaaaacataccacaactcacatttcccccaaaatgattcaaccatcacagcccacatcaattcatccatcccattggacccaaaatatcccaaaattttgcaaacacntatataagancaagtgtagagggtctgtccttatgcagtaaaaaaatagccataaaaaacataccaaaactcacatttcccccaaaataattcaaccatcacagcccagatcaattcatccatcccattggacccaaaatatcccaaaaatggtatgttcttgagcaatcatgactggccattcttccatcatagcccacaatatttcatcatcatagcccacatctgaacaattttcccaacatcccattctctcccaaattcacaaattcatccatcacagccatataaaactttatcagtagctaacacatatagaaatgcacaagtcattacagccatataaaaatttaccactatcggacacatataaaaatgcacaagtcatcacagccatataaaaattcatcactagctaacacatataaaaatgcacatgtcatcacaaccgtataaaaattcatcactacctaacacatataaaaatgcacaagtcatcacagccatacaaaaattcatcgctagcacaagtcatcatatgtagacattagcatctaaacattgaatcagcaaataacggcagtcttgggcggcgccgggctcggggacggcgtggagggaggcgccgggctcggggacggcggtcttgggcggcgccgggctcggggacggtgtggagggaggcgccgggctcggggatg

SEQ ID NO: 11471 - DNA, 1685 bp, Oryza sativa
cattcgttgaagcgagcaccatgttctctgttgatccaaatatctgatcgaccaatattgtcctgtcggaccttcgctaaatgctcctcaaagtatggggttacttcagccatatgttgcagcactgcgaaatgagcctgcgcgtaggaaacttgattgggaacaattctttttctgtcagttgtgctgacacctgccaaccttccttcgtggtgagacgtaggaaactttgataggatcagtctcggccatgtaatcgatataaaactcaatggcttcctcggtcgtgttaccttcaatgatgcttccccctggttttgctctgttctgaacgtacgacttcagaattcccatgtacctctcgaatggccacatttctctcataaaagctggcccacatatttttgtttgcttcactaggtgaacagtgagatcaccaatgatatcgaagaaagccagtggaaaataaatctccaagtgacatagggtactgccaatatcggcctgcaacccatctaggtcttctggatctataatcttctgaccgattgcattgaagaaggcacaaagccgttggatcgtgtgacggacttgtggtggtagaatgcctcttatagcaactggcaagatctgtgtgattagcacgtggcaatcgtgagacttcattccaaccagcttaagatcctccaatttaacgtacttacttattgtcgtgcaatagcccgaaggaactttaatatttgccagacatgatagcattgcaatcttctcatccttcgacaatgtgtggcaagctggtgggaggtacactcttcctgtcttctcatctgtaacagggtgaagttcactgcgaatgttcatctcctgtagatcgagacgcgcattcaacccgtcctttgtcttgccaggcatattcaataatagccccagcaagttatcgcacacattcttctccacgtgcatcagatcaatgcaatgacggacctcaagatcttcccaataaggtagctgccaaaatatggattttttcttccacatcctcttcttgtcctccttgctacgttttcttttcttctaaactcattagtaatgtccttcaccatgttttgtacctgatctccggacaaatccgcaggggcagacccaagttctttcttaccattgaaaattttcttctttcttctaaaggcgtgccttagggggagccatctcctatgacccatgtaaacgatctttcttgatttcttcagccatctactgcgtgtatgttccatacaatcagagcatgccttctttcctttcacggtttgtccagaaagattacccaacgcgggataatcattaatggtgcagaacaatagaactcgtagtgtgaagttctcctgaccagatgcatcccaagtttccacaccctctttccacagaatctcaaggtcatcgataacaggctccaagaacacatcgatgtcattgcctggttgtctcggaccttggattaacaagcacaacataatatatttccttttgaagcacaaccatggcgggaggttaaagttcgcaatgagaactggccaagtgctgtgagaactgctcatgtctccaaaaggattcatgccatccgtacacaaacatatcctcatgtttctagggtcggcagcaaagtctttgtgctttcgatcgatatt

SEQ ID NO: 11472 - DNA, 740 bp, Oryza sativa
ggattcgagttcgattcggatcgacttttctccctccaatccgacctttccttctcgccgccggtcgccgtgggccaccgtcgccgctcgctagcccctttaaaaggacccccgagctctcctctacccgccgccaccttcgccttcgtctctcgtcgcggaagcgctctagcgccgtgtaacctagcgccgccgtcgtcgccgtcgctccagccgtgcgccgccgccgttccagtcgccgtcgtcactcgggaaggccatcgtcgggatcgccaagttgccgccgtcctcgtccgccccttcgccattcgccggcgagcgtgcgccgtccgagccgtctgagccgccgccgccggaggtgacgtcaccgccgacgtcatcgtcgccctctcccgtgagccggtcgtggaccgttcgatctcggccgtcctttttggacagggttgatctcggccgtccgttcccgtgaaccgccgccgtgcacccgatccaccgcaaaccctagccgctgacgcaataatcattcttttccttttcaaaaataattcattattgcgtcataattcaattaaaatccatataagtgttttaatccgatttaatctttaaaaattcacatttgaactcagtttaatgtgggtcaagttgcaaaagttgtataaaataaagatctacatattaaaattgtccataaattgaatgaaatttatttaattctttgtaaatgggctttaaataga

SEQ ID NO: 11473 - DNA, 7123 bp, Oryza sativa
  unsure (1)..(7123): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgtgtggccattactactgatttatggacagcaactcatcaaaagaaaggatacatgttgaggagggtgttggaacttcagatggagttaatgcttcttcaagtgttgcccctccagggggatttgatttggtggatgatatatttgatcagtatatgtctggacaaactgttgcctcttcctcacagattcgcactgagttagatttgtatttagaagagaaaccgttgcctaggacacaagattttgatattatcaattggtggaagtttgggggcattaggtacccaactttgagacagattgcccgggacattttggcaatccctattacaacagtagcatctgaatcagcatttagtactggttggagggtgataactccaaatcgtaatcagcttaaacctaatcttgtggaggcacttatgtgtgtgcaagcatggggtcgtgctgatatgttaggtaatttcatttttgcttttgtatcgttcaagtttaatttgtcctttcatgtttcttccatttcatctaattgcaaatcacattatatgttgatagctgaaattgctaacaagaccaatgcattgaacacggtacttgacgatgaatcagaatcggtatgtcctacactcccactttattgtttttattactataatatacaatgcttagttgcttcctctaattttgatttcaggaagcatctactgtcactgaagcttgaggtggagatttcataagtgaaggatgggctagaaagcctgcaattgcaaactatctacctatatattttattatgttggcaatgtaatagtatattaagacttctatatttctgtgagactgaatttgcttgctgtgtgtgatgtgttgaacaattcaactgttgaactttgaaggcttgattcgcttgaacagttgaactcatgtgtgttagtgtgtaactgtgtgaaatgatggatatcatcaatgtgttcttgctgaatttttatgatgaaattgaagtattcatgctatttttgatggtgtgttaattatgtacaatatttctttttgatgaaatgatgattgtgttgtattttttgagctgattggattgagatgctacccaatgcggggccccggtcgggttgcggggccccgcaggggtcgggggcgggggatgttttcaacccgcatcactggtcggggccgggggcggggggtgaagtcgggggtcagggtcgggggcnttncannccaacccanncccgccccgccccgttgccatccctaactacctttccactattcgcaggaggtgcgcgactacaacaaaacaacccaacggagacatcttatttgtaggatagagacgttttatctcgtctcctacagataactgagacgcttttataaatcgtcgtaggaacgtctccgtttgcaccgtctcaaaattatggaaacgctttttaaagcgcacctatattatttaagacgttgctagagacatgtaaattgcatctctataaaatatagagatgcttttatagaagcattaatataggcacgcacatcaagcattaatatttgcagattgcaaagttcatgcactaaccaagtcattaacgtgaacaatcttaaaggtaaatagatagttttttttatattgcaactctgcaaacatgcgtcctatagcagatactcttcttttttaatctgagactgaatattaaatattcatttttttttctaaataattataatattattataatggtatttaatgatgacgattaggaacagtgtgtttttttcttctttctctatataaataattatatattatctaataacgatgacacggatataataaaaacgtctcaaaactcatttctacacatgagacgttccaaaacgtctcaatattcctctctaaacgatttagttttgtgctaacctgtaaagcgtcttaaactatgtcctcaactaataaagcgtctcaaatatcgtccctattttaatttttcttataaaaaagagacgacttataaaatgacttaagtgaaacgtcttaaaacaatagttttgttgtagcgcgcgtgctctgcttcttcttgtatacggaaccactataggatccagtaatttattcttaatccgttcatcaagtcaatctcctacataggctgctatgttgcaaagcaaaagcatatactagtatattttaaaaagcgatttcatggacagacgatttggcatgcattatataactactctgagtacagccaggccagtgtttgtcacatggctgatggctcagatatacttttatgtcatggacgttgctggtttgagcaagtcggatgattaatttgatcgatccgacggcagtatgcatatgatgatgtgataagccaactaccacagagaattattagtgaagagtttttcactagtgactcagtggtattattggcccagttcctactgtataagcgaggatttattcgaggaaagagggaccctatatcataccattacccaccagttatcatcgccatctctagctctctcacacgttcgaccacagtctcgtcaccaccatctcccttacacgcaccattttcttcatgatcaccaccatctcacatctttatctattataaaaattaaagatatttttgcctatttttcatacgtcatctcagtccgattccctccccgtatgcgcccgattactcctagatcacccgtataaaaaacatgcaaggattacgtattttctttcttaaagcttttcatccgtcatcgatctcttgcgtaatcaaattcgctaattggctttcaatagagccttcgcccgccgcttgtgccatcatgcacagcataaggcagtccaaatcgatcatgtatttcataatgtaacacagcctaatctctgtccccacggaatgccccagtctttcctcagaccaactttgtcacgtattaatccatccacagccagcataagccgccgcctacgataactgatcttcataggtggctggtttaagatgggactggataaaaactcgtggcttgttagctcgctcggctcgtgtctatctcgactcgacttggctcgccgaaccagagttttagctcgttagctataacgagccagctcgagatggctcgcgagccgctcacgaggccatgaaaacatcagaccgagcagccccggatgacacctatccaaaccatgtaagcccaactaggccacggtagtacagtgcacatcctatattcagttaataaaggcgacagttgcggctcggcaccagaaaaaagaagagaaaaaagaaaaaagaaaaggagagaagaaacggtgagactccctcgatcccttctctgatgtcgccattcgccgccctgcgcccctgccgctcgcgctatccgctgtctgccgtcgctccctgctgttccccactgtcggagcaaaggagatccggtggccatcaacctgaggctgccggatctggcgccgttgacctcatggctaaccactggatttggtgttccatccgtgacaaagggacggtggtggccatgaggagaatttgttggccaacgaggagggagacgctggctggcggtgatgtaggcggcaacaccgtggcgcggtaggaggtgatgccagctcgttatcctaagccggctcggtatccaccctagtttaaggtgatgccggctctaatgcatcttcgttgggagcacctttattaagccacctgtggtaattttatatcagaggcgaaacctcaaatgtatcttcgcatggtggcctgctatcaaatcccttgtccacaaattacgtagacgggtgtttgcgccgaaattttggcctgccttaataaaatagctcgcgtagtcgaaactcatgtaacacacactggtggagaaaccatctttcgtcggtcggccgatttccacaatagtcccggatgcaataaaaaccggtgctaaagatgatctttagtcccagttcaaaagggtaacgggcatatttgatctttagtcccggttggtaataccaaccgggactaaatatcatctttagtcccggttcgaatgctgtcagggcatgtcgggccccccgggatctttagtcccggttggtcgtaactttagtcccggttggtattaccaaccggggctaaagatcctggtgatctttagccccggttggtgctaccaatcgggactaaagtcccacccctatatatatgtcttcttcctcctccagctgcccgagcaagcttcaaaatttcttcaaaaaagaggggaggtcatgccaaaatttttattgaatttattttgatgattacatacaaatcggaggtgcctaaaaggtttgcaacttcatcgtccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattataattattgtatgactgtcattattgtaagaataattatttgtgtacggtttttttttactcatgtagatggatcggcaatggatgtacactgaccggcggtccaaagagtttattgacggcatgcactattttttgagagtggccgaagctaacaggcaaaggggttttatttgttgtccatgcaataagtgtaagaatcagaaggagtattctgcatccaggactattcatttccactttattgagtcggggttcatgccaagctataattgttggacatcccacggagagcaaggtgttaaaatggaagaagatgaagtggaagacgacaatattccggactttgctcagtatgttggatttgaagaaaatcaaacgggtgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatagggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgatcgattgtatcctatatcgcggtgaggagtatgagaacctagaagcatgccctgtatgcaaagcactacgatacaagattagacgagatgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgattgttcgtagtggcgaaacatcgacagaaaatttaaagaatttggaaaggacgcacaaaacatacggtttggtttgagtacggatggcatggatccttttggagagatgagcagcggccatagcatttggcccgttacgatgtgtatctataacctccccccctggctatgcatgaagaggaagtacataataatgccgattattattcaaggccccaagcaacctggtaacgacatcgatatgtacctaagaccactggtcgaagatcttaaacagttgtggaagaaagaaggtgtccccgtgtaggacgaggacaaacaggaggagtttaacctacgagcgctgctgttcgtaaccatcaacgattggcctgcacttagcaacctatccggatagtccaacaaggggtacaaggcttgcactcactgtatggatgaaacataaagtacgtatcttaagcactgtaggaaggttgtatacatgggtcatcgtcgattccttgcagcaaactacctggtacggaagaaaggcaagcacttcgaacataaggccgaccaccgtacaaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacgcaatcgacatgatgcacctcactaagaacctttgcgtaaaccttcttggcttcctaggtgtatacggaaagttgaaagatacactggaagcacgtaatgatctgaagcatatggaacaacgcggcgaccttcacccggaaccaaaggagaaaggaagccattacttgagtccagccagctacactcttagcaaggcagagaagaaagtatgtttgaatgcttggagagtataaaggtaccgtctggatattccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatatattagaagcccttcagaataaagtggtgcaatgtctcgtcagttttgagttgatatttccaccttcatttttcaatatatgacgcatctgctttatcaccttg

SEQ ID NO: 11474 - DNA, 1670 bp, Oryza sativa
ttccgtaaagcccatttcactgttctgcaacactcttcattggtagctccttacatcgaggagcacttggctcaatgggtacacattctacacgagagcccaagacatgaagagcacgaaccaaaacagcgttgttcgtgtcgatgccatgggacacgatggaacaactggcacgtattacgatgccatcgaggatatatgggaacttgactatggtcctctcaaggttcctctgttctagtgccaatgggttaggttgactggtggaggcgtaatgattgatgacagtggtatgacaactgttgactttaacaaggttggatactcggacgaaccttttgtccttgccaatgatgtaacgcaagtcttttacatgaaggacatgtctagcaaagaaaagaagggcaaagggcttgacgagccgaagcgccacgtggttctgctaggcaaaagaaaaatcgtcggatttgaggacaagactgacgaggattacgatcagttggatgggaaaccccctttcatggtgacgattgaccctagcatcctcctatcaaatgaagacaccccttactcacgtagcgatcacaaggagggaacagtagtgaggagaaagtacgtgcggtcaaccgtcacctccaatgtattgccgtaattattatgtacacgatgtaaactattttggatgtactgattatccatataaatcaattgttgtatggcatatgttaattatgtatgattattagaatttttaacaattttaaatcatgcatatgctagttatatgcgataattagaatttttaaaagttttaaatcatgcatgtggcatttacatgtgttaattagagtttttaacaattttaaatcatgcatatgctaattatatatgattattagattttttattaagtttaaatcatggatgtggtatttacatatgttaattagaatttttaacaattttaaatatgcatatgctaattatatatgattattagaatttttaacaagtttaaatcatatatttgcttattacgtattatctacttaatttactacagacaacaataatttttcgaagtaattgtcattaatttttcgactttaaataattttaatgcattatttactattttagaaacacgtatttaatgaaattcaatattcagtgctattgtctatagtcccggttgtcaaccctaaccgggtttaaaaagaatttggaaatagcgggaaaatatctttagtccctggtggtctcaccaactaggactaaagatctacgggtatatatattcccgatgcgcgcccccgtcttcttcatcaacacttagaaggtttttccctgatctcggcttctccttcgccgccactgcctaaggcatccccgcgccgacgccgccgtcgtatctcgccgtcgtctcgcgggcgtcgtcgtcgcttcttctgtcgcgtatgccaccgctgcatatgtagggtgagagccgccaccgcctacctctctctctcgacctcgatctctctctctctccaaactaccgccgcctcgtttctgacgcagccgcagacgttgacgcggccgaccccgactacgcctcccgctgatgccgtccccgacctcgatgcggccgccacagctgaggacgtcgcgccggcactgtcgacgat

SEQ ID NO: 11475 - DNA, 10052 bp, Oryza sativa
tgaacgaaacgttaacgaaattgaacgaaaggtgaatgaaacgttaacgaacgtgaacgaaacgtgaatgaaacgtgaacgaatgtgaatgaaacgcaaacggtcgccttatacgacactacgtgaaatactatatatgttactttgcgtttagactaatacattatcttgtatgttgcagaaaagacgtcgtcgtcgttgtccctcaagccggagaggtagctagccctcgaaggaatttgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaatggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaaggataccaaaggatggcataatagggttccatttgcaaaagcagcatttaataaacatttcagaatttaataaaacaattaagtaataattaaacaatattaatccaacgctatacaacataccctgttgtataggcccaacctttctgaacaaccatacccagctgtacagatctatctccaaaccaggaatataccattccaaaccaggagctaaacaaattattaccagttatagcatcatttactaaggtgagaggtgtgagactaatcgcgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcattgactccccagcgacgcctgtgggcttatctccgccacttctcagtctggtgccccgcaataaaccatgctatacaaaaggtaaagccgttgcccacgctggcttgtggttggcacggttaatgtttcacaaccgaaactcgtgaaccggtccttgattgtcatgagcactactctcaaaaccatgtgctcacaacccaccattatcaggttttaattggcacattaattaattaaccaatcacgattgaccatcgtgagctatcgttaagccatcattaaataatagtgagtcataagttatcccaatagtgtgctaatgtttctaagcatggctaagcaatcatatctaatatctagctgaaccaatatataaagcccaactagtcaagttaaaataacccaaggtatcaaggaataaagtaatcaagaacaaaagggctataacaaacaataggttaattccacccaatgacattcgaaaataaatgcaatagttgaatgaaaacaatagctttaaacgggatcaacatgctcaaagggttgtttgggatctgtgtgacttgccttgctggccttggaattcttcaaattcttttcctgcaaaaacagactctccggaaacgtcggaatctaaacaggaaagagcaaaatcaccagaacagcacataaacaagcatgaacagtacatgtggatatttttaacatgtagatctcaattttagaaaaatttagagacttgaaccaactaaatccaagctaagatgaattagttatgaattttcaaagattaaatcgaattaaaacagttatattgattttaattgaattatgacgcaataatgaattatttttgaaaaggaaaaagggatttattgtgtcagcggctagggttttcggtggaccgggcgcacggcggcggttcacggaaacgaacggccgagatcgatcttatccaaaacggacggccgagatcgatcggtccacgaccggtctacgacagacggcaacgatgacgtcagcggctacgtcagcgatgacgtcagcaccggcggcggctcgggcacgcatgctcgccggcgaacgacggcgcggcggcgcgaacggagggcacccacgggtagcggacggcacggcgaactcaccggtgaccaaagaagcggcggaagagcaacggacgacgtcggcgacgaggaagaagcggcggcggagatcgggtcgacggcggcgacgatgctccggcggttgatagcgacggcgaagaggcggacgaggacggcgacgcgacggcgaccacgatggagacctccccgagcgacgacgacgactggagcgacggcgaagcacggctggagcagcggcgacgacggcggctcgaggtcacacggcgctagggcgcttccgacgacgagagatgaaggcgagggtggcggcgggtagaggagacaccggggatccttttaaaggggctaggaggcggcggcggaggcccacggcgaccggcgacgcgaaggaaacctcggggttcggaggaaagagaccgatccgattcgacctcgaatccacgaacttccaaagcgatttagacgatgattccaaaagagaaaaggtagaggagatcccgaagattgtttcccctcaaacgatttcaccggatcgggaaagacgcggccgaattggaaagcggcggcggcggacgcgacgctagggtttcgggcggcggccgacgcgaggaagacgacgactctgacaggcgggacccacctgtcagcgacggtcgcacgagcgcgcgcggctgcggactgggccgacttgggccggggagagagagaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttaactggccccattttatgttggaatttattaattaaaattagatcttctcttctaggcttttaaaataaattctaataattccatttaaacaacaatttatatatttaggatttttagggtgtgacagaattcgcgcaggcaagtgatgtaaatatatgattgttagatttttaatataattaggactattaaatttaatatacgacacttagacatagcatatatgattatctagggttctaatgtgtagcatatatgattatttgaattctaatatatgacacttagacttagcatatatgattgttagagttttaatataagattattagatttgtaatataggactaataatataagactattagatttaatatacgacacttagacatagcatatatgattatctagggttctaatgtacgacacttagacttagcatatatgattatttcagttctaatatacgacacttagacttagcatatatgactgttagagttttaatataagattattagatttgtaatataggactaataatataagactattagatttaatatacgacacttagacatagcatatatgattatctagggttctaatgtacgacacttagacttagcatatatgattattggagttctaatatacgacacttagacttagcatatgtgattgttagagttttaatataagattattagatttttaatataggactaattatataagactattagatttttaatataagattattagagttttaatacaagattattagagttttaatataagattattagatttgtaattagacttagcatatatgattatctagggttctaatatacgacacttaggcttagcatatatgattgttagagttttaatacaagattggtatagttttaattattatctaggggtctaatatacgacacttagacttagcatatatgattgttagcatatatgattgttaaagcaaatatgacctatagacttagcaaatatttcttgtatgaacagatggctgattgcgatgaggaacagatattgtacgatacaatcgcagagggaagcagccagtactggaacaaagaagaggggaacgaggatccaaaccagtacttgaacgaggaatggaacatggagagggatgcggagaggaaccagaaggggaacgtggagagggatgtggaggggaacgaggaggaggaggctagtggaagtcaaccctccgctgacagaagagggcacgcggacaacaaggtgccgcgaagaagctagagggtcaacacatcataacggaagtggacgaagacggccgacctagtgccccggcagaagcagccaagaactacgtacgacacaacggttgggttgtgcaggataacgtgtctgtcagtacggtgtactggcgcagaataagggcacgcggagatcatgagagctttgtcccagattcggagaaagagatgctgtggaccacaatgctcgagacattcacccttcccgcgggtatagagaacatagtgaaaaggtgaactctaaagaaaatggcagaacagtttcatagcatcaagggagatctgtaccagaaatatatcgtgaaggggcagacaccgaacttcaacacattcccgaagctaagggatcactgggacgagttcgttgcttacaagataggtcaacaagggtaggcgatgatggaaagaaacaaagaaaataccgccaagaagaagtaccatcaccacttggggtcaggcagctatagcatcgcgatgccgaagtgggaggagatggaggcaagcttgcttgagaggggtatcgaaccggccaccgctaaatggccggatcaatcgaagttctggtactatgctcacggtggaacgctcaacccagttgatggctccctggtcttcagcgatcagatacgcgaggctgcaagtcgactaacggacgcagtggaagcctcttctcagggcacgttccgacccgacagagagaaggacgagctgtcactcgccctgcagactcccaagcatccaggacaaacacgagggaaaggggtgattccttggaagattggattcaaggaggacatccacacgtacaggagtcgaatgaggagcaagagagataccgaggcgaagattgcagatcttgagtacagggtatcgagctacgagcttagcatgcaagaggaggtggcaaggaaggtggatgaacgcatggccacacatcggtccctagatccccagccgtacattcctcctgcaatggtcagcccttcaggcaatcgtagcagctgcgcctcaacggggcaggtaggatcacagagcatggacgccatgcaaatacaggacgaaaccacctgccccgttaatgtcatcactcggtggacaccatgtgagctgcatattccctttgagaacttatcaataaaggtaatctcgtagtttatagattttagacttgtccattccgcaagttgctgcttatatatattgattaataataaataacctctcaccatgtgaaggtggcgtcgggcatggccatcccaacggacccttcagggacttaccactgcaggcttattccagcaggatactccaaggtcgaagttgagttggtggaagccgcgtacgaggacctcgagttggactaccttggaggagacggtgagacgcatctacgagacacaagccacgccactatactatggcgcaagcggtacatcatcctccttgggcgacaagcggcgtctcgtgcaccatcttctccggctccgccatctcctccacaggctcctgcaccgtctcctcctcatgctccagcactgtctccacctcaggctcctgcaccgactcctcctcaggctcctacaccaactcctccgcaagctcctcgtccggcaccttccaagtcaagggccccccaagctccactgcctgcccccacaagggcaacgaagaaggcgaaagttgacgcctccaaaaacaaggacccggggtacgattgcacacaagaggagcttgacgcttatgtggcttcagaagtcaggagacaattgaagcctcaaagtccagaaaagaagattcttatagacccgagtgtcaggaacttcttcaggggtatgtcttcacctgccaaggaggccataaagctatcggactatgagcgaacacttaagaaagcatcttctggaaagtccaaactagtccctcagcttggagagcaaccaaaccaggagatcgagccgttggtgaccggtgaagaatttggaatacaagattttattaataacaccgggctaactacggatcagttgctacgagatccaccaatcgaaaaggcggaagtgaaatacttgtacgaactcggtaaaccgcttgtcaagcctgagtagctgcagtccctaccgatacaaatgtacaaattccatcaactgtacatggagatgaacgccaccggtagagagatgatcggagcgaggatcagggacacggacttcttgcaaggagaagatattctctagatcaatttcaagggtatctacgaactataccagctggacgccctcgacgtgtctattatgagttgttggactttgtaagtatcgttcagttagatttctttttacgtttcctttaattaattaggtccttgtatataagtacaccatatataatatatacttccttttatcgttgtagaatggagattcaaagggcccgacggcggggggttttcgatactggattcatcgaccctcggaaagtaaatatgcacacatatatatagtacacacatatataaatgtgcacttaattaagtaaatatggcctatatttacagaagtgcgtatatgtaatatataaatatttatatatatagtatacacatatataaatatgcacttaattaagtaaatatggcctatatttacagaagtgcatatatgtaatatgtttttacacatatatatgcaatatgcatacatatgtataaatacatataatacacacatatatgcacataagtaaatataggccacatgcatatattaacaaaatttgagtttgcacctaagtaaatatacacacatatattatattatcaaaataagtacaaacaaaagtaaatgcatgtatgcatatataaatatatgcatgtattacaaatccttcgggctttgtaattattgtttatgtcatatactacgactttgtcaaatcagaaaaagaaggaccggcttgatgaataggctttccgtctaatagaattattctgtgggatcaagaatctgctcgttgatgaatcccatcagttgttcttgaatagcccttaggaaatcatcgtgggtgaggttgtccttcatgtaaatcgcctgtcatttgaaaaaaaaatgggacaaaatatatgaaatcaataagctaatggatacataattaatgtatgaataaatttacatacattcaggtcctggacagtcctgatttgctgtgataggcagtgggtataatcacagacttagtatcgtaggctctacggaccttccattataattgagggatgaaatgaataattcaagtcatcaaacaagcataatgaaatatctgacgcctcaagagaggaatattggagacattgctgggcctttagcctgccagtcaactccagcctgagatgtgcccgtcaaaccactcaaaggtggcgactgttggtatttcttaacgacattactagaaatataattcccagcaatgacgcagaaatacttctggtatcttatggttacagagttcatccgcaagcgcacggatataccattgtagcatttcacccgagagtattccaagcgtatcgtatttattttatcttgtgggaagatcatgtagagagaactcaactaataatttatatattacttgtgataatcatattctaagcaggggttaagataatccaagggtagagtgacacacaagcatttctactcatcctcataataaataatctaagctagttggaaagaaaatagaaagagaatatattcctatacttctaatattcatagtatacatatattctagttaactgatatactagctaataccctctatccgatgccctcctggtacttcgagaagccacccctgactgccgagttccttacgacagcccatcataaccatccaaccggggctaaatacggaggaataccctccctaggaaattaacttaggattatatataggcgcggaggaatacccgtactgagctgtcaccatcagcggcccacctctcatccgcaatatataaccccggataatgatatcccataatctagacaccacgctaaactaccagatactactctaatatcatcgtcatgacatagagtaattgcataagcaaacactatacctgcactaaagcatctccgagataagctagcagtatattcagtataacatgaacataatgtaaagtaggtactcatatactcggaaagtatttcaataccagaaatgtatttagaagagtactctaataaatgtacaaagcttacaaaagaggaaaggaaagctactagagccatactcgaactcttccgaaggtttctggactcctgattcctattctaattctattccactagctagatactactaaactaaacttgagagaaataagagagctcttgcttgaggtgtgtgttgaagtgaagagagtgagctccttatatagaggtaggtatgacggttgtggaaggggaattgtccgaagtgccctgccctccaaccgtcattaggatgcaatcctagacgtccacgccaaaacctgcatccaacggcgccaggattagttcaaccgaaccaccaggttctgccgaacctggggctggcccaatccagcccaatttcggctggtggcctcctctattgctccactccatagacttgtgaattttggcccaattcgttgtgtcaattctgagtttttagcccattcatacataagtctggtcctcgacattgtccgattgatttatcgttggtgttgatgtcgattctcctccactttattgtcgttctttgcaaaaagttagtagacctgatactagtggaatattattattctaacatatttatgcattgcaagcatcactagttctctcctgttttagtaatattgacggtcgaaactgatcgatacgaccatcaacagcgaccagatgtgttacatattcaggagacttgacaaaaatggctaaagatctacaacatctcaaatattcctaactcatactcatgtgaatctagttcccagaatgtgcactagattcacactttcatcttaagcatgaatatacatagcaaaatacatctaaagcaaaaaaaactcagattacatctttaaatagatacataggccgaccgaccaaataactatatcagagaacagcggaagcttgactacccaaatcctcaagcacactgactaggggtttaccccattaagttcaaatcctagaagaagcagtcgaaacccacatcactcaacttaaactaagccttttcctgcaaaacataaattagacaaaacatggcaagactcagtattaatgtactggcaagagcactatcaaacctacaaacatgaaagctctaagtcaaaggaaggctatatgtggtttcaattttcagcataaagcaaattttagttcacaaaccatttgcaacgtaatttaagcaaaacatgttagcaatatgtaaagcatattaattatggcatgatatcaacataaatagatagacatcattcccttagaacacaacgggaagtaaggcaatcatatcacatataccaatctcatcatcatctcaaaacaattagttctcaaaagcatttagaaatcacaa

SEQ ID NO: 11476 - DNA, 14497 bp, Oryza sativa
  unsure (1)..(14497): unsure at all n locations
ctccactctagactcaactcctggagtaatatttaggagttggagctgtaccaaacaggcccgaatactctagtttgtcttgtgccagccaaagcactaccacactctacacattgagtgtggtctagaggtcataacgaggcttttacattaagcattgtctaatcttgcatgagcacaatatgtgttcttccatcctataccatactcgatatatgacctagaaccgttaagtggcgggcccatgccttaaactgaacgccgtggtgacggatacaatcggaacccaccacgtggcacaatatcgttgtattggacagacttagacgcctatgccgtgaggtgcatctaaacacccctcacgggacacacacacatagggaatttatcatcctatgatcatcacaaacacacactcatgggtagttcctctaggcagcccacagtacacccgtggccctacctatactacaacggcctcccgaatgcaaggtcagacaagtgcttaacttaataggccaaggtcatcccatactaacacatgtggatgtacggtaaacataatgggtgatatgatgttcggtccttaatcgactcaggcgaacactccccctatcggtctgcaactactaccatatgcataccacatgccgcccaagtcaaatcacatttttatctcattttatttcacaaataatcagagaatcacctctttccataatgttcaaaaagtgtttgcaaaatgtatagtaagtgaaccatagccatgtttttatttatcactaagcaaggctaagcatttgcactttataaaagcatagcatagtcatatgagcacaattaaagtactctaattaatcctaaggttcaaaacagcaagggatgatttttcaaaagggaagttatgcatatttttaggggacaactacaatctatcgtttggaagtatcgatagttagaaatacgcgtgcaactttacaatcaaaacatttagcctggaaacataggatttaatatgttcaaaggaagggcaacacttgccttgattgatataagacctccctgagaatagatataatccatctccttcaccggtatcgatttcgctgtctaaatgaaataacggtaacgataaataccaaaacatgtaaaaatctaaaatgatctaaaatgcatgagtttactagtgcggttaggtactggtctaagatgaatttaggtgaaagaatttatattttattactttgcatttgagagttattaattttcaaagtttaatactagctctagattaattaacctctaatcgtccttaggtgcattttaggtctaagttttgtgaaatgttggctttctgcagtcaaggggatgctcacaggagttcaacaaagttggtttcacaatttttaaggttagcatgattttattatgaattttacaagataggtcatatgctatagtctttattagttatttcgaattttagatatgttttgagtactgtatgtgtcatattttatttcataaaaactaagttcatggttcttataacctaagagacctgagatcacttcatttagactggtattaaattttatatgaattctagaagtttctataccgtcctttaattttaattcattattcaaattttagtgatgtttttggatatggtttcttctacagatttatatacagaacaaatgtacatgctattatcaaactaacaaattttagtttgtctcatttggagttaaaataaatcactcatgggttttatagtttctggtttacactatactagttattttaccaattaaatagttggtgatgattttatacagaaagtatcaagttttagttaatgtaaatcaaattaatgatttttttagcacactggaatttggttcactccaaattaagttaagatgaattttatatgaattttctaagttggagattgctctaggacgtgactacacagcactccacatgtagctgtcacatcctgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaatccttaaattataaattgttgtttaaaaggaattattagaaatgattttaaaagcttaaaagagaagatctaattttaatttgctaaatctcaacataaaattgggccagataaaattttgttaaatactttgcttaattctataattcctagatttttctgggatttatttgagctaaggaagtatttttaataaatggaattgcatttaagaaataattttaattgaaaaaggtttttaaaagtctgttttggctttgggccgaaagtcggcccaaaacctctctctttcttctctctctccccggcccagtcggctcaagtcggcccgcagcccagtccgccgagccgccgctctcctctctctctctcgctgtcgctgacaggtggggcccgcctgtcggacccgtcgtcttcctcgcgtcggccgccgcccgaaaccctagccgagccgcgccgccgtctccttccaaattcggccgcgtctttccatctccggccgaatcgtttgaggggaaatgatcttctcgatctcctcttccttttctcttttggaatcatcgtctttttcggtttggaaatccgtggattcgagttcgattcggatcgacttttctccctccaatccgacctttccttctcgccgccggtcgccgtgggccaccgtcgccgctcgctagcccctttaaaaggacccccgagctctcctctacccgccgccaccttcgccttcgtctctcgtcgtcggaagcgctctagcgccgtgtaacctagcgccgccgtcgtcgccgtcgctccagccgtgcgtcgccgccgttccagtcgccgtcgtcactcgggaaggccatcgtcgggatcgccaagttgccaccgtcctcgtccgccccttcgccgtcgccgaagatcgccggagcaccatcgccgccgttgacccgaaggccgccgccgcttcaacctcgtcgccgtcgccgtccgttgcttctccgccgcttctttggtcaccggtgagttcgccgcgtcgtcctctatccgttggtgccttccgttcgtgccgaagcgccgccgttcgccggcgagcgtgcgctgtccgagccgtccgagccgccgaaccgccgccgccggaggtgacgtcaccgccgacgtcatcgtcgccctctcccgtgagccggtcgtggaccgttcgatctcggccgtccgttttggatagggttgatctcggccgtccgttcccgtgaaccgccgccgtgcacccggtccaccgcaaaccctagccgctgacacaataatccttcttttccttttcaaaaataattcattattgcgtcataattcaattaaaatccatataagtgttttaatccgatttaatctttaaaaattcacatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcctaattcatctaaaattatgacctacatgtttgtttactttttatgtattgtttatttggtttttattagtctttttcctcgttttgcgtgatagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggaccgtttgttcttgattactttattccttgataccttgggttattataattggactagttgagcttatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgcctctggtttttgagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataagtattgatgttataactggtaataatttgcttagctcctggtttggagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagtctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtagttaatttgatgaatctgtatattaaattgttagtttgtgtacctcggctgattcctggacgaggattttatgcacaaataagttcggaaattactagtgaatttccgggcgtgacaagttggtatcagagccatctcgactataggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgttgatgaggtcaacttatggaggtcagtaaagtggatcgaggaagaaccgaagtgccaactggtcaagatggaatgaagtttgcatcctaccttagaacctatgccaccaaagtgactttgaagaatagttagtaggatagaacgtttgttgcttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtgaaaacaataacaatgaagggaacccaactcttgctcaagttctggctcaacagactcagttaatgaatatgatgatacagcagatgcagaaccagcttaaccaagggaacaacaatgctccactgccgcagaacaagttagctgattttcttcttgtgaggccacctaccttttctagcactaccaacccagtggaagcaggtgattggttgcacactattgagaagaagttggaactgctccagtgcacagatcaggagaaagtcgtgttcgcttcacatcagttgcaaggacctgcatcagaatggtgggatcatttccggatgaacagagcagaaggacaaccaatcacttgggaagagtttactgaaggattcaagaaaacacacatacctgtaggagttgttgctttgaagaagcgtgagtttagggctttgaagcaaaaggatcataccgtggcagagtatcttcatgagttcaatcgtctggcacgttatgctccagaagatgtgcgcactgacgaggaaaggcaggagaagtttttggaaggtttgaaggatgaactgtcagttacgttaatctcccatgactatgtggattttcagcagttggttgacaaagcaattcgacttgaagacaagaagaataggatggataaccgtaaaaggaaaatgactgtattccaggaggcacaaggtagtagccagaggcagcgtatcaagccactccaaattggtgaatcttttcccgctggtccaggacagtcgcaacagttgaacatcggtggtgagatcaaattagagactaatgaaagcaaagaagttaacatcgagcaagctaatcagccggtgctagttcagcaaggtcagtctcaagagaataacagtagtggaagggagcagcaggtatgtttcaactgttacaagccaggccactttgcaagagagtgtccgaagccgaagcatcagcagccgcaaggtcaggttaacaacattgttgtcacaggagccaatgcagtgccagttgcgtcttcaagagttgtgtcttcaagtgttacaactcagccaccagtttcaaagcggcagtagttttctttaaagccttagaataattatcggagttatggaataagatagactgcagtttacctatgcccttttctttctagccgttccgaatctcgggacgagattctttgtaaggggggtagatttgtcacatcgtgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaatcataattgttaagagcttttcttgtttaaaatccttaaattataaattgttgtttaaaaggaattattagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctctctttctctctccctccccggcccagtcggcccagtccgccgagccgccgctatcctctctctctctgtcgctgacaggtgggacccacctgtcaggttaatttttctcgcgccgncgncgncgcccgaaaccctagcgctgggccggcgccgccgcttttcaaattcggtcgctccttttcttctccggccgaatcgattgaggggaaacaatctccgcgatccactctatcttttctcttatggaatcgtcgtctttttcgctttggaagttcgtggattcgaggtcgaatcggatcggtctctttcctccgaaccccgatctttccttctcgccgccggtcgccgtgggcctccgtcgccgctcgctagcacctttaaaacgacccccgagctctcctctacccgccgccaccctcgcctttgtctctcgccgtcggaagagccctagcgccatggatctagcgccaccgtcgtcgccgtcgctccagccgtgcgccgccgccgttccggtcatcgccgtcgctcgggaagaccgccatcgtggtcgccaagtcgccgccgtcctcgtccgccccttcgccgccgccgaagactgccggagcaccgtcgccgtcgtcgacccgatctccgccgccgcttcttcctcgtcgccggcgccgtccgttgcccttccgccgttgttttggtcaccagtgagttcgccgcgtcgccctctacccgttggtgtcctccgtttgcgtcgtcgcgccgtcgttcgccggcgagcatgcgttgccgagccgccgccggtgctgacgtcatcgctgacgtagccgctgacgtcatcgttgccgtttcccgtgagccggtcgtggaccgttcgatctcggccatccgttttggataagatcgatctcggccgttcgtttccgtgaaccgccgccgtgcacccggtccaccgcaaaccctagccgctgacgcaataatcctccttttccttttcaaaaataattcattattgcgtcataattcaattaaaatccatataagtgttttaatccgatttaatctttgaaaattcataactaattcattgtaactcagtttaatgtggttcaagttgcaaaaattatataaaataaagatctacatattaaaattgtccataaattgaattaaatttatttaatcctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgatagcttgtcgtttccgtcgttgcgaaggttcgcgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattctttgttatggcctgtttgcattgattactttattccttgataccttgggtgattataattggactagttgagctttatatatattggttcaactagatactagatataattgcttagccatgcttagaaacattagcacacaattgggataactaatgtttcactatcacttatggttatatttaatggtagttcacgatggtcaatcgtgattggttaattaattacttgccaactaaaacttgataatggtgggttgtgagcacatggttttgagagtcatgctcatgacaattaaggaccggttcgcgagctactgttgtgaaacattaaccgtgccaaccacaagccagcgtgggcaacggctttaccttttgtataacatgattcattacggagcaccagactgagaagtggcggagataagcccacgggggtcgctggggagtccatgccttgtttatgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattattgatgttataactggtaataatttgcttagctcctggtttggagattagatctgtacagccgggtatggttgttcaggatggttgggcctgtacagcatgggtatgctgttcagtgttgattaaaatttctgattaattactccactgttttacttctcttaaatgttttgctaaatgctgcttttgcaaatgagccaatattatgccatcctttggtatccttgtgcacttgcatatttactgtgtggcttgctgagtatgtcatatgctcaccttgcaataatcaatcaacctcagttgaagaaaaaggatccagaaggagaagacgtttggcttatacccaagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacatcggctaactatggttaatgtggtatgcttttagtgagagtaattattatatgtgatatcattggaaggatttatggctgtgttatctttcctctattattgtattgcattgcatttcattcgaagttatgtcgtgaacctatggtcgcgaccgtaccggtacagcatcgtgtattgtcgtaacacgatgcagcttcacaccttgttgggtgtgaaggcaggaatattattgcatttgcattgcattgcactttagcattttggggtatggaagttatatactctattgagttcatgagagggcttctttctcctgaggtctttgcagatctggtttatcctccttactcttgaacctatgaacactagatgtttgcctttatatttaatgttatgttcctttgttttcttataaatataatttaatgatttggtaggttaaataacttgataaaataattctcttgctgagatttattctcacacccctacagtgttttcaggtgcttaaagtgacatgctcgcttggggaaaacgggagtagaagcacagctgcattccacactgccaccctaatttttaaagttgtcatgatttttataataaaggaattgtacccttgttaagttgcactagatgaatctgagagttgaaattagtttatttcatccctgaatgttcctttctcctttttttttgtagatggctacttgcaatgctatacttatatttgacgcttccgcaatgcttatgttttagaggagttgctgtcgaaatttctccttctttgttaaatgtatgtctatttagtagcatcccgatgtctttgtagtttctggggtgttacaaagatcatccgcagcattgttatcgccagcatccctgtccacctcgcccgtttgatttccttcaaatccagcgtactgagcccagtcgggaatgttctcgtcctccacttcatcttcttctatttcaaccccttgctcaccgtgggatgtccaacaattatagcttggcatgaaccctgactcaaacaggtgaaaatgaatagtccaggatgcagaatactccttctggttcttacacttattgcatggacaacaaataaaaatgaatagtcctggatgcagaatactccttctagttcttacacttattgcatggacaacaaataaaaccgttacgcttgttagcttcggccactctcaaaaaataatgcacgccctcgataaactctttggaccgccggtcagcatacatccattgccgatccatctacatgaaatgaaaaaaaaatcatacataaataaattttgatacaataatgacagtcaaacagtaatgataaaataatttaaaactctttcgacgagcaattcttattaacaatttttgaagttctaaactaatattaatgttgtacttctcttaattttcaatttagtttgttttctattttttaagattaattttcatcatattttaaactatgagaataaaatttctatatattcttcttccccacataaattttctctctcatcaacttacaacaaagttttgtagaaaaaaaaatgtgtgaaacatagctccaaaagtaatataacaagaaaaaaaatattggaggatgaagttactaaccttttagacatatccgatttgtatataattactaaaaaattttcacaataaattttggcatgacctcctctttctttgagaaatttaagcttgctctcgggctagagaaggaagaaggcatatatacgggggggatctttattcccttggtgttaccaaccaactggggctaaagatcggatctttagcccctgttagtaacaacaaccgggactaaagatcccgggggccctgacaacatctgacatctctacaaccgggactaaagatgatctttagttccagttgatgttaccaacggggactaaaagatcacatatacgcgttgtagccgccgaccaaagttggtttctccacgggcgggagttgcagcttcatcactcttcttcgggtgcttacgtgccgcccgccctcccgttagctagctagggaatactatgtctgcttgcttgatccactgagacatgcttctagttatatattactaacttgaaatgcagtagctataattagttgttgataatactattcgtgaagagtgtctcgatcaaggttaatgaactatagttatatatgctccacggagacatgctgttagttatatgctacaagtgataattaattatactccctccgtttcaaaatcttactatttttgaccctgacacagtctatgagatactactttgaccaccaatatttataaaagtaagatgttttaaacaaaaattaattatatattatgatagtttgcttaatgataattaaaatatttgacttgtcattaagttaaaaatatttatattttaggacggagtgagtaattgttataattagttgttggtgtgcgtgaattggttggcaaaaatatccgatcgagcgcgtcggcaggccaaatgcatgcattctgcagactcttgcagcatgtgaagctccaggacaagagtgaccagctaaggcacagttcgcgtcacgcactttttgcatgattgcatccgggttccggtgatacttgttgcccaacactggagacaagcacaactgataaaacacgcgcggcccatttcatcctgtgttaatagcccacggcccatctcccttcccaccttatcctacctaggaataagttcaccggaggtccctcaacttaccgagttctttgaggttccttaacaacaaaaaccataaatgtgtacatcaaactcacttaaaccgttcaaaggagatccatggcagtatttttgactggttttgctgacgtggcatccaagttagcaaaaaataaaaaataaatacgtggggcccacatgtaagtgaaaaaaaatgtgaggtctctcttttcttttctttttttttcttctcttctcttctcttcaaatccaaatctaggcctgcggtagaggtgttagaggtgacggcggtggcagcggcgcacagccaaaggcaggcggagcggcggcggcagcgagtgagtgcgggtgcggagcaacggcgtcgtcggcagcaaacagtgggcgagcgcgcggtggcgggcgagcggcggctccgggttgccgccatcagagttagtaccgagggagaaggagggcgcgtcaggaacctcgtaacttcaccattgctcctcccagtggtgctcctcatcaccgtcgatgtcgagagagaaggatggtgcatcgagagcctcataacgcttctgctcctcccctccattgccgttgtcggtgaggtgggactcatcaccgtcgccctcaaaatcgattccgagagagaaggatgaagtccatctgctagcaacggcgatggagggatttggtggagaactcagtaggttggcagaggggggaccagcggcgagcgagagcggcagaaggcacaacagcggcgagaaagcatggcagaggggggaccagcggcgggcgagcatggcagcgggaggagtagagtggctggagtaggccgcaaaggggggacggctgcaggcgacatggcaaagggacggagcagcggccgccgcgacacttctcgagcttctcaagctgtagctgccgtcacgcttctcgagctccacctccacgagctccggccctcgatctcctccaccagctgcggtgcctccaccgccctccgcgtctaaccctgctccgcccggcgccgaccccgcaccgggtcgagcacgcggcacacgaatggtggcggcaacacctaatgccgcctccccctcgctttcccgccggccgtttcccgcccctcccgccggccacctgccccactcccaag

SEQ ID NO: 11477 - DNA, 3415 bp, Oryza sativa
caccaaaggtgtcgggctaggatggcaagctcgccgaagattggatgatcggctgcgaatttggagaacatgtacgcgtagagtcggccgagccgaacccaacggtactcaccctcgagccaaacgtcaaacgacgacgtccgtcgactaaggggcggcgacggcggctcgggataaccggcgacggcgagctacggcggccggcgacgaaggagaaggtgcgaccgagcttctcgtcgctcccacgcacctaatggcggtggcggcaagcggcggcgacggcggagacgtctgcgcggcggcgccggagatggccggcgacggcggcgaggctaagcagcggcggcgcggcggctaggaggcacgggagaggacgggagttggggcaaacgaaagaggaggactagggggtcctagttatagccttggattgaagagatcggactcctcctacaagaaatcgatccgggaaatcaaaaactcggttttggagataaactcaaaaacgagttcgattcggataaaatactcaacgattagctccgatttttgggggtaaagatagaggaggataagaggaatatttcccctcaactaatttggaaagaggagcaacgaggaggccggatttggaaggaggagcggcacggctgcacaggctcgggacggctcggctctgtccaggggttgaagacaacactgtagcgagagggaggacaaacagacttctatgcgggctgagaggaagggacagaatgggctggattcggcccaagctgagtaggaggatttttattacttttccaattaaattaatcaatgaaatgatctttgaattgttaaaaatacttcctatgcccaaataattccaagaaaaatcttgaaaatacttggacactcaaagtacttaacaaaattataatcagaccatttaatgattaatttaatatgtggattattactgaaatgttctttgtattattaaaattaggaattgagctccgaaaaatccgagaatattccagagagtataattaaccatggagaatttaaaaaaaaaaatccatccatgctttatatttaggaaattttatttcccacatttaacttcacttgtaaattaatgaacatttaatataaattctaataataatttattaaataatttataaatcctaaaacgaaaatcagggtgtgacaaatctaccccccttacaaagaatctcgtcccgagattcggaacggctagaaagaaaagggcataggtaaactgcattctatcttattattccataactcagataattattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttgtcttcggacactctcttgcaaagtggcctggcttgtaacagttgaaacatacctgctgctcccttccactactgttattctcttgagactgatcctgctgaactggcactaattgagtagcttgctcaacattatcttcattgctttccttagtctctgatttgatctcaccaccgatgttcaactgttgcgactgtccttgaccagcggaagaagattcactaatttggagtggcatgatacgctgcctctggctactaccttgtgcctcctggaaaacagtcattttcctttttcggttatccatcctgttcttcttgtcttcaagtcgaattgctttgtcaaccagctgctgaaaatcaacatagtcatgggagatcaacgtaactgacagttcatccttcagaccttacaagaacttctcctgcctttcctcgtcagtacgcacatcttctggagcataacgtgccagacgattgaactcatgaagatactctgccacggtatgatccttttgcttcaaagccctaaactcacgcttcttcaaagcaacaactcctacaggtatgtgtgtcttcttgaatgcttccgtgaacttagcccaagtgattggttgtccttctgctctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacctccacttccacttccacttctggtgcgcgtgttcaccatctgttgcatattagagaagatagaaggagaggggttacactaaagacaagaccttaaccagtttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttagcggcataggttctaaggtaggatccaaacttcattccatcttgaccacttggcacttcggttcttcctcgatccactttactgacctctataagttgacctcatcaacatcttctagtttcaacaactagtttcagaactactcaagttgaacgagagaggagagtagacaatgaaacaatttgcaaagaattctagataaggaagaaaggagaaattttcacaaatcatttttgttggaaaaattcgtccttaaagtttgaccatttggcttatcctacagtcgagatggctctgataccaacttgtcacgcccgaaaattcactagtaatttccgaactaatttgtgcataaaatcctcgtccaggaatcagccgaggtacacaaactgacaatttaatatacaaatccatcttaataataacgttacatacttacaaagaaaagaaaatagcagcggaattaactgtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacatggattccaaaggatggcataatataggctcatttgcaaaagcagcatttagcaaagatttaagataagtaaaacagtagagta

SEQ ID NO: 11478 - DNA, 2519 bp, Oryza sativa
acaaattttatcttagcccaatttatattgagatttacaaattaaaattagttcttctcttctaggcttttaaaatcatttctaataattccttttaaacaccaatttataatttaaggattttaaacaagaaaagctcttaacaaatataattagatcattaatgatcaaataattactgaactgttctttgtatcatttaggaattgagctccgaaaaatctgagaaaatttcagagagtttacttaatcatgaagaatttaataaaaattaaatccatccatgctttatattaaggaaattttatttcccacatttaacttcacttgtaaattaaagatcatttaatacaaattctaataataatttattaaataatttataaatcctgaaacaaaaatcaggatgtgacaccctatcaaggatcctaaattaggtaggcacccaaataatctttccaagcccccagtctcaggggctctactgcacagcccccatccacggttggaaaagctcgggagctgcccgacgtggtcttggtccgccggcacctcccctgcccagtgctcattcccgcccggtgcggctcctccctgcctaccgtgtcatccctcaagtgcattcctctacccgacgctccttcccggccgacgcgtctgctgtacctggagtctcctctagcctgcaccctctgcctgaactcgatgaaaaacatggcccagtggccgagtcatgcgatggcgtcgaggcactggatgattcaagtgttgttgcaggctgcaaaattgagaaagtagtagcagggtagcactagcagctgcgattgtgggacttagaagaatggggaaagtgatacatgcgatgtgctatgcagcttttttgttgttttgcttggttgttgcttcgtgagagaagtagctggtctatgggtggatgagaagacgggaaaaatcaacacatgtgagaaaatgcatggaagcgctacagtagcagaagctcgtttcacccgagctatgaatacatgctactaggatttgtatttccattttattttttttaaaagaatcgaatttgaattgtgaatttaaatatggttggattattatggttttatactaggagtagcgtagagtatagaactatacatttgtactttaaagtatatgttaaaatagaagatgaaatgaaataagggacgagaaaagggactgctgctggagttaaaggtattttttaggtacttagaaaatgggggaagcccccattaaatttttagaggctgtaaaataggagctattgctggagatgctctaactagccaacacatggatgtcccactcgtataagagcaaatttaatagtatagccaactatcaactctaaatcatctaaagttaatctaatagtcaattcatataatagttacatataaatatatattggtcccacctgtcatacacatagtgtcttagaatccgtgttgtagcaagctacaaatctatagcccacgcttctcttctctctcctctctaatctcctccatatgcttatagctaacttatagtctattattcacactagtacagatcctctcatctgtgacggcccatcacatgcctgggcaacgtggcccgtcaaaacaaagtcatctcaatcgggcctaaatttttgccgttgtagatatactcgtcggggtgcatattcctatagcccgtcaccgatgacactcatttgtgacaggcttgaagttaggcccgattgagatgacctccactatctcaatcgggcccaaatactgagcccgtcatagatgagtgtcatcggtgacgggctccaaagaaggcccgattgagatggcctgaatgcccgtcatcgatgactcttatcggcgtcgggcttctatttctgcccgttagagattagtgtgcgcccgttagagatgacttttttttggcccgattgagatatactttgcacactatatatactccagcagtccgttgtctgtagttatcccactaataactattttggtgggaggttgaagggggcgaatttttgtaatttttttgcaaacaaaaacatgaaaatcataaaagtaagtaaaagggtactaataatttcctattaatttagtagtacttatgttatgagatgttaactaatattttgttcattgttcagcgatggatcaaagttggatgtacatgactggcttgaggcgtcagtacaaggagtatagagatggcatattaagttttatgaaagccgcagtggaggataggataagaagaaacgacaagtacatgtgttgtccatgtagcgattgcaggaatgagatttggttggacgatgaaaaggaagtacacgctcacttgatacgccggggattcatgaagagatacacatgttgggtgaagcatggagagcaagatctgggtactgatggtgtagctgcggatggaagtggtgcagacaatcatgaagaaggagatgaagacgagcatgacatgtttgt

SEQ ID NO: 11479 - DNA, 31909 bp, Oryza sativa
cgtgaacgtgaaatgcaatatatatatgttacttcgcatttatcctaatacatattttttgtatcttgcagaaaagacgtgttgtcggagtcgtccctcaagccggagtggaagagctagccctagaaggaattcgtgcaggcaagtgaagtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagaacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatctgtcacatcctgatttttgtttcaggatttataaattatttaataaattattattagaatttatattaaatgttcattaatttacaagtgaagttaaatgtgggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaaggataccaaaggatggcataatagggttccatttgcaaaagcagcatttaataaacatttcagaatttaataaaacaattaagtaataattaaacaatattaatccaacgctatacaacataccctgttgtataggcccaacctttctgaacaaccatacccagctgtacagatctatctccaaaccaggaatataccattccaaaccaggagctaaacaaattattaccagttatagcatcttttactaagatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcattgactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaagaacaaaaaggctataacaaacaataagttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacgatgacgtcagcagtgacgtcaccaccggcggcggtggctcggcggctcgggcttgcatgctcgccggcgaacgacggcacggcggcgcgaacggaaggcaccaacgggtagagcgcgacgcggcgaactcaccggtgaccaaacgagcggcggaagatcaacggacggcgacggcgacgacgaagaaacggcggcggtcttcgggtcgacggcggcgacggtgctccggtggtctacaacgacggcgaaggggcggacgaggacggagacgcgacggcgaccacgatggcagccttcccgagtgacgacgacggctgaaacggcggcggcgcacggctggagcgacggcggcgacggcggcgctagggcacacggtgctagagctcttccggcgacgagaggcgaaggcgagggtggcggcgggtagaggagacaccggggagccttttaaaggggctaggaggcgacggcgaaggcccacggcggccggcgacgagaaggaaagttcgggaaaatcgaatccgaaacaaactcgaatccacgaatttccaaacgattttagccgatgtttccaaaggagaaaaggtagaggagatcccgaggatcatttcccctctatcaattcggccggaaacggaaaggagcggccggattggaaagcggcggcggcggcgcgaaactagggtttcggccggaggaagacgatgggccccacctgtcagcgggcgaacgcgcgcgcgcgcgacggcggactgggccgacttgggctgaggagagagagagcggttttgggccgactttcggcccaaagccaaaagagactttttaaaacctttttcaatttaaattatttcttaaatgcaattccattcattaaaaatacttccttagctcaaataaatcccagaaaaatctaggaattatagaattaagcaaagtatttaatgaaattttatctggccccattttatattggaatttattaattaaaattagatcttctcttctaggcttttaaaattatttctaaaaattccatttaaacaacaatttatatattttgaattttcagggtgtgacaggaaataaaatttcctaaatataaagcatggatggatttaatttttattaaattctccatgattaagtctactctctgaaattttctcggatttttcggagctcaattcctaaatgatacaaagaacagttcagtaattagttaatcaattaatgatctaattataagtgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaatagaaaaatgtttttaaatcctccttttggctttgggccgaaagccggcccaaaacccctctctctttctctctccctccccggcccagtccgcccagtccgccgcgccccttcctcctctctctcagccgctgagaggtgggccctacctgtcaggcccgtcttcctcctcgcgccgctgccggccgaaaccctagccgccgccgctttccaatccggtcgatcctttccgtttccggtgaaatcgtttgaggggaaataatctcctcgatctcctcttccttttctcttatagaaacttcggtcaatttcgtttggaaatcgacggatttgagctcgattcggatcgacttttctccctccaaccctagctttccatctcgccgccggtcgccgtgggcctccgtcgccgctcgctagcccctttaaaagcacccccgagctctcctctatccgccgccacctttgtcttagcccgccgtcgcgtctagcgccgcctccgcgtagccctagccgtcgctgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgccgccgcttcttcctcatggccggcgccgtccgttgctcttccgccgtggttttggtcaccggtgagttcgccgtgttgtcctctacccgttggtgtcctccgtttgcgtcgtcgcgctgtcgttcgccggcgagcgtgcgaggccgagccgtcgtcggtgatgacgtcatcgctgacgtcaccgctgacgtcatcgtcgccttgtcccgtgaaccgcggtagatcaagttgatctcggccgtccgttttggataggatcgatctcggccgtttgtttccttagaccgtcccgtgcacccggactgcctttgatgacgcaataatcctccttttccttttgaaaaatagttcattattgcgtaataattcaattaaaatccatataaatgctttaatccggtttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatcttgtaaaattcgtaataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgtagaccgaatattgcaagtcaagtcacacagatcctaaacacaatcctttgagcattttgatcctatatttaaattctctatttatttcaactgtgcatttattttcgaatgtcactgggtggtgtgaatctattcctttgttatggcctgtttgcattgattactttattccttgataccttgggttattataactagactagttgagctttatacattggttcagctagatattagatgtaattgcttagccatgcttagaaacattagcacactattgggataacttatgacttattattatttaatgatggcttaatgatagtttacgatggtcaatcgtgattggttaattaattacttgccaactaaaacttgataatggtgggttgtgagcacatggctttgagagtcgtgctcatgacaattaaggaccggttcacgagctactattgtgaaacattaaccgtgccaaccacaagccagcgtgggcaacggctttaccttttgtatagcatgattcattgcggagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacatatcacaccctgaaaaattcaaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaagagtctcttttggctctgggccgaaagtcggcccaaaaaccgttctctctctcctcggcccaagtcggcccagtccagtccgcagccgcccacgcgcgcgcgcccccgcctgtcaggtcgtcgtcttcctcgcgtcggccgcctcccgaaaccctagcgctgcgccgccgccgtctccttccaaatccggccgctcctttccttctccggccgaattgatagaggggaaatgatcctcgggatctcctctaccttttcccttttggaaacatcggctaaatcggcttggaaagcgtttgattcgaggtcgaatcggatcggcttttctctctccgagcccgacctttccttctcgtcgccggccgccgtgggccttcgccgtcgccctccaacccctttaaaaggacccccgagctcttctctacccgccgctaccctcgccttcgcctctcgtcgtccgtagcgccctagcgccgagtagcctcgagccgccgtcgccgccgtcgctccagccgtgcgccgccgccgttccggtcatcgccgtcgctcgggaagaccaccgtcgtggtcgccaagtcgccgccgtcctcgtccgccccttcgccgtcgccgaagaccgccggagcaccgtcgccgtcgtcaagccgaagagctccgccgtttcaacctcgtcgccgtcgccgtccgttggtcttccgccgctcctttggtcatcggtgagttcgccgcgtcgcgctctacccgttggtgccctccgttcgtgccgaagtgccgccgttcgcaggcgagcatgcgcgtccgagccgccgagccgccgccgccggtggtgacgtcatcgctgacgtcatcgttgtcacatcctgatttttgtttcaggatttatagattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattgttaattttaatcatacaaagagcagttcagcaattgtttaaatattaaattaatcattaaatggtctgattataattttgttaagtactttgagtgtccaagtattttcaagatttttcttgaaattatttgagcattggaagtatttttaacaattcaaagatcatttcagtgattaatttaattggaaaagtaattaaagttcaccttttccttttcgggccgaattaggaaaagtcctctcactctcggcccagtctcctctcagcctgcagcccttttcctctctttcccgaagtctgctttatttccctcctttaatcagtccttggaagtagaagcccagccgaaagtctagtttgcctccctggcactattcatcttcaagcttggacagagccgagccgccggtgctgtgccctgtgcagccgccgcttcctccgttaaatccgccacatcccgagctccgtttgcaaaatttgttgaggggaaatattcctcttatcctcctctatcctctcccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgttttccccctctcccgtcctctcccgtgcaccgtagcccgccgtcgacgccgcatagtccgccgccgccgccggccgggttgcagccgcgccgagtcgccgtcttcgccgtcgccgccgcttgccgccgccgcctttaggtgcgccaaggtgaagagaagcccggccgcacctcctccttcgtcgccggccgccgtagctcgccgttgccggtcaagccgagccgccgccgccgttcatctcgtcgccggccgtcgtcgttcgtcgtttggctcaagggtgagtaccgttgggttcgtctcgtcgttctccacgtgtacatgtcctccaaatttgcagccgaccatccaatctccggcgaggtcgccaacccgggccggccattgatgatgtcatcatgacgtcatcattggttttttctttttcccgtttttctaatagattaaatcttctgaaaatcataactaaataactgtagatccgattcgagtggttcaagttgctaaatttttctaaaatcaagatctactgccggccgggttgcagccgcgccgagcagccgtctccgccgtcgccgccgcttgccgccaccgccattaggtgcgtgggagcgacgagaagctcggccgcacctcctccttcgtctccggccgccgtagctcgccgtcgccggttatcccgagccgccgtcgccgccccttcgtcgccggccgtcgtcgtttgtcgtttggctcgagggtgagtaccgttgggttcgtctcatcgtcctctacgcgtacatgtcctccaaattcgcagccgatcatccaatctccggcgagcttgccatcctagccggccacctttggtgatgtcatcatgtcatcatcggttttttctttttcccgtttttctaatagattaaatcttcggaaaatcataactaaataactgtagatccgtttcgagtggttcaagttgctaaatttttctaaaatcaagatctacatgttaaaaatatccacatatactgtttatgcttttttttgtactgttttgttgatttttattctttcgctttagtttccgacgttccggaggagagcgttttcgttgagcaaggttcggaagtgtttgcggaagctcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttatttttctatgggttataatttgattagcatgaaccttatatattggtttggttcagttaaatgctatatgtatgtttgcttagccatgcttagaaacattagctaattaaaggggattaaatataaattatattatattattcttattaattatggttatatttaatggtagctcacgatgattaatcgtgtgatgttaattaattgataattaaaacctgtttaaggtgggttgtgagcatatggttttgatggttgtgctcatgacaattaaggaccggttcgcgagctactgttgtaaaacatttatcgtgccaaccacaagctagcgtgggcaacggctttatcttttgtatagcatgattcattttggagtgccagactgagaagcggcgagaagtccgtgggggtcgctggggagtccatgcctctggttgtagagggggtgattatgatccaggaacggtgcactgttttgagttgtgttgtgcagagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatccttcggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacagtttagtggtgtgagagtcttcagttttgtaataatgaaactcagttaagatcaataaaagttaaagtaattctctgtcctaagtagtttcccccggtttctcttcttgtgccctgtccatgccagatggtgctcactcgcagcaacgggaatggccccaacaacaacaataacaataacaatggagagaatcccacacttgcccaagttcttgctcaacagactcagttaatgaacatgatgatgcagcaacttcagaaccagcaaaaccagggaaataactatgcgcctccccaaaacaagttagcagaatttcttcgtgtgaggccgcctattttctctagcaccactaatcctgttgaagctggtgattggctccatgccatagagaagaagttggatttgcttcaatgcactgatcaggagaaggtctcatttgcatcccatcagttgcatggccctgcctctgaatggtgggatcacttccgtctgaataggactactgctgaacctatcacttggcttgaattcaccgctgctttccggaagacgcatataccatcgggagtggtgtctctcaagaagaaggaattcaggtcgctcactcagggatctcgctctgttacggagtatctgcacgagttcaatcgtcttgctcgttatgctccggaagatgtacgcactgatgaagagcgccaggaaaagttcttggcaggacttaatgatgagctttcttacccactcatgactggggattatcctgatttctagaagttagtggataaggctattcgccaggaggacaagtacaatcgcatcgagcagaagaaacgtcggattgctcaattcaagacacaacaggggaatagtcagaggccgcgtcttactttaggaccccagtccatgccacagggaggttcttcgtctgttgttcgtccgcagcgtcagttcttcaacaacaatgctggcaacaacatccgcaatcaagctctacgccctgttgcagcctcgacacagcaacaacctgccaagagggagcaaggcagaaagcccgtggtgtgtttcaactgtggagacccaggacattacgctgacaagtgtccgaagccccgacgcgtgaaggttgtccctgctcagagcaactctaccgcaccagcgccaaaggcccgtgttaatcatgtcgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcctctctgtcagaatagaaattcaaggagtaccatttctggccaatcttatcctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtccttaaggtcaagactgaaccaaataactttggaagagattcctatagtccgggagtatcccgatgtgttcccagatgatttacctggtatgccgcctaaaagggatatagagttcagaatagatttggtaccaggaacaactccgatccataagagaccttatagaatggcagccaatgagttggcagaagtcaaaaggcaagtagacgatttgcttcagaaaggatacatcagaccgagttcatctccatggggagctccggttatttttgtggaaaagaaagaccatacccagaggatgtgtgtggactatcgtgcactaaatgatgtgactatcaagaataagtatccgctgcccagaattgatgatttgtttgatcagcttaaaggtgccactgttttctccaagatagatcttcgatcagggtatcaccagttgagaatcaaagaggaagatatacctaagacagcttttaccactagatatgggttgttcgaatgtactgttatgtcttttggacttaccaatgcccctgctttcttcatgaacttgatgaataaggtgtttatggaatacctagacaagttcgtggtggtctttattgatgacattcttatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggagagtaaacgtcacaatgcttgaccaatatccacaagaaacagaggacaatctcgtccatctcctgaaggcgcagcattacaagacgttcatactgttgccgtacaacatagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgacttaatggataaaaaagagtctacgtttgactattttttcgaacttatagacaggtaccgtcataagttcctctgttaattaagaaaatcttgttatgttaattgctactacgaatcatagctttaaactccatgtagggcttggtatcgattccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaactaacttgtgcagctattacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactactacgtcgaaatcgtagctatctaggacatataatggattgtaattaatacatgactacatatgtttctatatgcatgtgtacacattttctataatgtaaatatattttggtcatatatatatatatatatatagtaaatttgtttgtatatatacatatgcatttgcataacatatatatgtataagtacacagggccatgcaaaaaaaaaaaggtcagctcgatctttagtcccggttggtaagatcgatctttagtaccggttatttcacccgggactaaagataaagatagcgatctttagtcccggattggtactcccggtttggaaaccgggactaaaggggggttataaaccgggactacaaagggtttctccaccattgacagactcaaattttcagggaaaatgttttgcaaaatattttagttgcactcttctcgattcttctgttgaagtgatgttgccttctcttaatttcttttaacttggatttaaactttatttgcaaagttaatcgctctcttttaaaatgtaaacctctctatcactactaggaaaatgatttgttgctacgaaaaaaatcgtggcaacaatgctaaaatcgtggcaatagatacatattgccaccattttaaaaccgttgctagccgtggcaatagaaacagtagcaataggttattgcaacaatttttatctagtggcaacaaactttgataatgccacaaaataatcgtggcaaaaaaacatattgcaacacttaacatcgttgcaacaaataattattgccaccacttcgtgcgtggcattagttgtgcttgccacaaaatagtttcgttgcaatatctaatatatgttattgccacatagcattaatcgtggcaatatatcatatgggttattgccactaaaatatttttgtggcaataagtattattacaatgaaatgaatttcttctagcttttatagaaaagaaattgtgttacatcagtaattggatggatcatttggtactattgcaacatgagtagaaatatatgttaaatggcaaaacccttgcaactcatgcgcacaagaattatgatgtctgatatttccgcgaataagacataatatatttcagatacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacagtaacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattagtgctcactatatctgacattttttaagccatgcccctgttatttactgacttgtgagacccactgaaatatatatgctttgttacatatgtggtggctatatatagtactgtgttgctaatcatttatatggcatgcatgcttatcttagttagctcagataaacaaaacaaaggtctatggggcagtaacagaagcttagatgccccatatactaataaactaaacaggcaactgtttttgtcagcaaaggggacgtgccaaatactaatacaatccaatgagttaagtagcaaaagtaccagatcattacctggatgctacaccaaaccccgagctgatttagatatttctttcattcattcttccattttctcctctggcctgttacaggatttggccatacacaataagaaattattttttttacaaacagaccatgagcaggaaaacatattgtaaatttttttgcaaaagatcatttcaacatagcagcttgctgaagatttgtaattacctgatcagttcgggaccgtacaaaatttctagcaacattcctaagatgttgtgaagaaatattttgccgggtagtacttgttgttccttgcaaattagcgccgttaaaaagtgctttcacaactgtgttgttctgaatgcttcgagccttctttgttgtgtcatgtggttctctattctcagttggacaatctattgccagatcagacttcacaccataaaacaagaaatatatatattatgattccacatttgacatatataagatatcaaatattggtgaatgtgaacattttggcaatcattacctgttgttccgatgctacgctttgcgtagtaatcattttgagaatatcctcccgtagcatttccctttccttacgttcttctgaatcttcccgtgacattgtcatcatctgaatcttcaccgtggtaaacccactgtatgtaactttcatcgaatccattccttagcaagtcactttgcacttcggagcgtgttttgtgcaccacattaaggcatcttctacatggacagggggcattatccccaggattatcatcttgaaatgcaaaatttaaaaattcctgcaaccctttttgccactctgcagttgccctactcatgcgcatccaactcctatctactgacatgcttcctgcttatcactatacaatattactaatagtatcaaaccacccatttaatgaaaaaaaaacaaggaaaatatggttggcactttatgatcttaaggaaaatggagaaactgtgtgaacataaactcaccttgccagaacttgtctctgtaggctgaccagaaaaaatattcctgtacaaagatatgaacagataaattagaactaaacaaaatcatgaggatttgagctgaaaaatagacattggacagtaacagatatattggtattcccatggaaggtgtttcttatttttcaaaattcatatgggaaattggacaaactgaagaaattaataaatatgagagaccgtgtatagcaaatttggatattgtgcagtataaccaaggtaaccttgtgggagacagaaattcagaaacaaagacagaaattcagaaacaaacataactcatctgagctattctacgctagcaatgctcgccctgcctgctctgcttgcctactaagatagctaatctgaagttctaaactactcactgtcgctgccgctgcggccgtcaccccatctgcagcaagcaacatcctttgctctatgttaccgagatacagggatacggatatggataggatacatcattttctgaaaaacatggatacgggatacgtctatatatgtatacaaaaataatatgaatttatgcctgggaaatcaatagcagtagtaaaaaaaataaatcatgtcttccagtctgatttctctctatcttctccaataactcaatttaattacctccacaacccattggatggcagctttgtgccctggcctacgtggtagtgtggtggcgatggcatagggcgtccggcggtggaggcagtgctacgcccagcggcggcggcggcagcggcgcgacgcggcatattcggcatccgacgatacacccggcttccgtcaacggcagcgctgcgctcggcttccatcgacggcggcggcgctgcgtgcaacttccatcgatggcgccgcggccgaccccccatctgcagcaagcgacatcctccggctccgcttcctcgtcgacgccggggccgaagccgaccctgtgtaccctcgcatccttccattgtagtggctctctcatgcgttgactgaaccctcgtcttccccagcgaaccctcgtcttccccggcggatgtggcgcctctagccaggcacctcgcttggatccctcccgcacacatctccggcatgttgcttgtggaactagggctggaggatcagatcgggatgaggaagatgaattggaggggatgcaggcgtcatccggtcgccggcgcaagtgaggcggcacagaaggcggtgagcgccgacggattgggaaatttggctagaccgtgaaaaaagaaattgtgtattcgaggaggatgaggggatgaaaacggaggatacctgaaggctgaaagctgaatcactgaacggagtggaggaattcctcgtgacgcggttgacggcggcaccgtcgcggtgaaatcaccaggcgctgctcctccgtgagactttggaagtcacgggagcactgcccagccgtgtgaatggaatagattagattgataaatagtactaataactgaactaactttttcgggagttaatcgatcttttcacgcgcccaaaaccgcgaaacacagaaatatttcgcgctaaattttgggaggttcggctgagtcgtggcaaatattgtgtgcttattgccacaaaaatcgaagtcgtggcaatagggcttgtacgttgcaccgatattttttttgtggtgatagcttagtttttattgcaacgatattttatttgtggtgataacttatttttgttgcaacgaaaataaaagatattacaacgattatacatcgttgcaacagaatatacttatttgccacgaaaagttttatcgtggcaatagtatgatatattgccaccaattatttttcgtggtaatactttcgtggcaatagctaatttttcttgtagtgtatttattttctttaatctctaactttagctctagattatatttcctttgactcctttaccgaacatctccaacatccacaaatacccttttcattcccgctcaaccatctctagagccgctcaaccatctctagagcacatgaaatatcaatctctctagagttaatacctttttcatttagagcttaccatacaaccagcaaaaccagttttatcttccaccaaatatttcccctttgatctctacccaaacacatgaaataccaattcttaatttccccataaccaaaaccttccctttggatctccacctaaatattcccatagtccatgagatatccttttcaatatccctctaagtcaatatacctatccttcagaagtttaccaatctaccactaattccgttcctataaaaatccccatccacatatatttctgaatccagttctatactcccacaagtatttcccctttgaaatctcgttcatctaaattatccattcaagatttcaaagactaccatttaacttgggccaataattccctgattgacccgactctttgttatatcccattaaccatttttatctttggggttaaaccagtataactccctttccgttggaatttaatttggatcaacccctatctaaacctaccctctaaaacctttgtcttcttttaatcgatccaaaatattatgtgttcaagttcctattttaatcaagccaccaatttgattcctacggcttgatttcctcctcggcacaagaactatactatcacaaataattgagtgattgctcttgtgctaagaaacttatttctaatcccttctattcaaaatccaacttcctttagccacaaatattccaccaagaatccataccacatataatggaggttaaaatcctatttattttacctccatccattttaccaccatcccaaaaatttatccaaagttagaaattaaattattgcctttctttccctttgatttttttaaaatattaaagaaaatctttgtgacaagttttgtatttggttcttattgaattctattggagcatgttgatccttattgaattcttttaaaattggagcatctttatttttatcctttttaaaatttatatctcaaaaataatatctttgatattattttaaaaatattttaaactcctttttgctttcaaaactttatatttaaattctttttataaagttcaaaagataccaaacattcctcttttaaattttatctccattaaaatctatttcaaaccttccattcaaaaattcccctagttttcaattcctttgaatcctattcaaatttcttgtccaaagttaaaaagtccaccaacctcttcctttagatcaatttcctttgaattctatttgaattccttgtccaaatttaaaaaatccacaacaatctatcctttagttttcatttcctttgaattctattccaaattcttccacacaaaattctcatgtttcctattcctttggaccaaaaatccttcattaggccgattccttctttcctttctttttcctccttttccttccacctctactctatcttgggctgcgcccggcccagccgagccgaagcccagtcgagccgcctaattctcctcctctgtgggcgcaccacggcattgtgccgccgccgccaccatgggcgtggccgcctcgcccaatccgacgcgcccccggccagttgcgccgccgtgccacccgctgccggcacgcaaacaccgtgccgccaccgatgcaaaccgggggcaccccgtgccgccccctaagcctaagccgccgccgccatagccaatccgcggccgccgctgctccgccgccatcactcaccgattcactgctgccgcccgctgttcccgtcgccgccactcgacgccgcgccacgacctcggttgcgtgtcgccacagccatcgcccaccgctttcgccgtccaatcgggagccgactcccatctcgccggctctcaccaaaccggctcacacagcgccgtgccgtgtgtaccaaaattgaacacttgattttgcaagtaccacaggatcactcattcaatgagatgagtaactaacagtagggaaaagaacaggaatacaataatgaagcatgcaacagcagatcaatgctgagccatttgcgtctggccggacgacgaccggcatcctatgaaatcgtacgtgaacatgtttaggttgcgatacagacaaattcagcatggagatgaccagtgatcatgagtgtttatatgcctggaataccgtaacaatactgaaaaaagacgagatcaactgagtgttcaacctactccatcgatgtacatagaacaactgctgaactgcccaataatttccaagcatgcatgcgtacatagggtgtgaagatattatcatgcaccctgatggagatatcttacatgcccctgcactggtaacgggatttgcagccacggccagtgtacctgtctccgcgaccagggcaaatagggttgcaagccgcacctctgccaagcggtctgtagacagtgttgccaccttgtagcacccttctttgcgggtacggcaccgaatccatctcacttagttcctccgcgtggcgggtgcgcttgccgccggccacggcgacgccgacggtggcgtgatcggcggtgagagcgccggcgccgctcaggaggagtaagaatgtcatcactacaatggaggagatgagcagtagcagtggcttcatcactggttattcggcgtttccaacgctgccaactagcaagctaccttagtccagtcctgtatatatagggtgtgtttagtttatgttaaaattgaaagtttgattgaaattgaaacgatgtgacggaaaagttgaaagtttatgtgtgtaaagaaaaagttgagaaataaaccatgccatagttgggcactgcttgcactgctagctagtagtaacaatagtgctgtatactctctccatctagttttgatagacatatttttaaatctgaaaaatttatttatgatagacatatttaaatccaaccacctatcttcttaatgattttctcagatttaatgtgcaactcttcattctttcatacaagattggctataatggacatcgagaaattaaatattaataactatcaggaagtattatactccgtatgatttaattatagggttagatggccattaggcgatgcatgcatgcatgcatgcatatttacatgcgacggcgacggccggccaaacggaagggtctggagctccacgacgactactccccacatgctgatgagcggtgttcttgttgcatcacgtacgtgccgttcgatgcgttatcattgtcattgtaccggccggtggcatgtttatgtcatgtgtccttgcacaaacgtacgggggtggttgtccattagttttctgggtaactagcgccaaagtactacctccgttttacgttttaggttataatatgttttagttttttaaaagttaaactattttaagtttagccaagtttgtagataaaagtagtaagattttcaatccaagataaatttattataaaaatatatatttaattattgatttgataaaactaatttagtattataaatattactatatttatctataaacttagtcaaatgtcaaacagtttgatttttatcaaagtataaacatcttataaactgaaacggatggagtattacagaacgtacacaacctaattagtatcggttggatcatacccatatcggaaaggttccccctcactggtatccgcactcgccccctctaagaaattaagaaccacatcgataccggtccgcatcgtctagtgcacaaccaaaactgattatggggggcaatcaatgtcagcctacataagagcatctccagcagggacactaaatatagcccctaaacagattttgggtgttgaggctaaaaaactcaatccagcagagcccctatgtcacgcccggaaattcactagtaatttccgaacttatttgtgcataaaatcctcgtccaggaatcagccgaggtacacaaactgacaatttaatatacagattcatcaaattaactaaaacgataagtatttacttaagaggcacttagtccccaccatgaagaaaactgcagcggaaaataaaatctagcgaagctccggctccactcccacaggcaactcaactggggtataagccagacgtcttctccttctggatcctttttcttcaactgaggttgattgattattgcaagaatgagcatatgacatactcaacaagccacacagcaaatatgcaagtgcacaaggataccaaaggttggcataatataggctcatttgcaaaaacagcatttagcaaaacatttaagacaagtaaaacagtagagtactttaatcattaattttaatcaacactgaacaacacgcccatgctgcacaggcccaaccattctgaagcaaccatacccggctgtacagatctaatctccaaaccaggagctaagcaaattattaccaggtatagcatctataattattgtgagaggtgtgagactaatcacgaaaaacattgttcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgtccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagttagtcataagttatcccaatagtgtgctactgtttctaagcatggctaagcaatcatatctaatatctagctgaaccaatatatatagctcaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatcggtgtgacttgccttgcaataatcggtcttcaattaatcttcttgaatacttccggcgcactcgcgaaccttcgcaacgacggaaacgacaagctatcacgcaaaacggggaaaaagactaataaaaaccaaataaacaatacatataaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatatggattttaattgaattatgacgcaataatgaattaattttgaaaaggaaaagaaggattattgcgtcagcggctagggtttgcggtggaccgggtgcacggcagcggttcacgggaacgaacggccgagatcaaccctatccaaaacggacggccgagatcgatcggtccacgaccggctcacgggagagggcgacgatgacgtcagcgatgacgtcagcaccggcggcggctcgggcggcgcaagctcaccggcgaacgacggcgcggcggcgcaaacggagagcaccaggacgtagagcgcggcgcgacgaactcaccgatgaccaaagcaacggcggaggagcaacggacggcgccggcgacgaggaagaagcggcggcaaccttcgggtcgacggcggcgacggtgctccggcggtcttcggcggcggcgaaggggcggacgaggacggcgacgcgacggcgaccacgacggcgaccttcccgagcgacggcgacggctggaacggcggcggcgcacggctggagcggcggcggcgacggcggcgcaaaagctcacggggctagggcgctacacacgacggcgggcgaaggcgagggaggcgatgggtagaggagagctcggggatccttttaaaggggctagcgagcggcgacggaggcccacggctgccggcgacgagaaggaaaggttggggaaaaacgaatccgaatcaaactcgaatccgcctatttccaaaggaaattgaccggagtttctataagagaaaaggaagaggagatcgaggagattatttcccctcaaaagattcggccggagaaggaaaggatcggccgaatttggaagaagacggcggcggcttgcgctagggtttcgggcggcggcggcttgacgaagacgatggatccgacaagcgggccccacctgtcagcgaccgaacgcgcgcgcgcggctgcggactgggccggactgggccgagggaaagagagagagggttttgggccggctttcggcccaaagccaaaagaagactttttaaaacctttttcaatttaaattattttttaaatgcaatttcatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaattatttctaataattccttttaaacaacaatttataatttaaggatttttaaacaagaaaagctcttaacaaaaataattagatcattaatgatcaaataattactgaactgttctttgtatcatttaggaattgagctccgaaagatccgagaatatttcagagagttgacttaatcatggagaatttaataaaaattaaatccatccatgctttatatttaggaaattttatttcccacatttaacttcacttgtaaattaaagaacatttaatataaattctattaatgatttattaaataatttataaatcctgaaacgaaaatcaggatgtgacagccgagcggagagagctcagagcaagatacataaaataatcatttgcacatatggaattatagtgattgtaggtattaaagtgttaaggtggaggttggaaaaaataacatgataaaaccgtagcaaaccacagctacattcacttgcctctaatgaagggttggtatcatacacgatctgaaggaccaccacctaatcacaaacaaagcctcagaaaacacactcaaatatgcatatagaacagtaaataacatgcatctacggcctcaacacctcaaaacgcaaaaacaaggaacgccgcttggactataaacagtactgttgcttcaaacctttatatctcgaaaaataaaaatgatatgactgcaaataaatacattttgggaatctacagaatgagacctacaactttcgtgtagaacccatatttttattctgccatttagatgccctaaactgcaaatcaagacaagattcagaatctgcccaagaattcagactgccacacttaaaacagccatatctggagttctactcgcccaatcaaagtgtactttaccaatatggaaagctaaggaaaaactctacaatttcctagttataaactttcgcagcaaaaatcattttgatcctctaattggcgaaatacagagacacagcaaagctgacagcgcccagaaacactaatccaaaacacaacacctaatcccatcctctaaccctccaataacgacgaattacaaccctaaaacaacctataacctctgcacaggagagttaagcctctttggagaacttgagagaatatgatgggaaaaccaacccaccactcttcctgctcgtctcctcttcctcgatctgtttttccaatcagattcttgattagggctatggttcttggagatccatggagtagggttaataggggagacgtgagttccataggtgcccagggggaggtgtggcggcgtcggctgggaaggtgggagtcgcctctccctagggtattaggtgggggaggtgggctggactactgcgacgtggcccaaattgattcggcccaattccaaacatgttattttatttttaatttcagggtattacaatattggtcagatattgcaggatgcaaaggagaacgatgaaagtgaaaaggaggcccataaattggagcggatgttagaggaccacagaacgtcgttgtatccaggttgtgagcaggggcacaaaaagttggatactactctggagttcttgcaatggaaggcaaaaaatggtgttagtgacaaggaatttggtgatttattgaaactcgtcaagaacattcttccggagggaaacaaattgcccgagacaacgtacgaggctaagaagatagtctaccctctaggactggaagttcagaagattcacgcttgtccgaatgattgtattctatatcgtggtgaggagtacgaaaacctagaagcatgcactgtttgaaaagcactacgatacaagattagacgagaggatctaggtgaagttgatggacagccaacaaagaagagaatttctactaaggtgatgtggtatttccctataataccacggctaaggtgtttgttcaggaacaaggggaatgctagaatgatgcgatggcacgctgaagaacgtcaacaggacgggatactgagacaccccgctgatggttcgcagtggcgaaacatcgacagaaaatttaaagactttggaaaggacgcacgaaacatacagtttggtttaagtacggatggcatgaatacttttggagagatgagcagcagccatagcacttggtccgttatgatgtgtatctacaacctccccccttagctatgcatgaagaggaagtacataatgatgctgattattattcaaggccccaagcaacctgataacgacatcgatgtgtacctaagaccactggttgaagatcttaaactgttgtggaaaaaggaaggtgtccccgtgtgggacgaggacaaacaggaggagttaaacctatgagtgctgctattcgtaaccatcaacgattggcctacacttagcaacctttccgggtagtccaacaaggggtataaggcttgcactcactgtatggatgaaacaaaaagtacgtatcttaagcactgtaggaagtttgtgtacatgggtcatcgtcgattccttgttgcaaaccacctggtacggaagaaaggcaagcactttgaacataaggcggaccaccgtacgaagcctaaacatcgcagcgggaaaacagtgtttgctatggttaaagatcttaaagtagtgtttggaaaggggcctggaagccagcctatagagagcgaagatggtcacgcggcgatgtggaaaaagaactttatattttgggagttacccaattgggaattcttggatgtccgccatgcaatcgacgtgatgcacctcactaagaacctttgcgtaaaccttcttggcttcctaggtgtatatggaaagtcgaaagatacactggaagcacgtaatgatctgaagcatatggaacaacttggcgactttcacccggaaccaaaggagaaaggaagctattacttgagtccagccagctacactcttagcaaggcagagaaggaaagtatgtttgaatgcttggagagcataaaggtaccgtctggatactccacgaatataaagcgaatagtaagcacgaaggagaataagttcacaaacctaaagtgtcatgactgtcacgtgttgatgacacaactgctactagttgtaagaaggggtatccttccagacaatgtccgggcaataataacaaagttatgtgctttcatgaacgcaatttcgcagaaggtcatcgatccgaatagattagaagcccttcagaatgatgtggtgcaatgtgttgtcagttttgagttgatatttccaccttcatttttgaatataatgacgcatctgctttcaatacatgtttcctttcgagaggtacatgggcgttctgaagaagtatgttcgtaaccgtgctcgtccagaggcaagcatcgccaaggggtatggaacagaggaggtcatcgaattctgcgtagaatttattgaagaccttcgcccaatcggggtacctgaatcacgccatgaagggagactatggggaaaggggactctcggaaggaaagcaataatgacggtagacaataatttattccgtaaagcccatttcacggttatgcaacaatcttcattggtggctccttacatcgaggagcacttggctctagttcacgccagaaacatcggtaagtccgatgcatggattacacggcatcacattgatacttttcccgcgtggctatgacaacatctcatgggtaacgagacgattaaccaacaactggccttcctagtgaggggaccatctggctcgatcgcgacattccaaggaaatgagatcaatgggtacacattctacacgagagcccaagacatgaagagcacgaaccaaaacagcgctgtttgtatcgatgccatgggacacgatggaacaactggcacgtattacggtgccatcgaggacatatgggaacttgactatggtcctctcaaggtccctctgttcttgtgccaatgggttaggttgactggttgaggcgtaacgattgatgacagtgggatgacaacggttgaccttaacaaggttggatactcggacgaaccttttgtccttgccaatgatgtaacgcaagtcttttacatgaaggacatgtctagcaaaggaaagaagggcaaagggcttgatgagcctaagcgccacgtggttatcctaggcaaaagaaaaatcgtcggatttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtatgtgcggtcaaccgtcaccgccgatgtaatgccgtaattattgtgtacacgatataaactattttggatgtattgattatccatataaatcaattgatgtatggcataatttactatcattcatatgctacatttaattgaatatcattcatatgctaattataattaactagagaatttttaaaagtattaaatcattcatgtggcatttacagatgttaattagagtttttcacaatttaatttactatctttcataggctacttatatatgactattcgaatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtaatttaaataatgttaatgcattaacttctattttagaaacacatatgtaagcgaaaataatatgcagtgctataatctttagtgccggttcttaaccctaaccgggtttaaaaagaatttagaaatagtgggaaaatatctttagtcccggttgatgattactcccggttgttctcatcaaccgggactaaagatcgagggctatatatattcctgatgcgcgccctcgtcttctccaccaacacttaacgttttcggccgatcgatctctctcagcctctctccttcgctgccactgcctagggcaaatccccgcgccgacgccgccatatctcgctgtcgtctcgagctcgtcgtcctcgccgccgcctccgcctcctcctccgccgccgcatctctggggtgagagccgccgccgcct

SEQ ID NO: 11480 - DNA, 2030 bp, Oryza sativa
ttatgatcttgtcaattcagcatttgttgcctcttttgagcccaaaaatgtttgtcatgctttatctgatgagaattgggttaatgccatgcatgaagagttagaaaattttgaaagaaacaaagtttggtctttggtaaacctcccttgggttttaatgtgattggaacaaaatgggttttcaaaaacaaactaggtgaagatggttcaattgttcgaaacaaagccagactggttgcacagggtttcacccaagtcgagggcttggattttgaagaaacctttgcaccagttgctagattagaagctattcgaattcttttggcttttgctgcttcaaaaggtttcaagctttttcaaatggatgtgaaaaatgcttttctgaatggtgttattgaggaagaggtctatgtcaaacaacctcctggttttgaaaatccaaaatttccaaatcatgtgttcaaacttgataaagctctttatggtttaaaacaagctcccagagcctggtatgaaagattgaaaacctttttgcttcaaaatggttttgaaatgggggcagttgataaaactctctttactcttcatagtggcattgattttcttcttgtccagatatatgttgatgacatcatatttggtggctcttctcatgcacttgttgcccagttttctgatgtgatgagcagggaattcgaaatgatcatgatgggagagctgactttcttccttggacttcaaatcaagcaaaccaaggaaggaatctttgtacatcagaccaagtactccaaagagctcttgaagaagttcgacatggccgactgcaagccaatcgccactcccatggcaactacttcatcgcttggtcctgatgaggacggtgaagaagttgaccagcgcgagtacagaagcatgatcggctccctcctctacttgactgcgtcaaggccggacatccacttctccgtgtgcctgtgcgcaaggtttcaggcttctccaagaacatcacatcgccaagcagtcaagcgcatcttccgctacatcaagtctacacttaagtacggtatttggtactcctgctcttctgccctttcagttcgagctttttcagatgctaattttgctgggtgtaagattgatcgcaaaagtacttctggcacttgtcattttcttggcacttctttggtctcttggtcctctcgtaagcagtcttctattgctcaatcaacagctgaggctgagtacgtagctgctgctagtacatgtagtcaagttctttggatgatttcaactctaaaagattatggtctgtctttctctggtgttcctttgctttgtgataatataagtgcaatcaatattgcaaaaaatccagttcaacactccaggaccaagcacattgagatacggtaccactttctccgagacaatgttgagaaaggtaccattgtgctagagtttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttagtttatgcattgtattatacattcttcaattgagctttgcttgttatctcttggtcatcactatgctatgcatgtgtcactcttatgctagtttgatctcttgtctagctttcatttgcttaagtagcttatgtgatcatgttatgctgttcaagcttgttgaaacctgcttaaattgactattcatttgaacttaatcaatgtgcaatgattgctctagaagtttgtttaaattgaagtatccatctcatactcatgccatgtttatattctttttgcaataactgtcagtacatgcttatgaatgctcatgcttatgcgtccatactttgtatcaatcatgctttacaagctttatctctgtttttgtccgggctactgagtgcgtttacccatgagtagtgcc

SEQ ID NO: 11481 - DNA, 7485 bp, Oryza sativa
tgcatgattatgagctggtttgcttccttttaagcttcttctagaaatagctttgcacactaaatcactaattcacttgaaagctttttgcttgctggggatactaacttgatatccatgacatgtttcatacttcttatgcacatgcttagctaggcttgagcacatgcttgtatctgtgtgatccatgtctaccttttgatgcctttagataactctcaaagctctcaaaacactaaaatttgcaagtttcatctcatttttatcttgcatttttgtctcttttgatcttgatggcatcattgacaaagggggagagaaatttgcacttattgaaaattaaaacttgctttagatctcggtgaaagggggagtttggcacatagggggagcattcttgcatttgcatttgcatcccttttcttcttgtcacttggtcttgatttttcaagaattcaaaatgaccaaagttcgacttttgcaaaatggtttgctttgtgaatcaaaaatcaaattttcaaaattttgcttgagattgtcaatgttcccatcaagagagagattgtgaaaccatgtgtggttatagttcttttgtgatgggaaattgacaagtaccggaagtgcaagaagtgtgtgcgtggactaacattggtcaggttgcgacatctgtgccaagacaacggttgtttggttcatgtgggtgcaggtgatcggagtcgatcttggtcaacggcggatcgggactagactcagggaggagttgaggtccaaagtgatcaaggatgccaggtgacaagattggacacaaggttgcacacagtggacgaacaccgtgtgaggaggtctttgcaacgggcttcagaaggtcaagtgtgcaagcatcggattcgcgaagaaatcagaagggactgtgcaagtgcattgctgctacagtaaatggacttactgtaggtagcatacttgcatgtacacgtaatgtacttgtgcaaggaggagcttgcagaagctgtgcatgtgtgctgtgattggttggcagggaggccaagccaatccagccgttccacgtggcccaaggagatcattggctcggttggcatgaaggccaatccggcctgtccagctcgggagctcggtcggcccaagcacgttgctgactcaagatggtgaaggccaggccgagcagaccctagacatgacgacggcccagctcggctcggcaaatgcacaggcgtgtgcatgcgcgcgcggaggcgggagatcgtacggcacctggaggcgtggcggccttctgttcgtcaaggaagcggagacgcgcgggaacgtggttttcgcgagcgcgcgcagaacgcggctcggcgggaggaacggcgacatggcggcttctgacttgtggcgcgcaggtgcgagaggagcgggcgcgggctctctgggacgcgtggcgcggatgcattggcttggaggagcacgacgcggatcggtgtacactgattggcttggagtggaatcacgcggatcgcacgagggcacgcgacgtgaagagctcggatcaacaacgtggcgactatccaggaggtttccttcggatctaaggaacaatggacatccaggattttatcaaggctagggtttcgccccacgggtatttgagacaatgtcttaggggtcttaggctataaatagagggatggatgcaagggtggaggttgctccttttgtaatccttttgagatgctcggtgagagagtttccgtgtgagtttggagtgtgtttgcccgagaggcttttgtattaagattagtttggagtgtgtttgtccgagagattttaagtttgtgttattgttcctctgaaggtgtttgtttgctcctagttgagcggttattttgcatcacctatgaatgaaatgatttgaaggatttcgtttttgccttgtccatttaaattccgcaatttaaattccgcttgaaatttgaactttgcgatgatgagttttgctctctcctcctaacctctcttctagttttcgggaattccttttctcttcctcttctagtttcgggaattccttctctcttctttttctctcttcttttctagatccggcttctctaatagccgcggttctagtaaggattttgagaaatccagcttgatgagtattttcgggggaaagttttgaattgctatattcaccccccctctatagccgttcttggtctttcaatctgaggtatctcagccttggggcagaaattacaagtattcctaaagatatagcaaaactgaaacttttggaaacgctctgtctaagtaagacgagtgtagaggagctacctgtgcaagttattagtttgcccttcttactccatctgattggaaagtttaggattcaatatcatggctatagcaagagtacgctcaaaaagttatctgaaaatagtaaattggagaccttatcgggatttatcgccgacttcaagagccaaggatttcttgagatattgggccatatgagcaatttgaaaaaggttaagatatggtgctagtcatcagctgcaggagatcatgatagtatcttggctcgtaagctttcagaggccatccaggagtacatcaatcctcccttgtatattggcgataaccgtaaactatcaatctgcctgcaaacattctccggcagcctcctcaattctctcgatactccctgtgagctcacttcgctgaaactacatggcgagcttcgttcgttgccccgttttgtcaaatggcatacaggtctcgttgagctgtgcctttcatcaattaccgtgacacgggatgttctctctgatctgtataacctaaagtgtctgttatacctcaaactgatcagcgattgccttgacgaatttgtgataccacaaggggcgttccgtagtctgcgacgcctgtgcttcaaggtgcaagtctctgtcttcccgaggattgaagcaggagcactgcgggacctggtgtcactccagctgctctgcagacacctagtaggtttggctggtattgaaatcgaagatcttcgagaacttaaagaagtaactctggactctgaggtctcgagatacacaaaggaaagttgggaaacacgagcaaggcagcatcctaacaggccaaggattttgtatacttacaaggctgcataattgatattatcttatgtgcttcctgagcagtaaattagtaattcatgttcattcggaactaaataaattatgtgagagatttcctttgtgtgtgtttccctatttgtaataatacgtactaatatatgcaataataagcgttaattattcattgtatggtatcagagtatgggtagagatttgtttgttttttgtgtatgcacgaaaactcattagaatttttctacggaatcgctagtttactgtcaaaagttttttttgggtagaactttcaatttctagaccgttaggtattctctatagaaacagtgtaataaaaaccgtgcaagacttgaactcagcacctccacttcgcatcacgaacacttaactactatgtgtcagcacacatttgtgattgttatattccagttacatataagttattatggttataatataattacactccacaattgtaatatagttatatttgcaactttttgactcaaaaaagtcttcaatgttatatagctactctctttttctatacttaagaaaaaaaattcaaaagtatatgccaatatagggcatgttaaatagttcaagtatgtctacaacaccatacacaaattggtgaaaatattataataatgtgtactgtataagaatgactttggtagttaattttgggtatatttttttgagatcgctacctgtttttttgtgtgtaactttaacatgatctatatacaatataggtatacgcaccgtaaccaggctttcacgttatcgcgcggtaatcacggttatcgtgcttaccgcggggaaggggatcggttaccggcggttagggtttgagaaattttgagcaaattcaatttatggaaaaaataaaaaaaattatggatgtagttcttgttttttaatggtagatggtgaagaaatttttttaaaaagagtaaggaaaaaaattaaatttgagggcaaaaccgataattgtttgggaaatagaaaaaatgtattgagcttcatttttgtattttacatcaacaagctaggtttgcaagtgtcctatatattcttccccaatttctacacatatttaagtgattttccatttttttagcttctttttatttttcatgttttatgcaaatatcgcggttacagcaactagctgaaatttcttctcgtcaaagcaataattacttagggtagggtttgctcaatgctaccttcaaccctctctttacagcaatgtcacttttcatcactgcaattaaatcagtagcaaagactgacagaaaaggcatggctatatatatatatatatatatatatatatatataaaaacagcttttgtttgttcacctatgtgtgtacaaggtgaaaatcaaggataaggtattataattgagtaatagtgccttaattaattagtatcttgagtgcaatgtaattcgaacagaattcataatatgtttgaacaatattagcatctttcactacttaaaaacgatttttctggatgagaccgccttttgtttgcagatggacagtaacttgtcgcgtcagcaaaattgaccaacatttttacataccgctccttaagagacctgtatataaaaaataattttataggcgggcctcttaacatgtctatatgcgaaaatagggttattttcacatgcggacctgttaagaggcttgcctacgaaaagtccagccggcctccctccaccttaaaaaaaatacctgtcgggtcccccacagccccgctcctctcctctcctccacttctctgccctactcatctccttcgatctcccactcctctcctctctctcttggcggcggtggtggctagtggtgcgatggtggcgacggatgaggtcaaccatggcgacggtggaggggcctctacgcctccctcgcagatccgcagcagactggcctcgagaggggcagattcgacagcgtcggtggtagagaagtcggatctgtcgatggtgggcggcaatttcgtcgatgacggtatataggcttggcgtcgcgtgatccatcggtagggagcattgtcggtggtggatccggtggtggggagtcttgacagtgccggatccgacggtgagaaggcttggcggcagtggtttttctaagtctgatatgtaccatgtaatctgctcaatcctcttgttgtaaattcattttccttttctttttctttgtaaccctgtaatattcctgttatacttatacctgatatagcatattaggagtctctcctgttgtttactgtcaaaaagaaaaaacaaatctgctcaatcctcatctcgttctatagaccgcttatctgtgttggcttgactaataaagaagatttgaatcgatatttataaacaggttcgatgttggcctttggatttttatcaagtggaccatcgtttgcaggtgctgttttcctatacaatccatgtagaatctgacttaggaggttccggagcgccatctcttttccatggcatggaagaaatttccgccgcccaaaggatccaccggttcttcctttttcttctcttctagcatgaggagcgacattatgttcctactcatctccttaggaaccctaaagagtggatcacgcttttgtgatgatgttaatttcctcgatcatggtcgaagtactgccactctccctctttttgttggttggaaacgacggagggggcggtggggtcggactcttcttccgtggtttaggtgatttctcttctagtgatatgtacccaagatgtatcaaagaagatataactcctcatcattggaacgatattagctctttccgtctttcgccatgccacatgataatatgtatggcctgtctcagagttgtgataatatgtatgataatatgtattccttagttgggatatctagttaattgctcattcatgtgcttgggccttgggcttcacaagctcaacatcaacccttgcatacacattaatattgttcccgggtttccttggcccttggataatgtcatcccatgataaatttatcccaaattaaaagtcactttctacaaggaattatagaaaattattgaaagcctacaaaatatctcaaataataaaatacctgcaagaaaattcaaatgggacttggagtattttgcttaaaccagtggtggcttgggttgacgctggtgtcgtgcccagagcagaagaatttgggtgggggaaacttttaaataattgattgccataaaaatttagtactattttagtgataagggaaaatgctattaaatttccttgacagcagacaagaaagtttggttacgcggcgttgtagtttacgcataaaacacacgatcatgacgaaaaccatgtacatatgtatgcacctacagatgtttaatttaaaactactaaaggtacgaaaccatgagttaagaatggtaaaaaacatgagtttagagagtgatgctgtgacccagtcaaattaacgaaggtggtttcgcgcaaaaaaaaaagagtgagagagagagagagagagaagaggaagaagatgggaacgaaattaggcgtacatcatttgacagttctatgcatatgtgtgtggaccgtgatagaatttacattctaattttcttttattagaaaagtaagggccgtttctcaatttacattaccgcgcacgcactccataggaaaaatacatgcatgcatgcatgttctctccaagagagtaaactaatgtgacatcaattgggtttatatttcattacacctgtaattgcaagtggaagaacgattaaatactgaaatagaattgtacccagaaacactataataaaaatttgatgacgattagtttgcttctggtgttggagtttgttgagtggatccccatgcattgagaaacaggagtaatagtgatgctgatcgagagcggtgtcaatggcgtgatgccctatctcaagacaaaacgaattcacaaaaataaacctgtgtttccaccaaattatgcatcaccaaatttttttttgcataaccgtacatatgcttgcattgcagaatagtactccacttctaacagatttacgattatcagtttgaaatttcgtttcccatttacgttaactgaatgaaaaatcaacatgttaattgttttcatgttcctagttaagacatattttacatatattagttcgagaaatattatttcgtttatccctgataaaaattaaaatattgaaagcacaatcatgcatggtaccatgtatatttgtagttttgcaaatatgtatatctattatgg

SEQ ID NO: 11482 - DNA, 1199 bp, Oryza sativa
  unsure (1)..(1199): unsure at all n locations
tgcgtggcattgtcattcaagtggtgtatctcgctttcctcgccgagatgtgcaccctcgatgtgacctagcagggttggggcaaaacagacatggtcatcttgcatataattatgtnctcataacactaaagaatgcttgtacctcctcgcatggttcagtactggattactaagtcatttctcactaaccccagtactgaatcatcgagatctgctgtgtctttcttgtaggattttggagtggggagaagtaattcttggcttgtagactccggttgctcacgccacatgaccggtgaagccaagtggtttacttctctcactcgtgcatccggtgatgagaccatcacttttggggatgcgagcagtggacgcgtgatggctaaaggaacaatcaaggtcaatgacaaattcatgctaaaggatgtcgcgcttgtaagtaagcttaagtacattttgctctctgttttacaactctgtgatgaaaatctggaagttcgtttcaaaaaggacaggtctcgagttcttgatgcttctgaatctcctgtttttgacatttctcgagttggtcgagttttctttgctaacttcgactcttctgctcctggtccttctcgttgtctcattgcctcagagaatagggatttgtttttctggcatcgacgtcttggtcatattggctttgaccacttgtctcgcattagtggtatggatttgattcggggtttgcctaagttgaaagctccgaaagatcttgtgtgtgcaccatgtcgtcatgggaaaatgacatcttcctcccacaagcctgttacaatggttatgacagatggaccgggacaactgcttcacatggatacggttggtcctgctcaggtccagtcagttggggggaagtggtatgtcttggttgtagtggatgatttctctcgctactcttgggtctattttcttgaaacaaaggaggaaacatgtggcttctttcagtctcttgctcgtagtttggctttgcagtttcctggtgctcttcgagccattggcagtgataatggctctgaattcaaaaattctgcatttgaatctttctgtgattcttctggagtcgaacatcagttttcttcaccatatgtcccacaacagaatggggtggttgagaggaagaaccgcacccttgtggagatggcacgaactatgcttgat

SEQ ID NO: 11483 - DNA, 1749 bp, Oryza sativa
acatcattggcaaggacaaaaggttcgtccgagtatccaactttgtcaaggtcaaccgttgtcatcccactgtcatcaatcattacgcctccaccagtcaacctaaccgattggcaccggaacagagggaccttgagaggaccatagtcaagttcccatatgtcctcgatggcaccgtaatacgtgccagttgttccatcgtgtcccatggcatcgacacgaacagcgctgctttgattcgtgctcttcatgtcttgggctctcgtgtagaatgtgtacccattgatctcatatccctggaatgtcgcgatcgaccaggacggtcccctcgccaggaaggtaagttgttggttgatcgactcgttacccacgagatgttgtagtagccacgcggggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttacggaataaattgttgtctaccgtcattattgctttccttccgagagttccctttccctgtagtctcccttcatggcgtgattcaggtaccccgattgggcgaaggtcttcgataaattctacgcaaaattcgatgacctcctctgtttcataacccttggcgatgcttgcctctggacgagcacggttacgaacatacttcttcagaacgcccatgtacctctcgaaaggaaacatgttgtgtaggtacacaggcccgagaatactgatctctttgacaaggtgacaaagcaaatgcgtcattatattgaaaaatgaaggtagaaatatcaactcaaaactgacgagacattgcaccacatcattctaaagggcttctaatctatccggatcaatgaccttctacgaaattgcgttcatgaatgcacatagctttgttattgttgcccggacattgtctggaaggataccccttattacaactggtagcagttgtatcatcaacacgtgacagtcatgagactttaggtttgtgaacatcttttccttcgtggagtatccagacggcacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcggacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcagccttatgttcgaagtgcttgtctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggatagtttgctaagtgcaggccaatcgttgatggttacgaacagcagcgttcgtagggctgca

SEQ ID NO: 11484 - DNA, 8919 bp, Oryza sativa
actaaccccattttttgccttccattgcaagaactccagagtggtatccaactttttgtgcccctactcgcaacctgggtacaacgacgttctgtggtcctctaacatcttgtccaatttatgggcccccttttcactttcgcagtcctccttggcgtcctgcaacatctgaccgagatcatccgcaacgtcgttaccatcagcatccctttcctcctcgcctgtttgatttccttcaaatccaacgtactgagcaaagtccggaatattgtcgtcttccacttcatcttcttccatttcaacaccttgctctctgtgggatgtccaacaattatagcttggcatgaaccccgactcaaacaagtggaaatgaatagtcctggatgcagaatacttcttctgattcttagacttattgcatggacaacgaataaaacccctttgcccgttagcttcggccactctcaaaaaatagtgcacgccgtcaatgaactctttggaccgccggtcagcgtacatccattgccgagtgtacatccattgccgatccatctacatgagtcaaaaaaaatcatacacaaataattattcttacaataatgacagtcatacaataattataagataattacaaactctttccacagtcatacaataatgacatatctttattcatacaaaaatcataaaatattacaccaaataattcttatttactatttctaaagttttaaactaattttaatgtgttttacttcttttaattttcattttagtttgttttctattatttaagattaactttcactatattttctttctcaactattttataaaaccttctttagcaaatcaactaaatttctatatattctttcttccccacacaaattttctctctcatcaacttacaactaaattttggagacaaaaaagtgtgcaaaacatagctgcaaatgtaatatgacaaaaaaaaaacactggaggatgaagttgcaaaccttttaggcacctccgatttgtatgtaatcaccaaaataaattcactagaaattttggcgtgacctcccctcttttttgaagaaattttgaaacttgctcgggcagctggaggagaaagaagacatatatataggggtgggactttagtcccggttggtgttaccaaccggggctaaagatccccgagctctttagtcccggttggtaagttacgatctttagtctcggttggtgttactaaccgggactaaagatcccggggggcctgacaggccctgacagcatttgaaccgggactaaagatcaagttttagtcccggttaaaaagggtaacgggcatatttgatctttagacccggcatatttgatcaaccgggactaaagatcatctttagccctggtttttattgtatccgggactattgtggaattcggccgaccgacgaaagatggtttctccaccagtgcttttagataaatatgtggtcatcctgcagatatttacatgttttttaatgtaaatgaatattattgtcatctcatatttactgagcttgaactttcatctcttgttaatttgatatatataacaatgcatggacaaactcatgcagttcacttgaacttttagagaaatgaatggattactgtgcagcccgtcaattatattggtttttgtttatttgtaattttggctcttataaatatcgtatactaaaaaataaattccgtgaatgttaatggacttgcactggctcttattatattcatacataatgatgaaatgcactttacattgatggagtaatagaattacatattctggcacataatgataatttcactggaaaaatatgtaactattgatgtgccagatgtaaccgagtggaataattaacgcagcacaactatacacaaattttataaaaatatcaagaaacatcaactggtatatagaaactttttatgtagaataatgtttcctagctctacaattatcgaacaacagagaaaagtaattatattgagataaactaaaataccaagcctaatatgtcttcagttacctactagcaaacttacataagaactttttgtatcagagaagggtatttttttacccagcctctatatcgccaatcgaatatatgcagccttttaaattggaaacttagccctttaaaaccacttggctacatacccttttgcaagcacataattgattgcttatgattaggaagctacaagaattatatttgaaacagattcccttgtggtggttagcaaacaatttgataggtcaatccatactacattgaatcaagatttgaagttcaaattagttggttaatttccaagagatgaagttttgttgggtacgtcgaacggcgaacacggtacagcacacatgctagccattagcgaaggtgtgtagcgaaggagagtatttcttctcgtgttgctttacaacctgtgtttatatgttcctgcaggctttattttacctttccttgataatgattgtaagcaagattatatgtagtggaataaatctccattaatttttaccaaaaaaaaacaagtgcaaacctcgttctacgatatttttctctttttccttttgagaactctgattctttcttgacttgtcgaaccatacaatgtatataagaccagaaaaaagaaccaatatctacaacctacagtagatcactatcatcgtaccctggcaaagagaaaaaaaaagtcactgtctacacatattatttctttagtttttgaagtaatttcatttgtcaactcaaatttactgaccacttcaaaattccacaccttgtaagttgttatacataataacgactctaggtcgtttatctattttggccctttaattagttatatatcccatattatgctcaaagtttgtccgcaaatgttaatggaataatattgattttgcagtcgtcatgaataaatggacattggatgcaggaatctatcgggatatcgtcattgcgtgcacttcgaggcaaaacccttgtagattccctctatatatagctttaataattctttctatgatgtatggtttttattattaaccttttacgtggtcaattatctaaaagaactgttaagtgttcaatgtacatatactattgtgagtattgtcagttcaattgcagttgacacggaataattacatgataattaccatgcatgcaaattaattgaattataggctaatggaattgttccggccggtgggtattctagcacatggataactcaagcagatgaaatatattgatgtgttatacccactggaataattaacgcggcacaaaatgtaactagcctctctgctatgacaaactactgagtttaagaaaaaaaaaaagaggaagaaaaaagagaaagaccggtctactggaaacttgccttagttaatttgggccgttgtttcacacattcgttttctttccgttttcctagtgaagactgggctgtgactgtgagcgatatacttcgacaggtcggactaagttcacattaggtcctcaatttgtcttccagccatttcatgcttgaaccaaaaaaccagatataacccgtcctccaacttacaaaccggtgtaaacaagatcgcttagcagtattatctccagttttagctaattacgtgtctcctatgacttggtcttcgtcccacgtgatattgacataacatttacacaacaatttgatcccaaaaatagaaaggacactacttaaaaaggaattttccgtgagatcaaaaatggttttcacgtgcgggtgggccaactgcacgcacccaagtgtctacaaaaattgctatttttgcgtatgggtgggccaaccgcatgcacccaagtgtctacaaaaatcgctatttttgcgtacttaactctgacgcgatctctttttctctacctctccatatcttcttcgccgtcgtcctccctctcctcttgatccccctcctcccctccctctctgcgaagccgatgacagctgcgatgaaaacgacggcgggcggcggcgccctcccgtccgctgggagggaaggcggcacgcagcggcgcacgagggggaggcggcagacggcggccacgcagtcgtgctgatgcggcccggcgaagcagtggcgccccggcgaggccatgcgacggcgggggtgcggctcgcgcccatgtggcagctatgctttgctagacggcggaggagctcgtcctggcggcggcgtggctcagccgggcggcggcggcgcgcccgtgcggtggtgaggtggccacgtaatggcgcggtggagcgcggcgcggcgaggccgacggccggcgggggtggacggccatgcagtggctgcacgctcccccctttttttttgttctttttttaatggttttctgttgggttagtcccacattgttaattgatgatgggggagcacgaattaaaaggttgttacagttctcatccatcagactgtcttttggattgtgtaggcccaggacctaaacttgtgcctccggttgggtctgtggaccagacgcctacggttggtggaacaggctgcgcactctaacattttcttcctcttctgttgactatcccgggatggtgtgaagccttcctatcatttttcttctttttttcttcattctattccttgtctctcttgtccgagtactgctgccatggcatgggtgttgctgccatcattcgatgtacgatgttcgatttgtaaatttgtggatgattttgttgatgattatgttcatttgatctgtgatatgtcaatttgatgtggggatttaatttgatttaggaatgtcaggagcaacttgacgtgggatgcaagcagcaaataagaataaaaaaagaaaaaaaagtattgttaacaccaaccgaaattaaagataatagtaccaagtggttggtgctaccatctttaatcccggttagtgttatcaaccgaaactaaagatatttcaaccgagactaaggatacccagctttagtcctgaattggatgtctgggttgcatacccaaaactaaaggggttaccaatcagaactaaagatgggttccccactagtgaaaataggtatggtcagtgaaagcaaaaattcaacagtgacatgttacacaaaagagcacccaaatacactaaaaacacatatatttatgtaaaagcaatctggtataaatagaatggttccatgttatttaattaccttggatttatcctaaatatttggtgtattcctgccaccaaaaagtgtgttaccgtacaacaaagtgtgcatggtatgaatatgatgcatattgatgcctaatctaacaataaggaaatgtgaatcctccgtgtcactactacaaaacactagtaggtactagctcatttaaccgtttccacattggataaaaaatatataaaaccagcacatttaagcagctataggtgccgatatggcattaataatataggtgacactttttagaaaaccggtacctatatttatatgatatggcattaataatataggtgacactttttagaaaaccggtacctatatttatattataggtgccgattctttaaaagattgacaactttatgaaactaagctgagctgtcacgggtgagactccttttaaccccaccaaccttatcgtctctcgcactctcccatcgcccccatcccctcctctctcggcctgtcgctgccgcccatccactccagctcacttctgcgtgcatcgtcgccgccgtcccaatcctcacaaccttcaccactgcaccgcccatcatcctctcttcccacttcctccacctttcctgcagctgtggcaactcccatccactctcaccgcatccccctactaactccttaagcttaacatgcaaaaatgtcacatcattattcactaacaagataccacatcatcatccactaacaatcatcacatttaaacatcatgcaaacatgctatatctttatagtttttataatttaagagcttttcaaatacaaacatgttaaattatcatccaacataattcacataatgtttcaatgtgtatcttcatgcaaagatgccacatcatcatccactaattaacaagatgccacatcatcatccactaacaatcatcacatttaaacatcatgcaaacatgctatatctttatagttttttataatttaagagcttttcaaacacagacatgttaaattattatccaacataattcacataatgtttcaatgtatatcttcatactaaattcccacagcaatgcgcagggtttcacctagtatttatattataggtgccgattctttaaaagattgacaactttatgaaactgagctgagctgtcacgggtgatactccttttaaccccaccaaccttatcgtctctcgcactctcccatcgcccccatcccctcctctctcggcctgtcgctacctcccatccactccagctcacttctgcgtgcatcgtcgccgccgtcccaatcctcacaaccttcaccactgcaccgcccatcatcctctcttcccacttcctccacctttcctgcaactgtggcaactcccatccactctcaccgcatccccctactaactacttaagcttaacatgcaaagatgtcacatcattattcactaacaagatgccacatcatcatccactaattaacaagatgtcacatcatcatccactaacaatcatcacatttaaacatcatgcaaacatgctatatctttatagttttttataatttaagagcttttcaaacacagacatgttaaattattatccaacataattcacataatgtttcaatgtatatcttcatactaaattcccgcagcaatgcgcagggtttcacctagtatttatattataggtgccgattctttaaaagattgacaactttatgaaactgagctgagctgtcacgggtgagactccttttaaccccaccaaccttatcgtctctagcactctcccatcgcccccatcccctcctctctcggcctgttgctgccgcccatccactccagctcacttctgcgtgcatcgtcgccgccgtcccaatcctcacaaccttcaccactagcaccgcccatcatcctctcttcccacttcctccacctttcctgcagctgtggcaactcccatccactctcaccgcatccaatggatcggcggcgatgacctcagtgtggagatggtgacgacgcacgcatgcatggagatcacgctgctctcgccggtgggaggtgattgggggtggggtcaccggggatgacgcataggcgatcgtgataaacgggaagatggcaaatgtgacggtgctggtggtgaatgatgcggcagcgggaaggttgtgagttcttgatcttttttttattttatttaagatgagttttttatcctacttgtgtagtttttgatgttgtgtagttcttcatcttgctggtgttgctttgttactgatgggaaataataattgaatatttctatctgtgatgtgaatggagattattgatgctaaatcaatatagagttcttgatctgtacatattgtgtatggggattaaaggcggcttgaagaaggtagttggatgcatcggttcattgagccgatgcttctagtctgtctctgttttttttaattgtgggaagtacaaaaggtgttggttctaccaccagcaccaaataaccattggtcattggtactagtagataaatggtgccagttgcaaaaccgatttttttgtcaggtttgcaacccgacaccttttcggtactatgtattagtgtgtgccaatcagtcacaactacacaactatgattcatacttgagtcataagatatttgggcagaacacaataagttaaacaacgatatatttaaccagttctcagtagcaaccgcatgcaaatatatacacacacacatatacacatgcacacgcattattttacacccaaggatatacaagtccatgccaattggaggaaatcaacaaaagcacaaattaactagaaaaaaaaaaactagaacaaaacaatccaatgcacaccgattaagttcttgttttagtttagctctgaatgctaaataaatctgcaagcccctggagggataaagccaccctagcgttgtctcccttgttggcagtcgggtctccgaaaatcaccgatatgatgatgcgcacgacacccccgacaacaatgcggtcttgttccgacgaaatgctcttgagggggccctccttcatcatgagctccttgctcgccagcatgatctggcctccgtgtttcttctcgcggcccgcctgccatctcttcccggcgaggtgcttgacgcaggccacgtgcaggtacacgccctcgccgttgatgttggtgtggtagcaccacagctcacggtccggccctttctccttcttgcacaggctgcacttcctgggtgcccggacatcgaagtcgtggccgtcaagggtgatgggcccctgcaggctcgcgcagcacgggtggaggttcaggttggtgccggagcagtggtagacgaagccgcgcacggagcagtgatagacaaactttacaaacttcaattgtaccaaatttagactccttctaaattcgactccgcatcctatacgcacacaatatctccatcatatgccatatagaatcttcaccaaccacatgcattgatgtttagcctaagcacgccgtatgatatcctgatcattcggacgtcatcttctcccaagttgactcctgattcatcatcgtcaacattctctccaggcattaatatcacctacacatgcatcaaccaagaaaccatattctgagcacaagct

SEQ ID NO: 11485 - DNA, 2348 bp, Oryza sativa
aagggatgaaaacttttaaagctaactctaccgtaatgtgatcctcatatattaatggcattacttcatgagacaccctgtgagatataacatttcaacaatcagttggcctatccaaaactctttgttaaagttgcgtaccttctcttttctccaaacaggggtgacttcagttctaccccctccatcaaaaagtcaagacatatttcactttctggttttctaaatgagatggacatatttgtagttttgatgcgctaaattaaattgttgactagaacccaagcagtcatcttaatactcattggttgcatgcatacatatagttccttggttttatcacatggtagatgagttattcccccattggtcttggtgaaaaaaaactgctttagacttttggatggaaggagtactacatatctgcctagcttatttcacatggccactcatcagcaggcttctcatataacttttggctttccaaaaggtcaattaatttatcgatttcaaaaagatgtgctgcacatgatttcaattggaaagcttacaattatctgtacacacgtaattcccaaaatttaggcgtgtatgactagcattaccttttaccccaaacaaagtttgcccaaagtaagggttggaatagataaaaatgacaatgaggtgtattaccttgacctggtgagaacaaaggctccgtcaccgtttgagacctattaagagcaacaattcaacttagatgtacaaataagacagattagtgcaccagttctcaagctgtgtatccgcatatggccaacacatcaattttttttttttactgtgaagcatccctttcttattatgcttaaaattttctagtatagaattttaaataaattttgcgggttcaattttcgttttattttactattcatttaaaatgtccatttcattcactctaacaatttgattgggtcacttaaacccctaaacaatttttagctcatgttacaactgaaactattaactatggttcattatactgcttaatactcttttttccagattcatagtactaagttgtgtctaatacagtactatgtcactatattttgagatggggggtacattttttatcttttttttattttttacaagtcttattttaagctaaaattttttaaagccatagatggcatcattatctaagttccataatattttcaatttttttcatgattgtttgcttgaacatttaaattttgatgtttaagttagttttaggtgcttccaaccttgtaaacaatgatgaaagttctaaagaaaatgctgaggtaagacgtaatgcatctatcagtcctatcaaattcaatgcaaaataccatttatatatataggtcgagagaatctacaaagtaccactgagttcaacacacttcaacaataagccaccgaatttgttgatatccataatatgccatcgcattatccttaacctctatgatttgccatcgtcgcgccgtttgtattgttaattttcttagttatgaccaaaataccctttgaatcatctaaccctagcatggcccagggccccttttttcccagcatcgcatctcccagcgccgcatcaccacccttcccagtgccgccacagcgccacgcctcgccaacgtcgccatccctagcgccgacccgaccttcgggacccagtgccaccatccgtagcacaagtcagcggtggtctagccaccatcgtcacatccgacgggagacggcgcccctgttggagggctgctggtggtgctgccatcgtcatcagcgttgccgtcgcaaacaaggggacacgacgtcgacgcccctgctggagctactgctggtgccgccgccgtcgtcagtgccggcattgcatgcaaggggacatggtggccctggccctgttggagagctactactgtcgtcagtgcaatccctcaaccgctcctcaacagtcacggcaaatcaaagctctaccccctcctgtagccttggagatatttgttcataatcaaaatacttaaaatatgtgctcataattatttataatcatgctgcttaaataaagatatttttcatatgtttagtaccgttgtatgttctctttatagttattataactctcggtaccttgcacggtatggtctcagtgctgctgatcttcactaagggcatacttgtcttttctccaacgcaaactaacaggctgtagatggcgatggtaaatcgtagaggttaaggaaaaggcgatggcatattattgatatcaacaaagtcagtggcatattgttgaagtgtatcgaactcagtggtactgagtagattct

SEQ ID NO: 11486 - DNA, 837 bp, Oryza sativa
agtgtgatgatcataagaataagtgtcatttgatgaagtggagtattatgtgccgacccaaagaacaaaggggatttaggtattcatgatttatatatgaaaacattgcccttcctagcaagtggttatttaagctactcgcgatggatggtgtatggcaacaattgattcgtaacaagtacttgggctcaaaacctatgtcacaagtcgagtggaaagctagggactcatacttctaggccagccttatgaaggtcaagcgtgattttctacgttttggcaaattcattatgagagaagcaccactgtgagaacaatacccttgcctatacaataaacaggatactatagcaaatgtgctacaaaactaccctccgaatgtatcttggcgaagggatcttattgagccaaaattagtggcatggaataaccatgttccacgaatggcaaatctagcgcttactcaggaccgagataagttccactagaatttaatccagaatggagagttttcagttaagtcacattatcttgccttggtacattcagatgtgcccaacataaataaagtaatttggaaagtaaaaataccacttaaagtcatgatcttcctaaggtatttacgtcgtgggatagttttgacaagggctaacctggccaagcgcaattggcaaggaagtaagaattgttccttttgtcacacagatgagacaatattacatttgttttatgaatgcagatttgcccgttttgtgtggtgcactatacaagtggctacagggcttttcccgcctcgtggtgtatccaatatgtctggtaattggctacggggaatta

SEQ ID NO: 11487 - DNA, 2079 bp, Oryza sativa
gcacacatgcacagcttttgcaagctcctccttgcacaagtacattacgtgtacatgcaagtatgctacctacagtaagtccatttactgtagcagcaatgcacttgcacagtcccttctgatttcttcgcgaatccgatgcttgcacacttgaccttctgaagcccgttgcaaagacctcctcacacggtattcgtccaccgtgtgcaaccttgtgtccaatcttgtcacctggcatccttgatcgctttggacctcaactcctccctgagtctagtcccgatccgccgttgaccaagatcgactccgatcacctgcacccacatgaaccaaacaaccgttgtcttggcacagatgtcgcaacctgaccaatgttagtccacgcacacacttcttgcacttccggtacttgtcaatttcccatcacaaaagaactataaccacacatggtttcacacagattccataacttgtgtatatttttcaggtgcttgttcttgacatcattgcattcttcgagatccaggactctcaaaaccttgtacctgtgaaactcgcaaatggtgtcacctgccgtcccgaagatcgtcaaagaccggacgcatgacaaatccatatctgttgtagttctgcgcttgtgaggtgtcctatgatcgatacagagatgacgaactttccttcgccagtcaggaaaggacatgatgaacctctcaagtctcgacgccttgtacaacatatactcgtgcacgatactgcgagtcttgcacatcttgacatcgccattattgcttgtgtcaatgataggatgaaagatgtcccagtctacaaacgtctcaaaattccaacgtgcaatagtctggtcatcaatgtccacatcttcgctccttgcgaatccttcagctatccaacgcctgattatcactttcttctcgagcggaacatcgtttggaaatatgctcaaatatagcaagcaggccctgacaacgtggtttgaaagacttgtgtaattatccatgatcacgcctttgagtctttcaaagttaccattgtcatgtatttttgaacctaggtagcgacacaattcgcgacagcgctgcccagtaggctcatttaaacctcccaaataattggccacacaaacaagggaaagtggatggccatcacatttcttaagtagttcttccgagcccatctgcaactcaggtgaaggtgcctccccaagagctattgtcttgcagtattgatcttcaagattttgcatttggtatatgaaacctttgccattgccacagcaggtattcgcttccgacttaatggttgtggtaactattatcctgcttccgttgtttctactattttcttcgaaagctgattttatagaattccattgcccattcccaatgtcatcaataacaatcaagtatctgacaaatttctgacaaatttcgggtaagagcaggtacaatagcaggctataagccaactgcaaatatattttaaggagataaacgaggagagagaagagcagtgggctacaaatttgtagccagctgtattacggactccaagacgcaatgtgtttatgataggtgggaccagttattgatagtgtagtatgtaactattatatgaatgagctattagattggctatagatgaattagagctagtagttgactatattattaaacttgctctaaccaacggccgggcgcaaggttcagcgaatgagtggttttacgatcctcaataaagtactcaatgtagtacgtaaagttccaatacattctgaatgaccgtaaaggtgtggatgggtaatgcgtgcaactgggaaacagctacagaaattctctcaccttctacccctgaggtagtccatgagctgggcttggagatattgctcgtcatcgaccaataatccctgaccccgatagccaattgtggagtaatgatctgaaaatctcccccgcatttttctccttggctcgatcaacccatgcacggcaggaacgaaacacccggattctatcatcatcacttgaccggaacactgccttagcgagggtcgtcttgccggag

SEQ ID NO: 11488 - DNA, 2253 bp, Oryza sativa
gccggagccgccaaaacccacgatggcgataaccctcagctcctccggactttcctccagcatcgcgaggatgtcccccttggctccctcgacgcccacggggttgagttgaacatgttcgcgttgttgtgccgccgccggcgccagtggcggcggcggcgggggcttgtcgtagacgaactggcacaggcgttcattggtcagctcctcgaggcgcctgttaagcgccttgatcttgtccccgaaccggtagcgtgtgcagatggtgagcaggaagcgccccagccggcgcgcccgcgacgctccctcggcgcaggacacgcggtggaggaagcgctcaatgcagtcctccatgtcgtgcgtcagctcgcgcagctggtcgccgaacaccttggcggcggccgtggggttcttcgtccgccggaggtcgtcgtccatggaagctgcgagcagaactagtttacgtctcattgagtcgctatcatcgatcacgttcatgaccatcttacaactgcctgacagcaccttaaacagcggcggcatgacagtgttcacgaaggcagttatcaccgctttctccatggtctctgctgcctcaatcatcgatcgatacaacactaaattttggtactaacttgatctagatcttttttgctcggtatctgagattctgaagtggtgaagtgggggttgaaagtgttttttagtgaatgaatggtgctagaaagacgatcgaccagaagggtataaatagtggagaaccttagaccgggtcagtacatagttggttgcttggcaaaccgaatctctgatacataatccatgtcccacagaatcacacatatctaacccatgtcacgcagaatctcttgtatttaataccatgtcaaaccgaatctcttatgtatgattatagctgagatatttttagatgccgtacctttcggatccacggagaccatgagggacagtaggatttttttaaaaaaattacacagtacaacgcagacactcacaatggaggcacgtaaactctacccctatgagcatcttcgaagactgcgcaggcaaatccttgagattgacgaagtcaccacaggcgcctcgctgtcgacgggtacgtcgcctaccactgaaagcacaagccgttaaatcatggaaaatttgctcccatggagagtcaaacccagaaccttatgtgctactgagactcttgtaaccactaggttattgaccctttcacggggatagtaggattgtgataattgaagagaaggtgttgtcgtacctttacaagttgtgagggtgtactattacaggtgtagaccagaaggaaacagtaattgggatagctattgcttttggtagcggtgattctggcataggctcatcaaccatctcacgaggaatctgcaagaagaaaaccccaagtctagtggattggtgaatccacatgataattctactacttgtgggtggcgttacattcagtgaggtggagcatgttaaaataggtgccgaatatacttgtcctaataggttgtagttaaacttaaagttgtaatatatggtagctagagggtggggttagcatcagactccataacccggtaaccctttaaataaaaatgggggcacccactactagagaaacgattttttatcctaaaccccaaaacacaaatatcctgactagatcaagaaccggtactaaatatgctttagtaccggttctaaaagttgaagttcctaaaactatgtttaattccggttggtgttaccaccctataataaaaatatatctttagtactgattggtaacaccaaccgagactaatgctatagtagcattagtctcggttggtgttaccaaccggtaataacgatgcaattttagcaccagttggtaataccaactcatactaaagatatttttagtaccggtcggttggtaataccaaccggtactaacgatgtctctgggatcagttcaaaaagaaagcatctacattcaagtcagatgtgtatagtagtaggtggaatggtaacgtgtgtgaggactgagttgatagatcttgagttcgaatctcacatcccacactttttttttttgacttagtatgcatcttttgtactcgttctttctaccggtactaaagatagtctcgatttactggtctcgggtgctacagccggtacgaaagggggttttaactagtattaaaagatgtttctcctgcagtgaccaccaat

SEQ ID NO: 11489 - DNA, 8846 bp, Oryza sativa
accaaccggtactaacgatgtctctgggatcagttcaaaaagaaagcatctacattcaagtcagatgtgtatagtagtaggtggaatggtaacgtgtgtgaggactgagttgatagatcttgagttcgaatctcacatcccacactttttttttttgacttagtatgcatcttttgtactcgttctttctaccggtactaaagatagtctcgatttactggtctcggttgctacagccggtacgaaagggggttttaactagtattaaagattgtttctcctgcagtgaccaccaatgtaacaatcatgtcaataatgtaacataggcacgcagaaagagaatggcggcgagaccatggactcatagcagcaaggggtgctagctatgttgattacagaggaacacccataattagagtcccgtgcattaaacgtatactaataacaaaacaaattacagattctgtcggtaaactgtgaaacaaatttaattgttaagcctaattaatccatcattagtaaatgtttactgtagcatcacattatcaaatcatggcgtaattagggtcaaaagatttgtctcgcaatttacatgcaaactgtgcaattgattttttttatctacatttaatgctttatgcatgtgtctaaatatttgatgtgacagaatttttagaagtttgaagggatctaaacactgctatagtccttatatatgcttcctaattagcacctgtacgtgtatgaaaaatcaatgttgagactaacaagctagcacaataattactggagtatctacttgctaccttacccggcccacgtgttatcatgggaaaatttggagtaaaagaattaattaacagaattagaggaaaaactcaagttgcaaaatactatcacatatacatagaacctaagctgatgaatatataccatcagtccatcacaaagagaatttgagttgaaaaataccattaccgtgatcatttccacccagggaagaaaatgactaatttgccccctgcttttttttcttctttgtttcctgtgcttgctatacttatggctctcaatttcataatattttatacagactgcttgccttatacgtactcccttcggtaacaaataagtgacattttagaaagcaacaagattaccgaaatgatcaatattgattgctagtataaaacctataaaaatatagcaaggacgttctaatattttgaaactcctttttgttttcaaagacaaatatacctatatcaatttttaaaattaaatcgaaatattttaatagaaattgatagtaaaagtttaaacacaaaacacattgacttgatgtattcaagaacatcaattattgttgatagggatgcagtaaaaaaataatatatttatttaaaaattatgaactgtactatttccttgaaaatgtttttattgcttatttcttaaagactaaattttataaaactacagatattttggctaaactatcacaaaactataaatttaaaatgtgtatcataaaactacagatttaacatgaaatttatcacataactacatatttaaagcattgtatcacaaaactatgcatttagaaatgaaattatcaaataactacaaattttagagtttatatctatagcactgttgatgttacaaaagttgtagctttctgataaaactgatgttatactatatatatatttaaatctgatgttaaactgatgttatatatgctcatttataaaattgtagttttctaatgatactttcaatctatagttttgtaaaaaaatatggttttaaatctgtagtttaatttgtaatacactttcttaaatatatagtattgtgatatattgatcaaagtacattaattttgtaaaatttactctttcttaatttttgcattagctgattttctaaacatttccaccataaattaaatgcgagatttgttaaatgcatccaaacgcgacttggaatgttgagtattacaactgagtggaaaaaaaagggtagtgttggaattttcaaaactctctctcctaaaaaggtattaattgcagttttggatgaaacagtaatggtaccggcattttccaactcaaatttccctgtgatggtattttgtagctgatcttcttgtagtggtattttccaacccaacattctttgcaacggcagtgatcaaatttgcagaagatttaatgtggacaagtagaaaattttcagaaattagttaaagattggaaagtgcatttagtaagatgggtaatgagatcataaccttcaacacaaacagctagatcataacctcctcttgtgtttccaaaaaaaaaaaatgttgtggagaattttatctgactaatattttttttagaagatgtattaaaaactcggtctctacaagtacatagccaaacatacattgtcaagagtatttagtttttggggcaatcgtatatttgaccctattttgaaagcaaactaccaaccaatttgaccttatttttttaactttgcttttttttaacctacttttttgaccctgctttttaactatcgacatcagacatgaccccatttcgtgaaaccaacttgacagtgttaatttgaggtcgaaatacctttatatccttactcatttgaccctaatttttttatacgctttggtgtacatgatgcaatttctaataaatttcacttggaattgatatgtcttgtgcgaatttgaattagatttgaattttagccaaaaaaaaacaattgagaacgcaaattagatcaccacaacaaatggttccggaacaacatgccagcatcgattcaaatccatatcaacatgcaaacaaatccctgctaagaacatcatccaacaataacattcaaacaagatcacaaaaatcaaacaagcgctggcaccggcgcatccagccacagccgccgctccctccacatctcgccgccatcactccctccatgtgtcctcattgtcgtcgctccctccgtgcaccgtcgccgtcgccgtctgatctgcccatcgcctccctccgcacgccggcgccgtcgccgtcaccgcgcctcctccttgcgctgccgtctgatctgcccatcgcctccctccgcacgccggcgccgtcgccgtcaccgcgcctcctccttgcaccgccgctgcctcctgctcgctccccacgtcggcgccagcgccgtcgcctcctccttcctcgtgccgctgccgccgagatgtgaatgagagattggttgaagacttgaagtgaaatgtatgagggtattttggtcactttgaatagtaaaatgattctttttcttttcttttttgaaaccctaatggcatagtgtaaatagggtcaaacggcatgctcgattttaaaaagcggggtcaaattagcaaactaaaaaatgtagtatcagattagtagtttggctttaaaacaaggtcaaatgagcaattgtcccttagttttttctagaccaacatgcttattgcttgtgctttttctctctctttttttgtcggaggagacttagaatcgggcgcccgatccaggcgtccaaaaatcgggggctgacgtcagcatgatgttagcgccacgcatgtgtgaaaaaccattttaaactattttttatcttaaattatttatcgaaattatgatctgattatactattaaatttgttgcaattaaatcttcaaaacaagaccacacatggatatattccgacgaaattttttagcttattattgaattatattttaaatgttgcacgatgttacaccaagtatatcggaattatttcactaagtagatcgaaaatgttcaatcgtttaaatcgggcgttgtttcaccttatataaaaacaatgtttcagcaaatagcgaaagaatatttcagttcactgcaatgttagatctatacatagtaaaacattataagtacactggattatttttggtggaacaaaaaagtgaaacgaattctcataatagagggttttgaaaatatgttggtgatctgttacaaaataatgtttcagttcattgcaacattagatctatacatagtgaaacattgtgagtaaactaggtgaaacttttttttttcgaaaaaaaaataaaacgaattttcttaacagatagtttctaaaatatatgggtgatttgttgcatggagttgtgtgtggacaaatgattgggagcaggggacacgtgagtgaggcctagaggggcgtgcatcttggggcgagggagcgcctgatttcggctaccttcccccaagcgaccgattggaagaaatttcgtttttttccgtaattattgcggggcgtcacacaccaccaatccaccgtgcaccatgctcccctccggcctcgcagtcgctccgcctcccataagcctccacgccgccgcctcccgcacgggccgacagcggtatgcacccgtcgaccggcgtgcttcgatgggccggagcaatccgccgcggcccacccgcgccgcgtggtggcggacccgacgccgcgaaggcgtccctcccctcccctccccgccgactggtacgacaccgccgcagtcatcgtcgccggcggccggagcagctaggttcggtggtagagagaggaggaagggagagaagaggggaaagagcctgaggaggaggaggcctcggtaggcatccctaacgccaaagggggaggaggcgacgaggccttccgccaagtgaagtcatccgaggagccatccgccgcccggaaaagtccggtggcgaagaagccgagccggccgcatggggggagtggggggccccaaccggcgtgttccccgccgacatctccccgcccgcggccgcgaatcatgttgctctctccctgtcacttcacaacacgcggaggcagcagcggccggtggtgcggggctgcgggcttcgtctcggcgggacggacggcagcggctgggtagcgtcgcgagcttggaccccccggcggcggcggcgtggggagggcggtgagatcgagtcctgcgacgtcggggtcgggctgtggctgggaaagtgcgacgagaacgagcacgcccggtggcggttactggaggagcacgtcgaggtcgggcccttggcggcggcaaggtcaagccttggcttcctgtaatcaaaggtaaaattttccgaaattcagcgaagaaacggtagaaatttgcatttctaaaagtggcaaatagttaaatgcccctttgcaattgagcctaatgggatagatgaaaaaaattgagagtttgaagtacaattatttatttctacaccaacggcgtttcttctctatatgttacaatcatatttctactcagggagaacctgtcaatatcttctagttgaattcatataacataaacaccatgcgctacttggcaggtgcctcattgtacttgataatgtgtggactgtatcaacatggaatgttgttagacatgctttacaagaggattgctgtagtagaatagtagtaacaacagaaattaacgatgtggctcaggcatggagtttttacaagtctcaacataatgcatctcacgtgatcaagaagcatattttgaagatggaaccgcttaatgacgatttctcaagagatttacttgttagtagagtttttggtgataaagacaaatgtcctgaagaactcaatgaagtttcatatgagatagcacgaaaatgtggcggtttgccactagcaactatcgctgcagccagtcttttattgagtcggccagacaaaccagatgaatggatctatgtacagaagtcgttgattccagatttgaggatacaacctacttccgaaggaatggcacaactactgaacaatagcttcaacaatcttcctcatcatttgaaagcatgcatgctgtatctgagtatatataaagaggatcacataatcaatccggacgatctggttaagcaatgggtagctgaagattttgtaagtgcgacggaagggaaaagtttggatgaagctgcaaggaatcatttttatgagcttgtccataggggaatacttgaaactgaacatatcagctgtagtgatgaggttgtatcttgcacagtgcatgacatggttcttaactttatcaaacgcaaggcaatggaagagaattttgtcactgcaattgatcattctcagtctggtataagactagcagacaaagttcgacgactctctctccatttcggatattcaaaagatgcaaaggcaccagcatgtattagattgtcacaactacgatcacttgtgttttctggattttggaagtgcgggccttccatttcggagtttcatcttcttcgagttctattccttcatggtaaacatggcgaatttcttgacctcactagaattcgtgaactgtttctactgacttatttgcagattgaaggtaatgtttgcatagacttaccatcagagctccaaggactgaagtatctcaggactctgcatattggtgcaatggtgacctttttgagatcagaagttgttcatcttccgccgttgctgcacttcagacttccacccaatctagggtactttgttgacgcagggagtgtacagagtattgaagaactgaccaatttgcaggatcttcaactcgcatgtcctcagatagccacttctgaccatattaagcacaacatgaaactgttgggttcaattattgggatacttaagagcctcaaatctctaacagttgttcctgtctgcttctctgaagattctaatgataacgaaaattcaagcattgccattttcttggatttcttagataaagttccccccccttgtagccttctgcagaggcttgagttgtttccacgtgtttgcgtcttccatagacttcccagttggatcataactattgagaaactctgtattttgaaagtagcagtcatggaactcctgaggaaagacattgagactctctcaatgctgaatgccctcactgttttctcactgtatgtccggacaacccctgcagaacctatcatatttgacaagtcaggattccatgttttgaagtacttcaaattcaagtgtagtactgtatcaagtctgagatttgatgaaggagctatgcccaacctccaaaggttaaagatggaattcaatggtagcacagtggagcaatacaaccttgaaaatgtgggcttcaagcacttgtcaggtgtcaaggtcagcgcaaaaatttgcattgccggtactagtgaagctaacagaatggctatagcctctgtactgaacaatgccatcaggcaaaatacaagaatatcaagtgtaatcatacggttcatcaacagggttataaaggtacgaatttacataccctactgtaacaataaacatgccctcttttctgtgtttatttgcgcaagatacactccttgccttaacattggaatttggacgagatgcacatggtcgattttttcgctattcaaaatattttatttgagaatttaactagggtaatcatttgaaccacatatctattttagtatgccatttggacatgcaaatttgacctgcaatcatccatttcatttttgttttaccaatcaaaacatcctactacctgctgtagtataatgtctttagttaggtcgatcaacagcagtggatatcccatatcctactacgtaattcttttgtacacatcatactgattttattatataaaagaggcccaatgatcagatcagtgacattgtagagatggtactgttgcaaagataatggaagcagcaaccagaaggtgtacacagccacattattacaagcgtgtgtgaaagttcattaaaatgataaaagaagtattcgacaggctagttaactaaaaaaaaaaaagatacataggctagctgttattaaaccaccatccaatatggttgaaaagttctgtgactacgctccaaggtgttgcctgcatcaaataccagatcatgcaactcctcacgctgaagagaccaaaccatagccagttggagcccataaagatgtaagattaggataattccttttatagaagaaaaataagtacattttactgtccgaactatttcattggaccatttaaccccctaattttgttttggctcattttacacctggaaatattaaaaatggttcactttactccctaacgatattaggagccatcgtttcgcttattcgcggaataagtgaaacggcatatttacaaacgaaaaattatttgtaaataaaacttttatatacgtgttctaagcgatctaaaagcaaaggctgaaaaataaactttgatgaaaaaacctcaaaattagctccaaatttaagattaaaaattcaaattttggctgataagtataagcataagcgaaaagttgaggcccattgttccttttcgtttctctctatataagtcatattttgcattgaaattttggtagaacgatagatgcattacaacatatgtcttgtgacattccggtccaatcaggattaggcctgtgtggtacatgagagctgtgtgcgcatgtttagtatcaactgcggtagtgtagcaaggttggaaccaacttataaacacggttttgtagggcgggctgttacacgtctcaccattttttaaattattccccactctttacataagtcggaaacagctaagactgatttaaatgtggagattttaaagttcaagccaacagtcaagaaaaaacttaattttttttttgaagcctgataatggtatcagggatggctctaaacaaattcagcctaaaatacaact

SEQ ID NO: 11490 - DNA, 609 bp, Oryza sativa
ctgtgcgcgagccgcgcgcacgggaagctcgctcaagcccaaccacgccttaacgtggggctcgcttgcccgcgatgccggccggagcagggctcttcgagacatgggttttgcattttgtagtttataggatggactatttcacgcttatcctacagctctttgagacatgggtttgcattttgtaatttataggatggactattccacgcttatcctacagaattttctcaatacacaagcatgcgggtcctaaccccaaaagcaaagaaaaccagagctaatcatggtctagaattctaatcgatagcaattaggtgtgctttacaagtcagccggccctttgttacaagaacgtgcgatagtccgatttccatagcacagttgtatccgaaaaggtaccggctaccagaagttaaagccgcgagtgtcaacttgacggcccgacggctacgaggctaaaaaatggcgggtcccgacggtttgtccaaagccacgcgccacgcgactttagagctgagacccggtgctaccactggttggcccgtgccgctgaccgagtcgtcacgcggccggcctccctggaccagacaccgacccggagcaaga

SEQ ID NO: 11491 - DNA, 756 bp, Oryza sativa
tcctgcagccctgcgagatgaaagcatgtatcagcataagaaagattttcggacaaaggggaaataaatttatggccatgataacaaagataaagagcagttgacactaagttaaagagagcatggtgagagtcataattatcgagagtttccaatacaccaataagcacgtatccagagctaagtgaaattttctgacctccatacagtaggatatttaggaaaataaaccatgcagtgagaggtattcgatattattcccattctttctagtcaaatatcctatgaaaaccaaaacttgaataggtctcgaaactaatagtttcatggaatttaatcttaacttctaaaggaacttcacaccgaggttttaagccatgagggaagtacctggactcctctgtggagaggtgactccaatatctcctatcatctatgcctgtgattgccatagcctttgaggaaatggatatgcaaagaccacccttgttcttctccatccaaaattcctacacacaaatatatttttcaattagatcattgaaacacgacatacaagaaaagcaagaacaagcatcatccaacatagacaagcaaggcaaaccaaatacacatgaaaaaaaattcctcaacttccatatgattatttcatattttactactagtgctccgatctatcctactagcgctccgatatatcaaataagatgtttgagattctcaacaatcaagtcatcctaattctaatatcaccat

SEQ ID NO: 11492 - DNA, 2213 bp, Oryza sativa
gcttttgagatgtgaaaggccctttacgcgcaattcgtactattctataattgctacacagtgcttgcacagaagcacgttagacactaatagaaaaaatgtttttgcacagtcaaaaatagtttttccaggcgggtgtaaggaccgccggcctgcttgcgaaaataatttttgcaggcgacatctccattttcacagctggtagattcactcgcctgtgaaaaaatcacagcgaataaaaaaaaagggtgccgccgccggcctcccctccggtcgacggctctccaccttcatccgctggccactgccacagccgctggtatcatcatcgcgcatcgccgcctctgctccgtccgccggcttccccgcaggcgtcgtcatcatcgtgtcggcgccgtcgtcgcgcgtcgccgcctctcctcctccatccgctggcttcccacaggtggagctgtcgtcgtcacgcatcgccgggagagggaggagtcgagccgccgcctctcctcctcgttggcacaaagaaaagcataagaaattgttcttttatccatgaatcatgtgatccatgccgacaaggctgccacatatctctactattataaaaattgaagatgtttttaccgattactttgatacgttatccatgtatgaatcgatttttaagtttgttcgctttcggatatacaaaaggagttgtacaagaaatccctttaaaaaaactcgcatgctaacttgacactatcggacttctaattgaagttcatgattttctaaaaaatatatatatccaagtgaattcccacaatgaatttcaccttagctaaatcgtataataacaataataagattaaaataacattcacccattgcaacacacggttatttttatagtttgtaaaaaataaaataaatccagtactgttcaacacggacagacaggtgtctcggcagtggttaattgcttctagcaatctagcttgatgatcaaatgaatgtttgctactccatcaagaaatcaatgcagttgtagtgcagcgatagcgcgtggaggcggctactaagtgagatcacagaggcagcacaaggtgattttccagatttaattaggaaataacaccggtataccacccagtagaggtttcaagcatccctgctcacttagtgcaatatccccatgatattctttccatgacaccacccaatcccaacttagggtgtatgcttccattaagggatgtgcgtggaattggactgtgataagagaagtcgtattccaagagaaagcacgcatggggtgttgaattgtggcagagggcaggagtgtttctttattatgactgaattttctcttctcctatggtgtaatgcaattcattccactttattgcgccttcgaatacaactatatacctccagtgtgtattaattaatgttaacattggtatgtggagttccgtccttacaactcaagcatatgtgctctcatacctcaaaatataattaaatagaaaatattgtcaaccaattaataggttgtagaatcgaatacaataaccaaacgtacaagagggggtgaatagtagcaacacgaaaaacaaaaactttttacagagctaaaaatttaccctccaacctaatgaagcccttggcgtagctggtctgactgtcgtgtacacaccagcctgaccgcaacttcaccgcctgcccgaccggtgtctggatggttgaaccactgcctccctgtactgccttctagctgtcgctggttagaccgcccaatgaactccggtcaaaccgttgggatccctaaaaacgcgtatcgacaaaactcttgaaagtacatcaactttattttatcaatatgtatttacaaagtgcacctaaagtactccactcaagtggttgtcacatgatctaggatgggatgctcccacctggcaatggtacacctattatacggtcaagcaagacagcaaatgcacagtgtagaacagtgcagtacgcatagacgcaagtagcgacgtacgtgggtgtcgcgataagtactacggccaaatggagcaaatactggagctataactagcatatccacagtgtgggtctagaaatacctctacaagaggagtaggaagaagatgcggtctaacatgcatgtgtcgaccatgaggaaggactatttttgaaacataggcccaatttgatcatatgcctaa

SEQ ID NO: 11493 - DNA, 10310 bp, Oryza sativa
  unsure (1)..(10310): unsure at all n locations
tctttcttttaaatttagattgttcccattttttgtgatttaggttgtctataaataatttgcattgtttagaatgattttgagtcacaaatgtttagaaatagtttgatttaggttgtttagaagttttatgacttaggttgtttagaaagtttgtgacttaagttgtttattataaattatttaggttgtttagaattattttgatttaggaagtttagaaatattttgatttaggttgtttagagatttgtagacgtaggttgtttagaaatgacttaggttcaattgtcattaaactttgaacaacttaccatcaaaattgattactacgtcttacatgtacttattatttactacattgtattgttcaattgttttctaacttttttgaaatggttggttgtcgttatttttcaaaaggcaaaggctataagtaacttgggtaagtttgcggcaagaaattgggcaagtttgtgtcttcacaggttcaaaagaaatgtgaggtgggaatatgtgactgtctatgtaatttatgtaaaaatttggaatgcatgtgtgcatgatgttaattttgggatgcatctgtgctacaatggagaatatgtgatattgggtatggctaggatatatgtgatgtttcttttttcagagagtgtggctagcaaatcatgagtctagtcaatatttagaaattgttgtttttcgaaaatacctcataactgaagggtcgtaaacaaagaccgtcacatgtgggctcatctgtgacggccttgttacttcaatccatcaaaggtgagtcatccgacaggtacaaactttgcacccgtcttaggtatctcactgtgacgggttgcaaccaaacatgggcatgtggagacgctcacctgtgacgggaaattaaaatactggcccgtcaaaagtgactagagtcaccagtgacccctaatccttgaccgggggaaatccatcgaaggtgagggttagtgtccatctgagatgacctgatacggcatagtgatgtggaaatatgctttttttatttattttatttagattagggatatgccactgacctccgtcattaatatatgttcagagcatgttaataccagagcttgctgatggagttcagtacaaattacctgctcttactgacttaggctccgttcaaccgggaatagtacgcacagaaaacagagcgatctattagcacgtgattaattaagtattagcttttttttttcaaaaatggatcaatttgaattttttaagcaacttttgtatagaaactttttacaaaaaatgcgccgtttaacagtttgaaaaatatgtacgtggaaaacgagggagagggattgggaaaagggtgtaccgaacacaaccttagtgtgtaatctttgtattgtgcttgcaacttccctgcacacatactgtagtgccttgccaagttgcttcggcaccccttgttcccaactcgtctccttgttttccgcttgcacacttttcaaactgctaaacggtatgtttttgcaaaaagtttctatacgaaagttgcttaaagaatcaaaataatttatttttgaaaaataaattagctaatacttaattaatcatgaactaatggatcgctccgtttttgcgtgcggagggaatgagttcccatcaagaacatgcgaacacagccttagtatggcacttctatgcaaaacatcctcatacacaatatttggctgtatttctaccctcaatccctaaacgaagtatgatccatgtacacatccaaattaatttggctcaaatataaacataagtaattgttcttccatccatgaattatgtgatccatggcgacaaggctgccacatattcgtaaaaggatctactgttcaacacgatgtcttggcagtggtagcttgatgatcagatgaacgcatactacgatacggaagacaacataatggtgatgcagcgagtgcgtgtgcacgcgggtactaagtgagatcaaggaggcagaacaaggtgattttccagaactcatcagggagcaacaccggtatactgcgcagtagaggttccagccgaagtttgacacccatctctacttgaacgaggcaagtataaaatcatccttgctcagttagtacaatatctccaccatattctttccatgaaaccacccaatcccaagctgcaaagagatcgatgcaccacaaaaataagggagaatagagtggctgcatattctatttcacagcaaagcatatatatgccaacgatatttgttcttatataggcaggatgaggaaactacaccaaacgttcatatccctattaccttggtagcttgcaatgagaaaactcggagtgttaggcatgcttgtttcagcttataattaagattatcataatctagattattgtgccaaattactgtaagctagattataataaactagactagaataagatgcgagctaaaatatgtaatgccctcaattgtaagattactgtatcaacaaattttgtaggacaacacaccaggttctaaataagaggtgtgcatccaccatatgatggttcatcgttcacaacaaatcatccacgtacgaataaatcgtccacataggttttaggtacctacatttacccctttataaattgaagggtgatgcacttggcagtatagttcaaaactggaaggtgtccacaaccacctgttgttacatgaacttactgcatgaccaggggatgcacatgctttgcgcagtatcaaattaatgtcacagggtcaatgatggctgaattattgctatcaaacaccgttgctaaaagcacagttgaatgagacttcaaattcagattttggatattgaacatacattttgattctggtgccaacaaaaatattaactcatccatacattgcatgcaaagctccatccaaaaatcagatgtatcaaattcagacccgttccctttcccttcgaacaccttttcctaacataaatccttaaaaactatgatatggcaatgttcaattggtccaagcttttctccgcccgaaaccactccttatttatttttttgtttttggaaaaataatcccaaggtctctctactagtcatcgagttacaaaatcgtccccatcagcaaaatcagatatatgacatcgctcaacttacaaaaccgttcattttagatccttcggtggttttgaacccagttttatccgacatggcggctgagtcagcatggccccacatgtcagcatgccacatcatcaccctctctctttgccctcctttcccttcctcctcctctttctctctctctcacttctctgcgcaggctggccgacaggcggggaggaagccggcgtggtgaggccggagaggaggaggaagtcagcggccgacgacgggcgatgcggcggcgatggtggcggaatgttggacaagggacaggcgcagcttctccagcgcatgcgaggcgcaggacgagcggcccacggttgtcacagcaaggaggggaacccggtgcctggggtgcacaacggcatggtggaagacggcggctcgtccagcggcgcggccatccggtgctgctccttttttttttctttttcttcttcctctcctattctttttttgttctttccctccaacggagttgccagatcagcgcttgcagccggtgcggcgaccctggcgcggggtggagtggctgtgcaacgtacggcattttccgacggaggagggcggcatcagcatggccatgcaagtctagggtggcggttacggcatgggctacccggcagcgaccgtgtgcaatggcagcgcagcgcggcgcctgagatggcgtggcgtgctgcttgtcggcggccaggacagcctgcgggctgctcttcctttttctcgtttctttgatttgctctttctatttcatcttcctgatggccaccgacctcctccccacccgctggccagcctgcgcaaagaagtgagagggagaggaggaagggaaaggaagaggaagggagagggtgatgacatggcatcctggcatgtggggtatatgtgggtcctaagctaactcagtcaccacatcggataaaacggggttaaaataaccgaagaacctaaagtgaaaagttttataagtagaaggatatcatatatatgcttctgcagtttgggaacgattttttaaatcgatgacaagttaagataccttgggtgtactttttcctttttttttcctctcttaggctacgttcgttttcagtggttaccaactccccctctcgttctccatgtgcatgtttttcaaacggctaaacggtacgtcttttgtaaaaagtttctatacgaaagtttcttaaaaatcatattaatccatgtttataaaaaaatagctaatggaccactctgtttttcatatgggagggattagttcccatcctcctgaaacgaacacgccggaccagcctttctctctctcggcccatttcaacttttcacccttcactactgtgcagccaagttcagcacctccaattgtttcttgtcgatctctgtcagcttttgtcccaaatgtaacgggtggcgcacgagttaactgcgttggtttgtaagctctagatcggttctactccctccgtactataaaataccaacttactatcaaatgcaaaatattttagtattacgaatttagacatatatctttcaggtttagattaatagtaatagaatatgtcacacgtaatcctagattcattttttaatggaagagagtagttggaacagcacgccgcctgctgtgaaatagttggtgtccagtgatattgctggttccttaaattaaaaaaaaaagattccccagaaaaatatgatcagccacctccctgatctcctcctccgaaccacaccgttccagcacagccgggccgatcaccatggcgccccggccgccgaggcttgccatgctgcacacgaccgcatgctacgctcgcagctgcaactacctagctaccacgatccacagtggtgaaagctaacacaggtagagaaaccatctttggtcagtcgatcaaattccacaatagtcccggttccattaaaaaccgggatctggttaaaaaaaatttaatctttacacaccaaccgggactaaagatgatttttagtcccggttcatcccctgtcagaggcatgtgagggagccgagaatctttagtcccggttgatactaccaacgggactaaagattaccattttagtttcggtttattaccaactgggactaaaattcaacatagtatataatccctagtccttatcctctactccacaatcacaaccactttctcacacacacagatcgatcatcctctcttctccccctccttccctctcctatcttacacagatcctccccttcctccttccttcccccttcccttcctcctccctcccctggagacggatgaggccgctcctccttccttcccagccccttcccttcctcctccctccctggagacggatgaggccgcgccgcgcggacgcggtggacggacggacacgcggcgtgcggcgcagacgtgcgttgcagggtgagcacatgcgcgcaaacgtcctccctcccctaaagttacttgttgtctctttttttttatattttttgattcactaagatgtaattttgtgattcattgtatggatttgagatgtataatctgtgatgtatttgatttgtgtgtaaattttttaggatttgcgatattttagatttgtgtgtataagtaactttaagatttgtgatgcagatttgggatgttactttatttggggatttggggtttgatttgggatgtgcatgccatccgattcgggagaaaataaaaaagtaacaaaaaaaagaaaagggtaccaacaccaaccgggactaaagatagatctttactcccgattatttcacccgggactaaagataacgatgtttagtcccgaattcatagtctcggttaaaaacccgggactatagggaattacaaaccgggagtaaagacagtttctctaccagtgtaatcacaagccacacacacatgcatctatccgaagactaatgacatctaccaatgctaagcgaaggcgctgggacctttcgtcactggcacaaatcgcagagaaccatactgttcacatgcaatgtccagccaacatgatcaaagtggtcaaaatcaacaatctcgtacttgccctttccgtgatgacacccattcctcagcgaagaacacacgatgctgtcacatcaagtactgttttgattactgctaattaagtatgcaaattaacggggagacaggatgaagaaagctagagggagaggcaaagtaatctactgcaagtagaatacaagaacggatcggaggctcgggaatcaatatggagtatatatgatgtgagttcgtgcatatagggccttgaattctaccaaaggacaactgcgctaggatcagctgaatttcatttggttcgcattcatggctgaattctttgataactactggattttccactcatggtggggatttctcaccggcccgttattacatggcaaagattatttttcgttcattgttttgcttctcttttctttgtcttcaaatgagcgcctttggtaagatcttaaaccactgtgtagtgaaagcaagatcatcatgtacgtacgactacgattagaacacttggatcaccatgggaagaaaactcatttgcggtcatcaaaacaatttgtgaaattccggcgtttagttaatcaattgaaccaccaaaaccacatcgacactagaggtttctggtttgggaaggagctatctcgggatcgccggatagtccggccactgtggattgggagagagctaatgatcccctgcgttgtcctcattttgatgcggaagagaagaactacggtagcacattggcatactagagttaacaggggagatcgagatgagattggggaattttttttaccgttttgaactagtttgacaaaaaatatttgaccagagcaactgaatatcgggacataccagtgaatccaatatttcaaaaattttcttttgaaatattttattatgggttgacgacaagtcgttaggtccgatgaaaaatattagctatctatccactactatctagcggtgaaagtggttacagtgaccttagtagcaacctaagtttttgagttcaaatccccataagaacgaattttaaattgggcgcgaagtcatatgagcgcatatatcctgttgggtgtaatacctattctctaaaaaaagtatctagcaataattgatatggaaattaaattagaattttatgctctgcggtatcaaaaggttcctgggctccaagaattatttttagattgtgcagttttacccctctgataaatctaaatgttatgctataccattcacaaacttaatatagagattgtgagccgttcacattaattacatggttgtaccttggaacaaactgtcttcagtatatggcgttttttggttcttgtcgtggtgccctcaaccagggtttgcaaattaatttgttttgaacttttgtgttggggttagctgaaaatttttattatttgaacaaattttagccgaatttgaataaacttttgaccaaattcataaaaaactgaaagccttgaaaatttcgggctaaatagtttcaagtgcgggggaggggataccaaaattgccaaactgccctcaaattgtaaattgcaaattgctcatagttccgatatttgaaacaaaaattgcaaatagtgcgctcaactgaagaaccaatccatgtatgtttgatgtttcactcaaatttagctggaacaacctaatcacaaattgctgattcctccacggatcaagtgatgcctggatacaggttcctaaaaacgtccaatgcttcaatcttgacttaacgatacagggtagtcaaactggaccagtcagttacaaaacattggtttcagccgcagttttgcagccatctctaacttgagtcggttatctatttatctgtattggagctcaagctgatcagtgtcatgacgatattcttttcacgacaccacccattcccaactaatgggatgcaccacacaaattaaaccaacgagaacaaaacggtcattatatgttcctatctgaaagaaactgtgtgtatgcattgatattggcccttatataagccaaggatgcctggatttttcattttagatcttttttaaaaaatattttataaatagacccctacaaaaatnttattntccttttggnaaaatttggggggaatttccccctttttttttccgggccgggcccccccaaaaaccccggggaaaaaacttgacgccgtaccgtggccccaaagacgttggtggcgttccccggcctatcctctatataaaagctaaatcactaatatgaaggggaagtgaaccatttaaaaaaaggatctatttttaataagaaatatttatatgtaggtcctcacaataaataacattggcaccgatgacctatttataaatattattttacaaataagtctttttttcaaaaaatatttacaaataggctatcggcgccaatgacattggtgcactactacaggagatgtcataggtgtcggtttctaaagttaagggattaaaagtggacttattcctatttttttcctctcttggccagaccagcttttttccctttcagcccatttaaatttttcacccttcacaactgtgccgccaagatgagcacttccaattgtttcttgtcgtgctctgtcagcttctgtcccgaatgtaacagggtggcgcacgagttaactgtgttgggttgtaaaattgttggtgtccagggatattgctggttcctttaacttaataaaaataggtttcccataaaatagaatgatcagcatcctcccttctcctccgaaccacactgtccctgcacagccgagccggccatggcgccccgcccgaggcttgctcctgcacacgaccgcactctaggatcgcagccgcaaccacctaccgcgcacacgcgccgcaccaaggtgaccaaccgttcgacggcggtgaaagctaatcacgagccacacacacaagcatccgaagagtaatgacttaattatctaccaatgcttataagcgaaaatgctggaccttggtgactggcacaaatcgcagagaatgataccgttcacgaaccgtgcaatgtccaaccaacatgatcgaaatggtcatatccatctatcccatacttgtcatttccgtgatgacacccattcctaagtgaagaacacacacgatgctgtcacggcaagtactgttttggttactgctatgtaacatcagttaggatcgacctgctcgtttctcttagcttgtgtgttgttagaatgcagaagtgtgcaaattaacggagaaacagggtgaagaaagctagagggagaggcaaggagtaatgtactcctaggatagaggctcgggagacaatatggagtatttatatatgatatatgctaccagaggagaactaggatatgctgaatttcattttgttttgcgttcatggctgaattctttgatgactgaattttccattcatggtggggatttctcaccgtccccttattacatggcaaagaatttcgttcattgtattgcttctgttttctttgtcttcaaattagcggcttcggtaacatcttaaaccagtgtgttgtgaaaacaagatgagatcatcatgtacgtacgactacgattagaacacatggatcaccataagaaaactcattttttaggtgacttgatataccaaccaggctccaattaatgtattggaaaggggggaaattatgtgggtcaccaacaattccagcgtttataatcaattgagccaccaatgcggtcagggagagaactaaattaagttacccttgcgttgtcctcatcttgatgccgaacagacgaacaatcgcacattggcatagaagagttagcagaggggttttgcagccatctctaccttgagtcggccatcttttgataagagtcggtgctcaagctgatcggtgtcgtaaagatattctcttcatgacaccacccattcccaactaatgagatgcaccacacaatcctacaagaacagaaaggtcacttattagacccacccggtcaacacattcaagatattacttctttcggggctgcagga

SEQ ID NO: 11494 - DNA, 3618 bp, Oryza sativa
tcctgcagcccattggatgatatctctttcctttttctttctaacaattcgcagtgtagattacctcttcatgactgaagcaacaattggggtgatttggagcaaatcttatgttggttttccattagaacgaaagtgtatcacaattggcataacactgccaaaaaaaaataagaaaggttaccagttttgccatccccatggaccgtattccggtccaacatctagtcaagagttttacgtatacactctagtcaattgaacaagacaatcactagaatccaatggagaaaatccccgtgtacccctaaaaattttcccaatctttttatatttctgaattttgcttattcccttttaaaccgcaaattttagtttggatatcttcctaacctttctattagttgaccattattaaactcttatgaagaagtctaatttacccctatggtatggaaaataaataaatttatagagtatagaaatttgttgtatgagactttattgagtttgtaaaatgcgaggtagtatttatgaaaaaaaatatttttaaatatgaaataaaaattaatatttatcttctaattattaaaaattttgttcgtagcttatttattggttagtagaacaacatgttttctatatatagatatacgctacacaaatgatttttcataactaaataactaatattaatttttatgtcatatatacaaataaattttatgataaataatacctcgcataataaactcacagatataatagtctcaaataatacatttctatcttccaatactatacttcataattttatatgtttcttcgtaccaaagggcaaaatagactttttttttataggaatacaacagtcgacccacgattagctaacgaaaagtgtatgaaaaggatccaaactaaaattcatagatatacaagagaatgagcaaaattcagagacatggtaggaattacgtagagaaagtttaaagggtacgtacgcagagaattttctcaaagcaatgtgtatgctctcttagccggcgaacagaatcccggcgtcctcaatctctcttcaactcccaaactgaaaaactcaacaatgcctctgaacttgaagacaagtgcattggcgctgcaacaccttcagcagtttttctgggttatattcatccccttttatttggaaacaacgctagtaaatcggccgtagtggccatcatgcacgcgacacgatccgcaccgacgtgcgccatcccacacgtcagatcgtgccgtgcgagactcggactccacaacagactccacgattttgacgtgaactcacacacctaaagtcttacacacgacgtagctgctagccagctggcccacaagcaaaacaaagaaaagaacgacaaactacccgatgaggaacagtgaaaaatagaaaatgcctaaaaagacaacgccacagacggcgagattgacaacatgctctagatcctattcctagtgtgacatctcaaatgaactttgctgcgagagctataacataggtcatcagagggaagtgagaggcatatgtggtgatggagttagttgtaaatttatctcctttgaacttacgttagaggtaggtacgatagacaaagtagtaatgcaatggcggtgcaacatatccgcgaggaggcagcagcccaatgagatggagatggaggtaggctgctagcacatagcatagggagacttttaagagctatgtgaacggcaacaccagtcgaccacagtacaggttccatccgtattcttacaggtatctcttccttattttggtcagcatgctcagcatatacgactccatatcatgatattctttccacgacaccacctattccaagtaaagaaatgcactatactaatataacaactgagaatagagtgacttcacattcctatcagacatgaagtgtatgcttagacattagtccttatataggctaaaggaggtagcatgaggaaacaaacccaaacatgttaacataaattatgttgcgccagaatttgtgatgtgtgagcagggttttcaattttgaaattgtatttttgcctgggaggaccaaaatttcggaaattttgtggctgaaattatttgaaattttgacttattttgaatgaatttgaataaaatttgaccaaattcacaaaaatttgcaaaacaccgaaatttcgggcgagatgtgagcctttgcttgcttcagttattggcctacggtaacataactcttatattagtcacttactccctccgtcctaagaaaaacaatctctagctttaaacctggacatgcccatatacatgttcatagctaggaactgacttttttaggacgaagcatgtaaggaagaagtaaacatttggcctttttttatctcataccatcttaattgaagccctagttgaactggcttttttttttaatctcatacggtcataccatctttcaacatttggccgacattgaaaaaacaatcaggattcttcatacggccaaaagagtgatcagcttatttgttttcaatcatatctagtatggttgttcctttccaatattaatatgcttttgttcaacagtattgagtaaaaatcctcctgcctatcttaagaaaaaagagttttgcaatgcatactccagtcaatttctattcatcgagacacaatcacgagcaagtagcgtgtatgctctagatctcaaatggttcctgttgtcgaattcggatcaactctttggtggggctgtattaatttggtccgctgctatataatgtgcgatacattatcttcaacttgctccctaactgatgatatgatatgagaaattaatggtataatctgctccatatagtgaagtacgtacacccaagacctgtgtgtctgtgctatatatgtgttttggtatcatcagcaattcagctttagtggctagtacccgcaaaactcacaagtttgtgaatctcacatggcctagacgaatgcagagttgtgtgtaccaccagatcaaagactacaatcagaacactgctgagagatcttgtcttggcattcttcctggttcctttcattcctaagaaaacaaatatgcttcaaggagttccagtggtgcacaaacaagcaaaggtagactactctggtatagcggcccgccggaaggagatagagcatatacatgaacctaagagagaattgttttatctctctagtctgtaccaatttgcattaagttagtacaagcgttcaaggctactcgattttaatgtgtacatcccaaactgatcctatacaaatcgcgagtgaaaagccagacaatctgaaggaagtgagaggcaggtaggtgaggtaagaaatcaatgctactccctccgtttcataatgtgtctaattcattaacatctatacgaatattagcaatgctagaaaaatcttagattattatacgaatggagtaggactttgtgataccagttcccagctcaagaacaagcaaggaagcaacctagctgaaacataattctgggtattgcaataatttgatcaaaataggaatctgccgaacaaaagaaggtatcacatgattttgt

SEQ ID NO: 11495 - DNA, 2149 bp, Oryza sativa
ggcgtcatctattaaaaaatagaggtagtaaattttaggtttattaattaataaaaaatatttatgtagcgtataaatatatttatattatatagaaaacatgttttagtactatgcacaaaataagctacatatatgtattttaaaaattaaaaataaatattatttttatgtcctatctaaaaataaactttgtcacaaataatatcttgcgttataaaatgataaatataaaagtatcatacaacaaatttccatactctataagtttatttggttttcataccatagggcaaattggacttttacacaagaatttaacggtcaactaacagaaaggatatggaagatatccaatccaaatatacaagagaataagcaaatttgactaggaatcctatatattttaggaactgccaccatcttatcgaggatggcccccaccgtcaaccttgtcgtcggaacccaccgcctcctcgtcggagcccacccgtgtcaaacttcactgacacctacatgtcgaccacaccaagacgtgctcctgctgcccggacttcgtcacccaacaaatctgttccaacctatcttagattgaccacctatcaatctagtcgttagccaaagccgacgaatcaccatgttgccttcatagttggtgaatgaccagagcgccacgtttggccatctctttattgaatgcaactagccaaaaggcccgacccacccccgccggtgtgtttgattccaccgaccgagaatggcaatcacctccagcttcaaccaagcccgagtgtttggcctcatgtcaccttgttgaaagtagctttctagaaagttcgagtcaccagcccaaagtgtcttgaatccatctattggatcgcaatttgcttctgccaccatcaacccgagcactgcatctggtcatctccttgttgaaaacatccatcgaacggttcaaaccaccgcctgaaatgttatatccaccgatcaaatttcgtttatcaccaccatgctccaccttgcgtgcacattcgtcccttcacatcctgtgtaatcgttgtagcgtggagcacctcccacgtacctctaccatggatttcccataagctctcatacaacttgttctaaagccggcccccaaatcacaattggaaactaaacatgaaagaaacgccatagaagagccaaatttgatgatgacaccgatgaatgatatttgttaacaaagttcaaccgaagcctatatccttgtggcactgattatgggtgctccatcgattcaggcatccaacattattacaatgtattagagttacaacgagcctcagccgaacgtcggcagccactccctctcgcctatggtaagtcacgatgcggttgcaacatatctacccctttatttaagagataggctagaatagagtccgacgcttactctattcctaacacctagtacaactctatgtcctaaactgtaaccgacatattcgacacaaactctaacaccattcaaccatgattggcctccattgaagccacaattaggcttagttttttaacactgccaaataataataagtttaccagtcaccagccagaagcactacaacatatcctcaccaccttcatgcccggcagccggcgacggtgctagctccgatccaacaccggataccagcatcatcaccacacacacagctccatcccaaccccctggtgcgctagagcaggctgagatgcatatgcctccttcttgcccagtcatacaccaagatccacaccatcaggttgaagtgtacaacaccatggatcatctgcgtgccggcacttccaacccacgacgacctcagcagccgtcggtttaactgaggattcaactttgcaggacgggccctgcacgagcatgaacgggatgagacggcgagttgagcgcgcccagttgacgtggtgggcagcatcatggtgatggcgaaggtgaagtagtacaattgacaaagcgaaaatgtgaggagggtggcctctgcaggccacagtgaaaatgttgcctggtgtgtaaagaagaggaataataacagacgctgaatgatgagcctttggagcctggaaggaacaagcaaattgtagggaaataaggcacgtatatatgcaa

SEQ ID NO: 11496 - DNA, 1368 bp, Oryza sativa
cccgttgatgacatcactcagcggacaccatgtgagctgcatattcctttcaagaacttatcaataaaggtaagcccatagtttatagattttagatttggccattccgctagttgttgcttatatatgttgattactaataaataaccactcaccacatgaaggtggcgtcgggcatggccatcccaacggacccttcaggtacttaccactgtaggccgattgcagcaggatactccaaggtcgaagttgagttggtcgaagacgcgtacgaagacctcgagctggattaccctggaggagatggtgagacgcatctacgagacacaagccacaccattattctatggcgcaagcgatacatcatcctccctgggcgacaagcggcgtctcgtgcaccatctcctctggctccgccgtctcctcctcaggctccagcaccgtctcctcctcatgctccagcaccgtctccacctcaggctcctgcaccgactcctccttaggctcctgcactgactcctcttcaggctcctgcaccgactcctccttaggctcctcttccggcaccttccaagtcaagggcaacccaagctccaccgcctgcccccacaagggcaataaagaaggcgaaagttgacaccgccaagaacaaggacccggggtacgattgcacgcaagaggagcttgaagcttacgtggcatcagaagtcaacagacaattcaagcctcgaagtccagaaaagaagattcctatagacccgagtgttaggaacttcttcaggggtatgtctgcacctgccaaggaggccataaagctatcggactatgagcgaacgctcaagaaagcatcttctggaaagtccaaaccagtccctcagcttggagagcaaccaaaccaggagatcgagccgttggtgactggtgaagattttggaatacaagaatttattaatgacaccgggctaactacggatcaattgctaggagacgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgattggagcaaggatcagggacacggacttcttgcaaggagatgacattctctggatcaatttcaagggaatctacgaactataccagctggacgccctcgacgtctctattatgagttgctggattttgtaagtatatcattcagttagatttcttactacgtctcctttaagtaattaggtccttgtatataagtagactatatataatatatactcccttttatcgttgtaga

SEQ ID NO: 11497 - DNA, 1649 bp, Oryza sativa
gtgagtacatatgctctacatttatatttctctgattcaaatacatacaagtgtacattaattagatctctcgtcgtttgtcatttatttatagtgcgcaaagcaaaagcagggaactaacttgtgcggctactacgtgtgcgagtattgccactgccttgcagaccaaatcatcaccacaagagagctcgatgtacgtacaaataaatttaaaatttcattatgtatcgatttgttgtttaattactaataaatttcatacattcatatagtttattcgtatgagggataacctgatcacacacaaggaatttatcgcggcggttcaagaacaactcatgggattcatcaataaacaaatccttgatcccaagggtgaattctactacgacggaaacacaattcataggtccttagcttctgagctagcgactactactacgtcgaaatcgtagctagctaggacatataatggattgtaattaatacatgactatgtttctatatgcatgtgtacacattttctataatgtaaatatatattttggtcatatatatatatatatatatatacatatgcatttgcatatgtacatatgtattgaaacatatataaatataatataatatatatatatgcatatattatatgtgcatatatatgtattgaaacatatatatgcatatatataaaccatgcagcaacagggacatgaaaaaaaaaaggtcagctcgatctttagtcccggttgtttactcccggttggtgttaccaaccgggacgccggtgttaccaatcgggactaaagatcgatttttagtcccagttatttcacccgggactaaagatagcgatctttagtctcggattggtagtcccggtttggaaacagggattaaaggggggttacgaaccggaactacaaacgctttctctaccagtgaaggcaatgctattcataatcaacagttcgtcactactttttttgccggtaaaaaaaaaaagctgtgacaatatagcaaacatatatactctaattttttttctcgaagtaactttgttcactggtttttattgagacttgacagcaaataattaaacggatctgatgtacctgcagttccttggcatcgtaattagttctctgcagtttattaccagcaactaatatttccaaattccctatatatatagaaacaaatggaaacttcaaattggttatttgttaatatatatcaggttagaaagggttagagaaacacgatccacgtccagaagaaggttattatacgtaatgggttgcttggcgaagtgaatatctggtagatatatatagtaatccatgtcccacagaatctctgatatttaacgtacccatgtgaaacagattctattgtatataatccatgtcaaacggaatctgctgtatataatttctgcgattcactaaacctataactagctagctagagtgccaagtcattcaagtatctcactaacagatacgtgttatttttatttatttatttattggggaacatatatattgcattgcaatcataggcacctagggtctcattcacactcaactatataaacgtccacaggtatacgttttttcctatgagtacttctgacttctgagatg

SEQ ID NO: 11498 - DNA, 5552 bp, Oryza sativa
aatggatgggctaattaacaattaacttgctaattgtttatctagggcaaatatatggtgaaaactcaaaacaattacacacataggtgatatttaaataataaacaaccgaacaaagttatacgaacaaactcatgttcgttaatgagatataaaattaataaataccattgctcgtgtttatatctttttatcttatatttctcaattttatatctcacaaactcaagtaggttgtatggttgtctaatattaccttagctatttgtgagaggtttttcaattttttggaaaacttccatatatcattgtttgagataaaaaattgagaaacagcgatataatagtttttatataaataattagagaatttttttgttgatttgttttgcaaagaggtgcgcgctattacagatatgggcaggctgaatattctgaaagttaaatttctttctagtgtgtcttttttagataatagaatagaatctcagcttttgctcaaagagttatagccaattcttttctagtgtgcgtgtgagtattgatcgacatgtcgtttaattttatgaaatccaggacactttgttgtaaattttgtttttcaatgaagtgaaagggaagactaattccgttataagtttgaatgaataaaaacgagtaataatttataagcataattagctgtccagaattttttttccggaagaagtagagcaagctgttcaggacgtagatgtgtagataaatataaatatctaccagttattgttaagagagacttttcggactaggacactgcacgtatacgtatatatttgcatatatacaattagtgaaagattctgagtgcgcatatagtttagtttgaaacaggaatcatgccggctggtgaattggtgtataaatagaagatccagtctcagtctatctctctcatattccttcgatctgcagcttgtacgttggccttcttgtggtacgggcaggagtaggatataaaccttcacgccgatcttctccgaggctgactcggtcgatccagaggtatccatcgatccttaatttgaacataactacttttaagaatcctcacttactatatacatcctcctttctaaattgatcatcatataatacaatccaaaattttttgaattggtcatcatataaccgcatggacataaattttattggaatataattaattcaacatgggacaatagtttacattaatttttaggattaaattagttttctagaactttgacaactgataatatataatacttttggagtcaaatatgctcataccatatttatactttttagttttaagtaagagatttgctctggtcaaacaaaaagtatctcgaggtactcatactaaatcgtttgcgatcgttggatctaacaacgcccatcctgcccagctagatccaacgatcgaaaacgatttagtaccgtaaaataccggtaactcgagttactttttattgaaccggagcaaatctcttcaagtaaatatttataaattcattaacggtcgaagttttaaatgtttttatcaaatcttgtcctaaactttcaaatgttcagaattgaagcgagtatatatgtgtatcactaacgagatcgagtgcagggttggaaattccggaacgatattatttcggccgaaatttttaaattttaaatttttccgtgaattttggtattatttgttcaaattcaactatactttattcaaaatttcggaaatttcggtgagcaccgatcaaatcggctataccgataggttttctagtgactcaaatttgcatggcttgctcaataatgaattaatgatcttgaatttgctgatttcaacagaaaacgacaaccacatgttacgcacgccggatttgggtgatcctccggtggcggagatcactcacccgtttcaccctcacaagctgaggctggccgacaacgtcaccgacggtcactggcctttccggtgcggcggctgcaaggagctcgccgccggccgccgcaggtacaggtgcgagccctgcgacctcaccctctacacgtgctgcgccaccgcgccgctcaccctagagcacccgctgctcccgggccggcacttccgcctcctcgagcggcctccgccgccgccgccatggctcgccgccgacgaccgtggcggcggcggctggaggccggcgtgcgacgcgtgcggcgacctcctgcgcggcgacggcttcgcctaccactgcgccgatgggcacggcctcgtcggcctgaacctccacccgcgctgcgcgaggctgaggctgccagtggcggcagctcgcggcgccgccgccgtcaagctctgccgcagggcggctccccgccgacggtgcggcgtctgcatgtccggcgaggatgggtaccgtcacgggttctggacctgccgcttccgccgcagcggcggcgacgagctcgtcgacgtgcacctgtcgtgcttgaaggagttgatgtcacactcacacgagactctgactaatttgtatgagattctaatggaggacgggacgccgacaaatgattgtggtgaaggtgcatctgcacaagataatagcaggtgtgtatatatgaatttattccctcctgataaataagtttcgttttagaatcattgcagtgattttcgaccataatcattgttcagaacatatgtttgaggcacatggaaatcatatagctaaatttgttgttacagcgagaacttccatagtattacatttatgcagttatttcaataaaaaagccacgtgcaaataattcagttatttcttttttaaaaaaatataaaacgatatgtattacgctgaaaaaagtgttaaatgatagaaattattaatttatgattggaaagtacaacgccgtacatgaaaaactaccagcaattattatgtcataaggaaattatcataacgagctaggggattcccctagataattcacgtatagagtgagatttagtatacaattctgaaattttatattctattggtaacattgtatgtagaaatatatttagattttatatatacaatgcttagcttctatttctataaggtttgaatgtcatataccactcttaacttctatttcaataggcttagatttcatatataactcttgaattatatttctgtagatataattgtatttttatacaactatatgtaccgttatctaactgttaagatttttttctttttctagaaatttctagcttctagaatgaatgcggtagaagagcgtcctaataatataacggatagatgtcaaaaacttattattttataaattagttgctccgaaacgataatacttatcgttttggataaaactaaagtcaaaatttaaaatatttgactatgaaatatttctcatacagatatggagaccatatgtatagattaatcttgaaaagtacttcaataaacttatatatttgttcatatttatacgaatattactcccttcgttctattttaaatgtagttgttgatttctgtgtccaacgtttgctcgtccgtcttatttgaaaaattatgaaaaaattgaaaaaaaataagacacgcttaaagtactagtgatgctttattatctaatagcaataaaaatactaatcataaaaaatatcaaataagatggatggttaaacattggaaaaaaaaaaccacaactgcacttaaaaatgggcggagaaagtatagtagaaaagtgttattaaggttatttcttgagtgttgtttcttggagactttgtgtccttgtacaaaactataaatactatcaagtagttctaacaaaaaagaaatggttgtcaggatatttaaagtttgatcgagttttgtcccaaataataaaaaaaatttactgatcgggatcattgaatgcgctagttacagtggggaaagtaacggtgatgcggaggagttcgagaaccagaatggaacaaacaacggtatggtgccggagatgaagacgatcacccaccccagccacccggagcacaagcttagaatggtgaccaccaccggcgaagcgccgttcaagtgcgacgcctgcaaggagcccggagacgggccgaggtaccactgcctcacctgcgaggacctcaacatgcacaagttctgtgcccatgcgccgagcacgctctaccaccatctcttcggccgcacgttcgagcttctcgccaagccaccgcaaggacgaccggagaaaccgcaccccgccgccaccggtggtggcagaggcgaaagcggcggcaggtggtgcgacacctgcggcgaccatgtgttcggtctcgtctaccactgctcaggcgccaacctcgacctccacccatgctgtgcgagcctgcaggaactcccggtccaaaaccgggagacgttggaccaaccgaaagaaagtcttgctacgcctcaaaagctagttaaagaggtgagagattccctcacttttaagttggctcaaccccataaataagtaacgtgggactattctcaacagggactagccaagatcactatcgacggggtcgccttcgacatcgcggcgttcagcaagtgcagcctatgcagcagacaggaggaggagggcccggatcactgctgccgccgcctccgccgccaggagcaatggtgctactacaactccgacgtcgtcgacggcggcggcgaggccgtgtccctgcacgtgtcctgcatcaagcagatcgcacggaggagatggcaggcagctcgggacatgaaatgtggagggcagatcatgctggcgatcagcgaggagatgatcggtgaaggtggtcctctccatggcattccgtcggagcgagatcggaacatcgtcggcgcggtggtgcgcgtcatcatcgcggtgatatttggagataggacagccatggagggagacatcagctcttgggtagctttaggtctcccatggctgacaaatttatttaccgttcaaagataaatcgattggtgtgtgtttctctcgctcatctattcataggatgctacataaataaataactgcaggtaagtaaataaacaaacagataattaatcgatcgaggtgtctgttggcttgttttttttccacctacttttgcttatatattttctgggatttggaataaatggacttgtatttccttcagtgtaaaatattgtgtgtaatatgcatatactccctccgtcccataaaaattgcatttctagctccaaggctttgttccacaaaattatatttctagccatgtggggcctaaccaattgattcatctatataagtttcattccatctcacataatttgagctgctaatgcttgtaattttattaagtatgctaattatatgggttaattctctcaaacttccttttaatcatttgtatatatggaatgtgtgcatacagtgggttcattaaataaggttattgtggtaattttccaatcctactattttgtcctaaattagctagaaatgcaatttttatgggacggagg

SEQ ID NO: 11499 - DNA, 2463 bp, Oryza sativa
tcataggtaaaatcatgtgacttgtgatttatgtttcgctgccatgtatagatgcataaaatatgtttttggtaccttttgtgcgtacgaaagtcaaaatctggtaattcatttttaccggccattcatgaaaattgatttttacgggtggtcatggaatctgcttgagaaaaatcctgatttctacatgcccttacttttagacgacggttcaaaaaatacgtgtgaacacgagttattgaccaccctgaactaatgttttcttttatataccaatgccttataattgcattggtagttgtttcatgtaatatctgcggtccccaaagtgtcgctcttttaaagaagagggtgaatgttataaccaaatcccatgtaaacccttttatctaatgcaaatcccgtatagtaaatatgcacctcctcttcacgatttggtgatgatgttgatataaaatatgttgctacttattgctctcccctacctatgctttgtagttgtacatatatctttgatcgactaaaaaatttatataaccaaacatatatctcttggacatcatggaacactcggtgtacttgtccttttttgtgttctcaaaaacaatttatattgatattcatttgttatgaataggaggcagcaggaaaactgagtgtagatctgataggactggacgtctcatgacggtgagaagtggaaagctacagtggggagtcaagcctcccagatcttcaaaacctgcaagcatcgatggataactcaagaacgaagagactagtacaacgatctgaaattgaagattatgctgaacaaattgatttgataccttcttttcttgagcagcttctgtttttatgcaaataattgcaatacccagaattacatattactagacgtcaacccgtgcgttgcacgggtataattatatattgttacaataatatgaacagttttatgctacagatgtgttgtttatttttaaaatatagtagattagaattaaaataacttgttagttttgaattaaataattaaattaataagtgctaaattgacagttgagcatggtcataaatcgatatatagttattaagtttgaatttattttcacattgtagtgggattagataaaatcaatccctacctgttacaatctgctattttttattttgaatttcataaattattaatagcaatgctaaatagtacgtagtccaaggtttaattggtacagctccatattattaatttcattttttttagaaaatctataaatgtaaagagcatatggcctgttttatttaatataaaaccaacataatcaatgggtacgattttatgatgattaaactaataaatgctacattgatattgatagtcgaagatgtttagaactctgtcataattagaatagggagttatagtggattagataaaaagagtcctagttaaagtttgctaatcaaaattattaaatttaaaattgttctcgtcttggactgtcaagcaaaaatatttttatggctgctgcttgtcaaacttgaagttacaattttaattgtctaattattaatataaaattgtacttgtcttgaactctcaagaaaatatttgtatcatccctgtttgtgagaaagaatatatatttatatcatgtcgagagacaaataagttgtgttatttgtctttggaaattatatatatatatatggcatcaacttaaataacaatgagcggatacaacgaagcagcacgcatggattaattagtttgaatgtgcagaaagctatagaacaacaaagttcgaatatatatacatataagagaccatacaaatcaaccatgcatgaattatcttcatgcatggtttacagatgcaacgcctacgatggatgtttcctaggtgcaagcaaaacttggcatagaatatccaaattgacaaattacgtaccttcataaagagcagatgagacgaccacggatcgatctctttgggtgcaatcgaacttgtttgtttgggtgaattataacatctcaatgcacctgaaatttattaggtcatatgttggcatagccagatgaagagcatgcagatgaacagctagaattggagaaagttcgaacaaaatcttacttgtgtacgtaaatcagcaatcgtagctgtaggatcagtttagatcaattcttaatagatgagctgagaccccgcaaggacaaatgcattcggtcgacatcgatatggagctttgcctgcatgcaattgcggccaaacctcgggtgcacgatgaaggaggtcgaagttgccgccgtcttgtcgggagcgatgtccgccaataccgtggcagccatcgatgtaggtgaataccctaatgtggtggctgagattaatacgtgcacatatatgggttttgggcctttaaagcagttaaagagattggatggtggaccaatttctaacg

SEQ ID NO: 11500 - DNA, 1544 bp, Oryza sativa
attcagaaaattgatcagtactctaccactgaacccccgcagcacatgacctacttagagtttctctagaaaagtcaatgggggcaggaggccagcgtgggggcagacagcgtgcaggtgggtcacgtgtgtgcgggcagccttggagggcacgcgacagcaggcgtgtggccaggcagatggcgggagatcggcggccgggcatgcgcatggaccgccgccgaaggccttgagatcgacgggcaagaaaggtatggaaaagtcttacctttcgggggcagtcttgacggaggtgctgggaattcgtcggtgctcgccggagaagatccgtcgtcgcagccgtgcaggaataacaagaaaatgcgcgaagcaaaattattatccgcgccaaaaaaaatgacgatgggggcgtgctccggagcccccaggactggggccttgggggaggattcgagggcctcctcacttttggggctctagtagggtccctgctggatctagttttttgatcttaactctcaaaaattgaataggggctgaatttgaggtccctgctggagatgctctaacaattgaaacactttggggggccacagctgaaattacacattcaacactgcttaatgtgtattggtacgaatatacaaactagagagagcaaacaattctcgatctgttgggttcatatatactccctccgttttcaaaatgtttgacacttgactttttagtacatgtttgatcattcgtcttattcaaaaaatttaagtaattatttattatttttatatcatttgattcattgttaaatatactttcatgtacacatatagttttacatttttcacaaatttttttaaataagacgaatggtcaaatatgtgctaaaaagtcaacggtgtcaacattttgaaacggagggagtatactcctaccccttcagattagaatactctatctctgcttgttaatttgggcaccactgcaagcatttgtttcttccttaggaatgagagaggaaccaggaagagggccgagacaagtaggttatcgcagtggtcactttgtagtgattggtctggtggtacacacacagatatgcattcgtctaggccatgtgagattcacaaactgtgattggagtactagctgctgataatatcgatttgcttatgatattttccaaaaagcttaccaattaatagaggagagtcaagggacgacacagagggggacgcatgcaccaggtggaggaccgtcaattagagatgcaatcgatgatggtgagtcgaagaagatgaaggaatagaagatttaagtctcagtgtactttactatatggagcagattataccatttctcataacatcagttagggagcaagttgaagaataatgtatcacccataatatagcaaccaacctaattcagctggagcaaagcgttaatctgaatgccataacaggaaccaagatggaaaaattatcatgataaaacagactgagcatggtgacctaaatagggtagagatccccaggagacta

SEQ ID NO: 11501 - DNA, 383 bp, Oryza sativa
tccctccctcttttcttttcttttcttttctttttcaaaaaggatttaattaaatcctttttcctttagaccaaaaatccaattatcttagaaatgcaatatcttcccaacctaaatccgtgtgactccgttcaacttccaaactcctcaaatctcgagatctatctaatggcacgcttaggggtcattaatagggctttattttcgccgtttgttgagttgccccgtttcgcgtgtagcttcggagcccgaagacccgcagtgcgaggatttctaggatcaagctccagatctcgagcaaggcaagccacctttgaacatcttgagcctatatttgaaatttaattatgttgcttgaaaaatattatgcattgctaggatcg

SEQ ID NO: 11502 - DNA, 697 bp, Oryza sativa
cagggcgagtccaccggttttgaacaaggcgggtgccccccgatcgccgcgacgcgcgctaaaactatttggccggcacatgaatcggctctgcccccggcatgcagctccactcgcgcgcacggcgcctttgcgtccgataaggagatggttgagctttgccaccgcgaattcaaatccggcttccaaggggatgattactccgagcaaactgatgattcgttgtacgacataaactaactattggatttttcgcgcaattttgcacaaaattagatttaagaataattgaatttgacatacagttcttagctcatgtgtttcatagatgtaattgcatttcatataaaatagattctaaagtataattgaatttgatatgtaaatactattttatgttctttacttgcattttgtgttttgtccccaaatacacgacagtgtacaatggacttcaaaaagcatgatgggaaaaacatatacaacttttttacttatgttttttatacagttatattttttaactatctatttttttatcaacatggtaatttctactatttgttctaaaatatagcactttaaccatttaattttgtcctaaaatatatggatatcctcccacttttcaattaatgataataacaataatttaatttctccacatgctttctcatctcaacgaattgggctgcag

SEQ ID NO: 11503 - DNA, 975 bp, Oryza sativa
cgttgtaagcaccagaaaataagggctgatatttgaatgaacagaaaattcgtgttttctgatgtaagttcatctaaaagtgtcgatttcatgtgtcagtttaatattcatgagcttagaaactaattccttccaagcttatactttatcacctttggctgtgggatatgatgttctaatatcgtgcttgcccatcatggttatggccttatggatattcagttctagaattatcctatacttacagatttgattgcctagttattcttctacctgattctaaatactaatcattttagacaagctcgaggattaagagtataggtgaaacggtttggttgcccttcattggtagcacattggatgacacataatgttcaatatattctgaatgatggagaaaataatattttattctggtactccctccgttccaggttataagatggtttgactttggtcaaagtcaaactagttcaagtttgactaagtttatacagaaatatagtaatatttataataccaaattagtttcattaaatcaataattgaatatatttttataataaatttgtcttgggttgaaaatgttgttatttttttctacaaacttagtcaaacttgaaacagtttgactttgtccaaagtcaaaatgtcttataacctgaaacaaagggagtagcatttatttagtaaaggcaagaatgggagaaaagcgaacataccatatgcaaatctgagctttaggtcacaagcatcgaaaaacttgaacattaagacaccttcattttcagactaagtgggagcttttgttagatattttgtgacctattaatatgagaaacctttcacctcttagtgttaactgtttatatgggattttaagaaaaaaccttcaattacccattataaagaaaagatactgtattaaatctttatatggtcatctggtgtgctaattcttcgggctttggc

SEQ ID NO: 11504 - DNA, 1265 bp, Oryza sativa
tgctcaaaagcacaaagcaaaagcttcatgttacgagccttctcaaggtcatgcttcataaaacgaatggtatcgtcagcgtattgtagaatggaaatgccatcatccattagatgagggactactccacaaatttgtccatctactttggctcaattgattagagtgaccagcatattagctacaatattaaaaaacattggcgaaagaggatcaccttgtcgaaggcccttttttgtttggaggaaatgtctgatgtcatcattcacttctattgatacatttccacccaaaacaaaagactcgatccaagaaatccacttggttggatattgagatttcatacgaaatccaaatcaaaatttgatcctttcatacgaagtccttgtcatcaattgtatcaccttagttgccatgtggactcaaaataacctcaaaccagctcgagggattaaaggtgttcggttttgatagtttgaggacatagtttacctggtttcaaagatgagggatggcaactagactaaccgaatagtttaagagtttagggatggaaattatacgttgatgtagcacaattatcggaggaacttcttcggtgtgctgatatgtagatatagcacaaaatgttgtaggaacgactttaatgtggtactccctccgtttcatattgtaagacattctagcattgcccacattcatatagatgttaatgaatctagacatatttaatatctatgtgaatgtggtcaatgctagaaagtcttacattttgaaacggaggaagtagtagataatgccctaaggcagcccgaatccacggacaacaagagcttagtccaaagctccaaagaagatctaatccatgttctgtaataggaacatctagttctattgataaggtggtaagcaaaagtaagttccaaactagaggccattgcctctatttaaaggctacaaagccatctacaactcgatacaactatatgacaacctgatgacatcctaattgacaactaggatgctactcaaaacaactcatctattactcaatgacacttagaacacaactcattggacatacaagtattttctagtgatataatgacatatgcaatatcataattattcttgagttttcatgaagtatgtactatagattcaaaactcaaattttgacttcttgttcttagtagagaaaatccaattctacttgtaacacctatactttatgaattggtcaggtcatgttcgggccgcaggaa

SEQ ID NO: 11505 - DNA, 2273 bp, Oryza sativa
taaagtttctttcttgtactagagggttttctaaggtgtttaggactcttagtatgagtttggttcgtggctttaggctgcctacctcatgtataaatagagggggagcggagcttcccggtatcgcttttgtatagcttttgagagctagtttagttagggtttcgagtttagtcaagatttttgtaaggagtgctgttggtgcactttgtaaacacagagagaagcaataaagttgtcatctactttgagagttcttcgatttgtgtttcactgggtttcggcggtctaaccggcgatatactggtggtcagaccggcggcgctagggcggtcagaccggcggcgcaggccggcagcggcaggtgatctcggcggttcgaatggactttgatctcggtcagaccggcgtgttccaggtggttagactggtacaactactttggtcagaccgcgagccatcgatttcgagggtaacttttattgccgctaaaagtttttggtttttgggtataccaatcattcacccccctctggttggcttagttcttgtgattcgatcctacaagtggtatcagagccacgtttgctctttttgatctttaccgatcttgagtttttgccatggctatttctaataagtttacaactaagcctcatattttcgatggaacggatttttctcattggtgtagtaggatgcaatcttacattatggctgagaattatgatctttggagaaaagtttctcatccttatgtgattcctgaagctattaatactgctgctaaaaaattgtttttgaacaaaattgcaaagctcgcaacattcttttgagtggtatttctcgttcggattatgatcgtgttgcttatcttcaaactgctcataagatttggattgctttgagtaattttcatcaaggtacaaataacattaaaaaacttcgtcgtgatcttttcagaaaggaatacattaaatttgagatgaaacctggagaagctttggatgactatctttctaggtttaataaaattttgagtaagcggtcagaccggccggcgctgtgtcagtttcggtttcgggttgtttgtttggatattcgtgattgtttcatggttatggcttctagatggatactacacgtatgtaatactgttgtttgctaacaatgagtcaagttggagatagcttggtctcagaatatggtttctttgtttgtttcatgtctaggtgactcgatgcctcgggagagtatttgcggtgatggaccgggagtcggcttggtggtaagacgatgtccgtggtggtcagatatcaagcgggatactaaggctagagttgatacacgtggttggtgaagattccatatggcatacgatggaggtattgtgtacgtatgggatgcggagtcgaatttgaaaggagtccaaatttggtacgattggttatgtaaagtttctttcttgtactagagggtttcctaatgtgtttaggactcttagtatgagtttggttcatggctttaggctgcctacctcatgtataaatagagggggagcgtgaggcttcccggattcgcttttgagagcaattgagttgagttttaagttagggtttcgagtttagtcaaaatttttgtaaggagtgctgttggtgcactttgtaaacacagagagaagtaataaagtcgtcatccactttaagagttcttcgatttgtgtttcaccaggtttcggtggtctaaccgacgactcatcggcggtcggaccggcggcaaggcggcggtcagaccggcggaagcgaggcggtcagaccggcgatagcagcaggcacggtaggcgatctcggcggttcgaccggagttcgatctcggtcagaccggcgtgttccaggcggttagaccggtgcaactacttcggtcagaccgcgatccatcgatttcgaaggtaacttttatttccgctaaaagtttttggtttttgggtatctcaaccattcaccccccctttggttggcttagttcttgtgattcaatcctacaagtggtatcagagccacgtttgctctttttgatctttgccgatcttgagtttttgccatggttacttctaataaatttacaactaagcctcatattttcgatggaacggatttttctcattggtgtagtaggatgcaatcttacattatggctgagaattatgatctttggagaaaagattctcatccttaatgtgattcctgaagctattaatactgctgctgaaaaaa

SEQ ID NO: 11506 - DNA, 4164 bp, Oryza sativa
gtcttgacatgtctatttgggagatgaaagttacatctattcaggagtctgttaacatgtctactttgactttggattcgctttacactaaactgaaaactcatgagatgaatattccttctcgtaaaggtgattctaagtctagtgctttggtttcgtcttcaacttctttggatcttggtgcttcttcatcaatttatttaatgccatgtccgatgatcaacttgaacagttcgaggaggaggacttggttttgctatctaacaaattttctcgagctatgaaaaatgttaggaacaggaaaagaggagaaccgaatcgttgttttgagtatggagcacttgatcatattcgctcgcattgtcctaagcttgggagaggcaagaaggaagatgatgggagagtcaaagatgatgacgtgaacaagaagaagaacatgaaggagaaggagaagaagaagcattgcatgcagtggttaattcaagaactcataaaagtttttgatggatctgaagatgaagatgagggcaaaggtaagcaagttgttgatctaggttttatttctcgtaatgctagttctgatgttgataaatctgatgatgataatgaagaaaagcttagttatgataaattagaacttgctacttaaaaatttgctaaaaaacttcaaacatgttctattgagcttgatgagaaggatcacactgttgagattttaaatgatgaaattgctagattaaaatctttgattcctgatgatgataattgtcaatcttgtgaagttttattttctgaaattaatgctttgcgagatgtcaattctgttaattgcaaaaaattggaatttgagattgaaaaatctaaaaagttggaatcttcttttgctcttggatttgctttacatgctcgtgttgttgatgagttgattttgacaaagaatgtgttgaaaaaatacaaagttgctttttgtgcaagttctttggtcaatgcttcatgtgcaaataaggcaaaacaaaacaatggtgttttgatttctcaagattgctcaaagtgtgttttgaatgagatgaagttgaaagatgctttagggcatgttaaacccatggaagaaattgttaaacaagatgaggtgttttcttgctcaacttgtagaaaacaaaaaggtcttttggatgcttgcaaaaattgttttggttggtttttgttttagacttggccataaaaagaaaaaggaaagagaaattgctgttgcaaaatgacgttggcaaaaatcgggttttaattcgaggaacacggttagaccgacactgaccagtcggtcagatcggccagcggtcagaccgaccggcggtcagaccggttgccaggcccggtcagaccacagggacagtggcggtcagaccggcctcagggtaattttgcgcgaaattcaaatcggacttttgtgaagcaaaaaggtaagtttttttggtaagtctgattctaattttattagtgcatatgtacctactggttctactggtcgtgtgactcagtgttggattccaaaatttcttatttctaaccctaacacggaggcctcgacatcttctcgttcgtaggtattttggcggcatactccccatgtgcgtttaactttgagatgacaattgtatagcaaggtaacatcacttacttttggattgacataattttggtctactctcttgtttattagcttttttatatgctactatttgaggttgtagttttggtttatactattggatatatgtcaattcttgagaattttggtgatatcgttggcaattggatgtctttttcaaaatctttgatttcttcttgattctttgttcggggagaattggaggttattttgagggggagttagtgctttttatgactttcttttagcatgattttagggggagtttgtacctcatggttttatcaagcaaaaatatgacaatggaaaaaattgataaaagagagctttgtttatgcatatggtattttcctgtgcatgctagcaatattttgaaggtttatttgtctctagcatagcttgtatgtattctagtcttttcatgatatttagattttgcttttaagggagatgatacatgacacttaaattctatttgaattaagtaaatatgcaatgttgatgctagcatatggtttgattcataaatgctttatatatatgctttattgacttgttattcctcaaatagctttaattgttcattgtgaaaaagagaatagaaatatgaaaaaaaaatgaataccgaatccttcgaaacagtcttgacgacaaggacgtattcgatgtgagcaaaataatgggtgctgaatctctgcaaacagtcttgacgacagcgacgtacccggaataaaagagaaaaatatgagaaaaaggctcaagaaaaagaaaaagtcaaattctctttgttattttgtgctaaaggttatttgagaaagaatgataaatgcaataggtatatgtgttagtgtttattcttcaacctatgtgcttgttaagatgttgcattataaatcgtatgaaatcatgatttttgattgttgattcaagcttaattgtaaaatctttggttcatggttatactttaataaatgcttgttatattatagatggattcatcttctttttattgcaacacatgacatgatatgctatatgtatgttaagctcttatactttaataaacataatttctatgcttgatgaaatcattggcaaaagggggagaagagatgagttttggggagaagagatgtgttttgggagaagagaagagtttctaagaagtgcatgtttttggttcaattgggaatttctttctttgtttttggttcaattgggaatttctttcttttaaggaagcaataaagttgtcatctactttaagagttcttcgatttgtgtttcaccgggtttcggcggtctaacgggcgactcaacggccgtccgaccggcgacaagcggcggtcagaccggcggcatacgggcggtcagaccggcggtggcgacagcaagtggcagttgatctcggtggttagaccggagattgaatctcggtcagaccgacgacaaccaggcggtcagaccggcagtgtaacttcggtcagaccgtgatccgtcgaattcgaggataacttttatttccgctaaaagtttttggtttttgggtatatcaaccattcacccccctctggttggcctagttcttgtgattcgatcctacatgtggaaccatcagaggcccacttgtgaaaatcgatttttgcgtgtggtgcttttaaggagccgtatgcaaaaacggaagttgatttttgcagaggtaaccagtcatgatttgtatgtaacctaaagaatgtcttattcagaataatcattactgtagtagtgtaacttatattcacggtcaaatttgtttttttcgttgtgacgtgtaaaagttgaattttaacttgtatctttacgaagtgatatatcacatgttaatacatcttctcaattttttataactatttgaataacttacaaacaacgaggggatatcccctcgagagttaaaatccactcctagttgatcagccactcaacaaagagtgagcatcatagtgagagagataagagacggagacgaagcgtcgtgcttgcgagtatggggtagcaagaagagaaggcgaaccggtgattccgtgatttcctcaaaattctagattggacacttgggctttcctcttatgcggtggtagacgtcccaagggaggtagggtgacgtgggccgtagctgtgccggttgtaagatcaacgtgtgttttgattcttattctgtgatgaacaattggcatatgtgattattggttttgttatttggagattatcgtcgaagtggttttggatgattggatttacaggtgctattattttatgtggtccggtccgaccggacggtggttgccgctcagaccggagctatgtgagcggtcacaccggccagtctgcggtctgaccgcccgtcgctgtgtcagtttcagtttcgggttgttactttggatatccatgattgtttcatggttatggcttctagatggatacgatacgtatgtaatactgttgattactaacaatga

SEQ ID NO: 11507 - DNA, 754 bp, Oryza sativa
cagccgcttcaccgccgccgtcgcccccgacccgcagaacagcagcgcgacgtcgccgcccgcggcgccgccggcccccacgcaccgcttgatgtagctcgccgccttcctcgccatcctcgtcgtcctgctccccacgtagctgtcctccgtgtgcgtgttccctacaagcatcgcatcgatcacctcgccatcgccatgaacgtcgtgatcgagctcgcatatcgcatgagatgagaagcgacatggtagatggtactgaccgtagaaggggaggacatggtggaggacgtagtcctcgacgtagcggaggccgcggccggaggcggtgtggtcggcgtagacgagggggcggcggccgaacggcgtgtcgaactcggcgccggcgccgacgagctgggacctgacccactccaccttctcctccgcctccgcgctccgctccgacttggctcggagcaggctcagcagcgtcgccgtcgacgtggccttggcggcggcggtggtcacgccggcctcgccgccgccgccgccgtccctggctgctccaagcgatggcatgcttagctttcttgcttgcttcaaatgcttacaaaatgctgtcaattgcgtctctctagtctctatatataggagatgtattctaatagctcgagtggacgtccacccgtttattgcatgtcatctatatggctacgaaaaattttcaaagatatgtggcgagatagatcatatgtaacactccacaacatgc

SEQ ID NO: 11508 - DNA, 14371 bp, Oryza sativa
  unsure (1)..(14371): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgcatttgctctgagtggtagcatcttctactcttttatgatttgtgggcaatacgccacgacctattgcgaggaacatgtctatcgagctcctattactagagcaatctaatggtgtatttctgaagcaacccgcagttcgatccatgagctcccaatcttgtggtgacttcggagagaagccctccatacaatcacaaaatggttttctactgccatcgcagacgccaaaaggtccgcaagtagcaatgcagaaactgaatggtccgcaggcagcaaataaagcgcagggatcagtgggatgggcatatacttcttgccaatattgattaacttgcgaccaaatgctcaacttgagctggccagacatgtctattgagacaaatgaggaagctaattcgtctgatgagtggtacatgaagtattcctcttcatcattattaacataagatggcataaggaaacctttggtctgtgaattcatctctagttgcgaattatgtaacggtatgagcatgttcgtcaattgtaccgatgaccaggtcaaatactctatgtaaggatctcgacgccacaggataaaacccctctcgttcagttggacgaaatatgagccgagacctggatcaataaggtttttctttgatataccggtacgatgcaacccggtgaccttattccacccaaactttgcaccaggaagcacaagatctgtcgcgtcatcaaagctctgccacagataaacatcagataggctttctatgacaaggtttccactatccaagagaattgcactagtattcatgctggttttggcttgtgctgtcctattggcaatttgtctggaccatactgtggattcagtggcacggtttatgatgatggcaaggctactgccatcttgtgagaatttcagctgtgctagattaagctcgtgatcagttattggcctctccctgtttgcaacccacacggtggtacaaactggaatctcgttgaaccatatggcgaggtaccagccaggagatgcaatgtttttatacttacttccagcgtcttcagggagtgtaggcttgaagaagccgagcgcgaacttgccatttctcgagatgagcttttcgccaacggcgagcaactggcccgccgcaagagtgtcatttgtggcatagcatgatggagtgtgcattgagaggaggaggaggaggagcccgagataggcgtggaggggaggcatggaaatattggagaagcatatagtagcagagaatatattgggagtacgtatgtatagcagaaagtcgattcaagtttgactgttgattgttgagcggcgacgctagctgccgggaaactgaactgtcagattaagtgttgatttggacatgagtggcaagcatgtacgaaccatggaattaattaggcaggaggtagactaattagtctccgttgacgccatcggcgtttaattactttggtcaatcaccaagaccaagcctctccagactggcagatttggatgcatatatgcagctgcagctccagttgctgtacgcctgtatattggtggagaataaaatgaacaggaagctactgttaatctgcacatatgtgtgttgctttgatacctgttttaattgatggggaaacagaacaaatatttgattgtgcaagtctgtgactttggcaggcacacggcaacttgagattattgtctattacgacgatacaggagtacgggaccatatatagccactttgtaccggcctactgagtaggaagaagagatgatataaataacctctagtaagtgacaatactacgcgttatgttcttagcacatcactaaaactagggttgaaagtgattaggatagtttctaccaccggacattttttcggattcggatagtttcagttggatatatccaaaaatttttgaattcggatatttttttttcggaaatgtaaacgaatatgatataggtgatctgtcggaatcggataacggtaagatactatccggtatttttcatcggatatccagtactcttatgcaaaaacatgtttttttctctacttaggtagaacaaaacaaaccatataaaaaaacaaggaatagcaattaacatacaaacaaatggaaaaattcaattctgaaaaataaccactcaaattttcaaaaacattcaattcaattctgaaaattttaaaaacttttaattcaaaaattgaaaagtttcagttcgaattcaaaactctcaactcagatttaaaaaattctactcaaattctagaacgtttaattcaatttcgaaattctcaactccaattgaaatgttcaacccaaaatttaaaatattcaaccaattttcaaatatttcaatgtgcctacgaaaatttcagtgatacacattaatttatttgtttcatgataacataaatttgtatggaaagtaaacacaacattttctatctccccatttttaaaatattgatgttttgtttctgaaaactaatggctatatctcttcctcgatttaagaagcttactttgaggggccttgatatttcgataattattcgtcaccatattcgtttcgattcgtattcgctccgtatctgtattcaatatatattcgattccgttttcgtatctgggtttccgatttcgattccgagaaaaaaatatgaaaacgaatatgatagagctagtttccgaccatattcgatccgttttcatccctaactgcaactagtaagcgtgcacgtggattccacgtgactaaaaatttaataaatagatcaggggttgaggttagaagatatcgatattttgggatagaaaagttaaggtttgcttcgaggtttcaatcctagttcgtgagttgagagagaagtgctttagatgcactttgtacacacatattgatcaaacaaaattgatctactttcaagagtttcgtcaatacatgtttttttttgggatcccaacggtttgattggagtacattgtgtggtctaaccggtgggtggtcacattggtggaagggagatggttcaaccggcagtcagaccggtggtgtgcaggcggtcagaccagcagcaatccagcaatgtaaccggtgcaacttcgtcaagttgagggtaacaacttttattttcactaaaagcttttggttttttggtgttcatgacattcatccccgtctgataggcttggttctggtattcaatcctatagagctcagcgatgccagatctggcatgggggaacacggcaatggcgggtatggcagtggggagctcaacgacgacgagtgtggagctaggagctcagcaactgtgactgtggcgctgggagctcaatgacagtaggtgcagcggccgggagtggtgatggcaaatccggtgttgggaagctcgtgatgccgaatctaacactcgagagctcgatgtcggcggtccggcggtgccaaccttgagaggtgcagatccaccgtcgctggcctcaggagctgtaaggcctcggcggcgacggacagtagtgatgaggacgatggcagcggcaattgatgtgggctagttagggtctcgaattttggaatttttattctttttcacaagcagacggcttaactttacggtttacaaaaatcacttctcacgcacgggtgtactgtctgcttgaaaaaatgctgatttttacatacacctaggaggaggcaagtgttatagcacataaaaggaaaacctaaaaaattgaaaatttcccaccagatttcaacagcatgccactcagccatttgcaaaaatgggttttagccgtttgcaaagattatctttcttagtgttaaccgtcataaattttggattatgttcctgctatttgaagaatatgcttatgcttcttgaccaaatctgcatataaattaatgtcctttggatggatgaattatctgtatacttaatatatgggaaaacctcaaagacatatcacatatgaatacacaccggcctacgtatagtatatctatgcctatacgagaaggattcttctgaacaggaatagagagttccgaacagataagcaataagacagcagctttggcaagatcttgaagaccacttggattcaaccagcatttcgtcaaaagacttccaactttccaagattatgtctagaagtccctgacgaatactagtcagggctaggacagggtcagagtattgaatcaaccaactggccatcaacccattgagccaagctgccaagaagatccagaagatcaatctcgacaagatcattagctcactaattagtctaaaatagatccgtatacatccttgtaaacataaattttccctcgtttgtcaatgccaacaggacataagtttattaatctgagaacagcctaaacctatataaaaatcttcttgcatcttactgggatatataccacagaggagacccgagtatacattttactgacaatactattctatgacaaatatatactcacattttgcatggtttagtgcttttaattttcgaagtagaaaataccacagccaaaattttcaaaaaaaaaagaaagaagctgcggtctgaaaaatccattaaattttaactaaaaccatcaaaatgtgagaatttgtcgaaaccaaatgaattcaaccaaatatgatcaagatttcaatcatctggggtactgaaacttttgaaattttggtctgaattttctttttaaccctgagcatgttcagcttgcacttgccgtctatctccaaaacaactagttggataaactttggatactcgtggcatgcttttcaaactattaaacagtacgtttcgtgtgaaaactttatatatgaaagttgttctaaaatataagattaatttatttttcaagtttctaataattaaaactcaattagtcacacattattgccatctcgttttacgtgaaacacttaatctttatcttcatcttcaggatgttcaaacaccacctaagtaatggtaccagcttcttcaattttagggtatatgtcatccgtccgatcaatgaatagcaaaacatacacaatggcaggtaattttagttctatcatatttggatataatgcgtgcatagtataatcagtcattaggaaaagtaataagaaatgagattactcaccagcaccacacagtaaaactaagcaattgccagattattacattggaactttcaatttgctcaaacaaaagactgattacattgaatacaaagtatttatgaaatattacaacactgaaactatatatgagacctttcggttatggctgcaagtagtcttggcatggggggcatgtcaacctcctgtagaccctcaagaaagcgaaccacttcacccattgttggcctatcaatttcatcttcttgaatgcaccaacatgcaactttacaaactctttcagcctcttccaaattgaaatcaccatgtaattctggatcaagcaaattctgcacacttccctcatgaagtttgctgatggcttgcacgggaaaataatcaaaatgataatggttgcttgtgtatgcttcagataaattccttcttcctgatatgatttctagcagtaccataccaaaactgtaaacatcaacttttggagtaatagcgactccgctaagccactctggggcaagataccctttagttcccctgaaagtagttagaacccgactaaaatcccttcccacaaatgccgccatcccaaagtctgcaattttaggagcaaatgatgcttcaagaagtatattttctggcttaatatcgcagtgtatgatgcattcacggcaactctcatgcaagtaggacaatcctctagcaactcctatggctatttgatgcctagtgttccagtctaggacagcaccattgctatgaaaaaggtgggcatcaagagaaccatttaccatgtgttcatacacaagtaacctcttatcaccttcacagcagaaaccaatcaatttgacaagatttatatgttgaatcaatccaagtgaactcacctcagccctgaattgcttttctccctgatgtgaaccatcgagccttttcaccgcaatagtagttgagtctcttaatactcccttgaacacagaaccaaaaccacctgaccccaacttttctgagaaatttttggtagcatgacttaaatcagtgtatctgaaggctattattccactgttgccttggttgtggtgtaatgttacaccacaacacttgaatttgttccgccaaatcaagaagaatagcatgagcattagtaacccaaaaccggcaatgcttgcagcggtaacagccacaacaactggtttttgtttgtttttggtcgtagctggcatatctttggcagctaggcgaaggtaaagagtatcttcagaaagactttcaatgctgtcatgtagctttacattaaggagttcactatgccagacaaagcatgtgctatctttgtaggcataagcattgcaggagcagttactgagacaagattcggcacatttgctttgagtggtagcatcttctattttttcggggttagctggcaatgcgacccgagttattgtgtggaacatgtctgtcgagctcttgttactagggcaatctaatggcgtatttctgaagcaacctgcggttcgatccttgagctcccaatcttgaggtgacttctgagagaagctctccatacaatcacaaaataaatctgaattgccattgcatacgctaaaaggtccgcaggttgcaaatggagtgcatggatcaggaggctgtgcatatacttcttgccaagactgattagcttgtgaccaaatgctcaacttgagctggccagacatgtctattgagacaaatgaggaagaggattcatctgatgaatggtacatgaagtattcctcttcgttgttgttagtataatttggggtaaggaaacctttggtctgtgcattcatttctagtagcgaattgagtaatggtatgagcatatttgtcaattggacagatgaccaggtccaatactccatgtaaggatctcgacgccacaggataatgcccctctcgttcagttgaacggaatatgggccgagacccggatcaataaggtttttctttgatataccagtacgatgcaacctggtgaccttattccacccaaactttgcgccaggaagcgcaagatccgtcggttcatcaaagctctgccacagataaacatcagggatgctttctatgacaagatttccactgtccaagagaattgcactagtgttcatgctggttttagcttgtgctgtcctattggcaatttgtctggaccatactgtgtattcagtagcacggtttatgatgatggcaaggctactgccattttgtgagaatttcagctgtgttagcttgatctctagatcagtgattggcctctccctattagcaacccacacggtggtacaaaccgggatcttgttgaaccatatggcaaggtaccatccaggagaggtgatgttgccatacttacttgcaatgccttcagggagtgccggcttgtagaagccgagcgcgaacttgccgttcctcgagacgagcttctccccgacggcgagcacctgccccaccgcgagggtatcattcgccgcggcggagcatgatggattgtgcaaggagaagaggaggaggaggaggaagaacccgagatgggtgtggagtggagacatggaaatgttggagaaagtagcagaggatggattggagaggcagaagcatggatgtgtgagaagtaggtgttgttgggacttgggagtgtgtggtgatatatacaggaaaattgatgcaagtttgactgttgatattgagcagcgacactagatgccgggaaactgaactgtcagattaagtgttgatatggacatgactggagcagttgtagactagtctctattggagtttactttggtcaatgaccaaagaccaagtaaagctgtagctacatgcctctccaggctggaagatttggatgcttgcagctgcagctcccagttgctgtactcctgtgagctggtggagaagaaaatgaacaggaagcttagtgtgaacctgcacaaatgtgtgttgctttgttagctgttttaattgacggggaagaagagaatggatttgtagaaacagaacacaaattgtttgactgttcaacttcagcaggcacatggcaacttgagattattgtcgattacgacgacacaggactgcacatggccccacttgtaccggcctaacgaacaaatatataatctcaagtagcaagtgacagcactacgcgttatgttcttatattagcacattagcgaaaagaacaggactgcagaaaaaccagctacagattaaccgctaaacaactcattccaaaacacagttgttcttcctagtgaaactaacctagcaatctcattgacaagacagagagttcttgttactgcgaactttaagccttgcattactaaataactaagaggtgcttcatctagctgatctattgttacttctttctcattttttctttttttaaaaaataactgaaccggcagaagaactgccaattgtattataataagtcggagaaaaaacatagccaggttacaagaaaaggaaaaggtaacacctcggcgagaaaatcctcgccaagcacctcagggaaaaaaaaagcgccactactaggattcactgcgtcttctttcttttttttgaccaggcatcaacaaatatttccttcctccagacagaagactgcatcagtatccaaaatacaataagtttgaggcagagatgtgcgattcaatcaacaatacgtgcaatactgaatgccctttcaaagataaggaacaataatttcaaagatgaaggtaaataagaagccagataatgtatcaatgtcagataacaggtactaagatctattccactagtcaacaaattgtgttcctgtccagaattactcatgcggaaactgtgttaacaagactaacatgaaatgaaagatattcaacaagtaaacagttcaaattgtagaagtcaagttattctgtttctatttatattttcatggatcgtacttgacaacaaaacacaatggatcatgttttccttttatcccttctaaatacagttttcttttttcagttttcctttccttgttttctaaatctctatttccagttctagttatttatttctatcatttgcaataaaaaaaaaatcagaaatactggaagaatgaaaaaatgtcaacagtaagcttacgttttggttgttgtttcctctgcttgataataacttttttgtccaatgtactcaaccacttcccaattttgtaaaccccctcatcaacttctttacagtggactttcactaccttaaggtgttctgatattgcagctggtttccacaatggattgtcattctcttctgtttccaattccaccatagatttatattcctgtagcagggaaataaatttcaccttcaattaatcatgcacaacaactttaacaatgcagcagttgtaaaaacatataccttggaaattttaagagtgagcttccgtagaactggtgagtgttcaagaatacaagctagtgccgagaaattagaagcaagacaccactcattgagtaacaaacacttcatcttgctaaacaaagggcaccatcttaaatcacttctgaaaataaactggataaagtgcaagcgagaaagtcaaccgaattttgttgtgaatacaataatttaagagccaagacatagtaatgcatgaaacatattcttaagaagttaaaatggtgaatcagatacaggaaataacataaattaaggagatatctgataagatgttaacgtaagcttactatgttaggtccagctatcaacttcaaattctcagcttctgttagacctcctaggagcacgctttcagaatcgtcgctaacctcatatctacaatgacagccatcacagtattcatcttcacaattaccagagtaactattactgcacgagtcatcgcaatcctggtggggtctgacagatgcttcaactaatgagggcattcttccgagaaaaggagttctgccacaaaaaccttcaagtaagagcgtaacgaggctcggtgcataaatgtccgtgcggtgatactcaccgaattgacaatggaagatatgaagacattgtatcgaccgggacaaaatctcgtaaacggaatcaaagccgcaattcttggtgaaatatagctccttcagcgcaggacagctcgagaagttaaggaagcaattcttcaactctataccagagagttctatcttggtcaagtgtggcgagacaagaggcatgcccttgtacacttcaatgtctatctgatcgaggttatggatcttgagcacctgaactcggcacattacggcatacatgacccacagcatgacgcattggtatggatcactgccgccatcatgcaccacgtcctcgtatcggcgtgcattgaacctcaaatcaagctcgcgcaaaggcgagatgccacggaggagcaccagatggttgacgaacttcttgaactcgtcggagctcttccatctatcagtactgtaagcgacgcgcaggatgtccgtggatttccagaggtggcgccatcgccgggacaggacgcaggtcttcacggcctcgtcggcggacagcagggacaggatctgctggaggagctcgtcggggaggtcgtcgatcccgcactcttcgctgggagacattccgtcgaacaggtggcgggcgtagccggggcactgtgctacgcaaagacacgaagagatcggatgatcccccggcttcaccaggcgctgtgtcgccgcttcgacttcgcggcggtcctctgcgcggcgcggggcggcgctagaacgaagcgcctcgacggggctcttctgaggaggcgtcgccggcggtggagtcggaagccggggcgccgcgtcctctagaagtccagcccttataggatagactggtaatatattataaaaaggtaatagaaactccatgcattacggtttttatttattaatctggagaataaactccagatatattatcatccaaatcacttaaaaggaaacatctcaccatgagctctataggatatgaaacatgtccaaatactttgccagatgtgttatatgcagagcaatgttgacatccaaatatccaattcagagcactctcaggatatgccactcaattcgtagcacttttatattatgccactaggagtgtgaattccttttttcccatgccactttttgtcgttcaatgtcaactctccaccctcgacacgccggcgagtttctccgtccaccacatgccaacgcctgtgggatggacaacgagttcgtccgtcctccacaccgctattgagggggtcttcttcttatcttcctggccatcaaagaggcgaggattgcctccacatcttgttggccatcctttttaacggatgctccgacgaggaatgggttggcaaaagtcgagaaagtcattcttgaaggcggaaacaggaagcaggggtcagctcgaccttgatggcgcaaccctccttgttatctcgggctactccgggcataggatgggtgggcgagcagaagttgagaaggccatccttggcaacgaagacaagaagtggtggataatatagtgacgttgatgacgtttgcagtgtacaaataaacaaggtagatacatacacataatgtttttttttttgaaggaaacccatacatatataataagctagagcgatttactgagccagattctatgtcgcagatatccattcggtgtatgccaccttgatcttcttcagtctgacgaccacatcactcattgtcatcctttcatttggcaaatcactagagcagatcaaacccagctcaaatattggcacaagaaagctctcatccaagttgcagctggaagacgaggagccttgcagtagatgcctatccaccacatggacaagttttgtaggaaatacctgatgaacccactctctaaggcttattaggtctccaagaaacatagcatccattggtctccttccagtgaaaacttcaagaagcatgatcccatagctgaacacatcactcttacgtgatgcttttcccatagagccatattctacacaggaaaaacattaaagaagttatacttaggacgacgtgatatctatcttctatctatctatctatctatctatctattatatactaaaagtccattaaacttcctacaaaaactttcaagccgctatgtgggattcctataaatgctcctaaactgctacgtggctctctaataaatcggtaggcccacaattttcatctattagatttatttttagaaaaaaaaaacaccacaatccatctccctcccctctccccaccagcccaccctcctcccctacgtgagtacgtatcctcccccctcctatcaaatcttctcgtctctttatttcttttcaagtttattataattaaaaatattttttaaataattttcgtatagagaaataatcataacctttaaattgcacataaatcttttttatcgttcttcattgtcgtattcatagtgcttaatcaatcattcaaataccaataaaagctactatattatttaccaataaaagctactatattatttaactcataaggaatatttaattttcatcatatcctaaccttaggatgcaattgaaactgctaaaaaaaatagaaaaaacaacaatgtatattatatgatcaagtatcactttataaaatattcataaaaaaattaaatatgatagatatgacaaaaataaaaacacttaaatcgttagtaacattcaaaaataattcctctattattttaaatcatatcagtacctttcgcatgccatcccaataataaaaaaaattatgtagaaatagataatgtagatcatatcatcatatatcacttcacaatcatgtataattagattagatctataatatcataaaataaaatactataattagttctgcttagcactcaaaaaaaataccactgttctaatattgatatgttaaaataatattatttttcacaaaacgaagtaatgttacttaaatatttcatgaaaaattgacgtcatcataactttcatatttaaagcaatctacaatatcccaaactaaaatactctaattgtgattagcattaaaaatattatctccactttaaaatatgaattatcacaataatgtaaatctagatatgtctagataaatattttgatataattatatctttagtatttaaaggactataaaaaatagttaaatgaactagaccaatgtgtcttaattaagagtaataggaggtgtatatgtttatccgttcatcttcaatctttcgagtttaaacttaagttaatctgagtatatagtatataaggtccaatgtactcgtctcacacatatcttgccttatgtgtcaattctatgttacacttagcccttgtatcaattctatgtatgtactgctatccaccaatcattgaggcagaatattattatatactctttccatattttaatgtatgacacggttgactttttaagatacatttgaccatttgtcttattcaaaaatttatgtaattattatttattttattgtgatttgatttatgatcaaatgttcttaaaacatgacataaatacctttttgcacaaaaaatttgaataagacgaatagtcaaacgttggtccaaaagtcaacgttgtcatatattaaaatatggagggagtactaaaaggccattgaacatcatacatacgctactaggccaccacgtgatccatctatctatctatctatctatctatctatctatctatctatctatctattatatactaaaagtccattaaactttctagaaacgctcctaaaccgttgtgtggtgttaccataagggggatc

SEQ ID NO: 11509 - DNA, 4523 bp, Oryza sativa
cagccggtttttctgccccttttcttgtatccctaaggttttccacaaattatgcatatatgtagcgaccactctttgcgaggttgatgaagaagccacgttgccatggcgctgcttcacgccaccctcgccaatttccttcaaaatatttttttaactaacaatgtaaaaggcaatcatagacgatcatataaacatgtacacacccaccctatgaatgcacatacacataccctatctcctatgagagaaaaatatttgtcaacaaaacatgaaaaagtatgtagatatgagagactaccattcgcaagaaaaaaacttacatacatacgtacaatccaaaatgtcatatggaactatattttatcttttttaattatgttgttctcatataaattgtgctaaaaattagtacaaataattttgacaatatagattattcctttgtatattacccatgatcatgtataggtaaattagatgtataatataagaaaaaaaatcaacactcatattatgtttacaaaggatgataataggtaagtttacatataactgaaataaagcgatttttgtttgaatatgatagacattatcatttagtatatcaaaatctatggtctattttacggtataaatattttcttcttttacggtaaggttatgaggtaatctatggttttttatgatgatatatgacttttttagtagttttttttaaaagaataataaattgcccgcgcatctgtgcgggcttccttcttggttatttttaaacattagattagatgtatgaaagtaatccctccatattaatctcccgtgtacataccacagaaaaataagtactattcatccataataagatcctttaacatttttctaataaaaagaataaataaattgcgcagatgcgcgggcttcctccctagtctatctatctatctatctattatctatctatctatctattatatactaaaagtccattaaacttcctacaaacgctcccaagccgccacgtggcgctcaaataaattagagaaatccaaaaaattctaagaaaaaaagcaaaacatccgaccgttaatttttacttaagatggtggaccattattcttcaccattagatcttatcttaaaaaaaatatcctaaaacccaatccataatctcctcccacccctaacccaccacctctcaggtggccctcaagtacgtacgagacctcctctcccctgacgtacgtacgtacatacgtctcttcctctcctgtacttccttttccttttgtcttgccattttccattcaatctaccaattttctacctagcaaaattcaatatgtaaataaaagtaaattctctaaatgattataatttttacattatattttatttatctacattggccatgtttggatatacaagaatatatcttttggaaaaaaaatcctatcttttacatgaaaaataaaaagtaattaaatattaaattaataacatatatatgatcttcgctcctctctccttgctcactttctcctccctattttgtagctagcaactcattatataaataaaaagagtaaatttcataatactatatctatctatctatctatcatatactctttccgtcacagaatataggatgggtctcatcctatcctaggttgttacattctaggacagaggcagtactaaaagtctattaaacttcctacaaatgctcctaagacacaacatggcgctctaataaattagaaaaatccaagaaattctgagagaaaagcaaaacatccgagatgaaccaccacacctaagacagctaaggtgatttaccaaggtcatcacgagtgtcgcagcaatactgatttgccaaggtgaagatgaatcaaatcatcagtgtataatgtttgttttgttaataacacttcaattttaatttgaatttaatttattaaacatgatttcttaacaaaataagtctactttctttctcgataactggatggataattactcatagggatgaattaaatattttgttgtataaaactaacaaatagcttataaaaattatcaaagaatatcgttgaaaaacaatcgtagagaaatacttttttgaaatttgaagcgtagcatatactgtctggttaatattccaatcttataaatttcttgaacacaacttacgatacatgcccgcgtatacgcgcgggctaccttcctacttcctagttatatataacaaagtgcatatgctatatatagtgatgtacctggtgccatgtaaccaaccgttccagacatgctagcaacaatcatcgagttgtcatcgcctaatagcaacttcgcaatgccaaaatccgccacatgtgctgtcatgtcattgtcaaatagcacattactaggcttcaaatcacagtgcaaaaccacctcgtagtgctcatggtgcagataatgaactgccatggacacatcgagcatgatattcagcctctcgaggaatcccaggtgcattgtgccctcggagcagtgtagcagtttctctaagctgccatttggcatgaactcaagaaccaatgctttgaagtccatgttcgaacaggtatttagtatctttatcaggttgcggtgtcgcaccatgcgtagtatatgacactcagcatcaaagattctgatcgaatgctccagcttcatgtctagaacttttatagcaacaaccaaaccactgccaagttggcctttaaatacttttccaaatcctccagatcccaacaggttatcatcactgaaattctcagtggcaaggacgagatcatgataggtgagtaactgagggcctatgacatctgccatatcaccataagctttggccttcttgtgtttcttttcaaacattaagtataagaaaacagcaaggatgccagaagctaccaagatggctgggagtagaagttttagaagaggtctgctataagggtgagactttttaagacagggtgaaaatccaagacgtggagaaccacataacccagcattcccaatcaaagattgtctcgtaaggttattagagaaaattcctccctctggtattgggccttcgagcctattgaaggagaggttcagcatagtcaagtcggtaagattttcaaggaacatgggaatggaaccagagaggttgtttgaggaaaggtctaaccatgttaagctagttagactttggagagtgctaggaattgaaccttccaaggagttgtgtgagagaatcagataggttagcatattgagctgtcccaatgattctgggatgcttccattcaagaagttactagaaacatcaatttggtcgatttgtcttaggccagcaatgtcggctggcagagcaccgacaatggaattacaggaaagatttatttggataaggttatgaagttggaataagcttgctggtatctttccacttaactggttgttggacaagtcaatgtaatctaacctgctaagattgccaatgctatctggtatggagccagagattttgttcctttcaagaaatagtcgttgtatactcaaaagcgtgccaatctgtgttggcaaagggcctaaaatgtgattgttagagacatcaagcaacccgagatttcccatcgtagcgattgattctggaattgccccagtgagttggttgtaaccaagatctatcagttcaaggctgcttaagttggacattttttctggaagactacctgccaacttattatgatctgcaatgaaactaattaaccgtgccgagagattacccaaatggtctggaagggcacctacgaaagaattatggtccaagataaggtcttccagctgcctacattctgaaagagatgacaagaagcccatattcccctctaggttgttgtggggtagaacgagcttctgtaaagcagcaatgttccccagtgtccgcggtaccgagccagacaactgattagctgaaagaagcaagtacacaagtttctgaagtaatcctatctctggtggaatatttcctgtaaggttgccaaaagagagctctagtactgtgaggcgggtgaggttgctaagaacagctgggattgtaccaacaagcttatttccacccagtgaaactacttcaagtcgtgacaatttagctaaccatgttgggagaacatccacgaaagaattgctatataaatagatttcccttaagtactggcatgatgcaagccccgcaggaaaccgaccggcgattctgttccgggcgagggaaataaatcgtagcatagggagcctgaatgtctgattattgtttggtattggtccggtcaggttcccgttgcctgccagcgccatgactcgaagccaggacatgttgtacagggcttgtggcactaggctggagagctgattgtactgcatgtctagaatctcgagttgagacagggaggcaacaccatccggtataggacctgataggctgttgtttccgaaagataggtacc

SEQ ID NO: 11510 - DNA, 2824 bp, Oryza sativa
ggatctgcccactcaaggagttcccttctagagaaatcacctgaagattgtgcagatgcagcaacaactctggaggtatctgaccggagagttggttgctgcctaattcaagaacctcgagccttgctaggtttcccaggtcaggaggaatcctaccagagaggctgttttcacctagacagagatgtctaagacggcgtagcttgccaagatcagctgggatggaggccgtgaggttggtgtcggtgagcctgaggaaggagagaaacgagaggttaccgaggagaggagtgatgggtccatggaggggcgtgtgtggcagcgacagtccagtgacacgacgatgtcggcggcggcggctgcaggtgacaccaagccagtggcagaaagaggtgctggtgctccagttgcttgtcagaacgccgagggggtcggtaagctgggacttgaaagccagcagggcggcgagatcggtgtcgctgctgccattggcggtggtcgtcggacttggagaagaatagcatgaggtggacgatagcactactactagtacagcaatggaaacgcatgctgatgatgtagtagccatttgagctctgctcgatcgtgtggctgtacatgttctcgtgcaagcagatactacaccagaaaaaatagtgctcatcaatttatatggggaacgagctagcgcatgtggttgtgcacacaattttttctgtttatttcaacatgtggaccgtacttgcccggcaggctgcagtagccgcatggcaagggatagccaattttaatgctagagcctagagctatcagttaatcctagacctgagtgccactgaaaaagaaaatgagaaaaacaatgcccacaactaggggtgaaaacgggaaacggacggaaatcatctttatcgctttcgttttcatatatatttttttaatcagaatcggaaaccccagatacgaaaacggaatcgaatattatcgaaatcgaaaacggagcgaaaacgaaccggcgcgaatatggtaacgaaaatttatcggaataaaaaaacccctcaaactgataaatccaattctcaagtctcaacggtcaataattcaacataaaacataatcatataagtcaaattgttaagtattaatagtacatcacaaaacacaatatatgaagcaaattagtaatgctgttgataaatcccaatgcaggtaaaaaaatattcttatataattttagatttgcataacaaatattttttaaaaaaataatagccaaatatcatggtattcactattcagtgcttaaaaaaataattcaggatattttgtgattctggaaattccgagaaaatttctggaaagttttcgacagattccgagttccgacgaaaactacccttatcattttcgattctgtttccgaggaaatatttacgaatccgtttccgtttctaaaaaattccgatcgacagattcgttttcgaaaataggtccggaatccggaaagtttatgtaccgttttcacccgtggcccacaacgagaccaaaattgagggtgttgacgctgattcaggtcacatttttactatcaacggagggcatgcatttacaacacgaattgatataaaccatctacaagagatgccaactactccctccggtttcattttaattgacactttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtctatatttaaagttattgatggtcaaagctataaaagtttaacctcaactttgtccaaaacgtcaattaatatagaaccagagggagtagacaatttgatgatatgtgggtgtgtttagatccaaactttggatccaaagtttgcaaaattccatcacatcaacctgtcatacacacacaacttttcagtcacatcatctccaatttcaaccaaaatccaaactttggatggaactaaacgcagccatactaggaggttctgatgcttcttcatcaccggctgcttccatgttagttgttgacttgttgtggacctattaaccttacagggtcccctccttcatatgcataaccatatgatcacaccagcggtgcaagctggaatgttcattcttgcaggaagccaggaaccctggaggccaactccagagttgatgtaggagtactattgattactggcatgctgccctatagccaccgtcacaggtaaatgcgcacggataaatggcacagaacgtacccagctgtacagggaagtaatcaataatgttgacaacgaggtgctctccaatgccctgttggaccgaacttccaagaaattctaagaaccaaccgtatcagtccaaccactgagagtaagtataatactgagctataaacctactatagcttaggtggaggagagagatagtaaataagagctagcttatcacaaactccaaaacaaatacattaaatatataagtgagagataaagagaatagaagaaaattataaccaactttatggctaatctattatatatgttgattttagataagctaatagtaggaattgagctatactattattcttgctctggcatggaaacttgattgagttcagtcgcctcatccatggtccaaccattcaggaggttctacgcatgcgacgcctcttctataaatagagcagaggtcgcacagctgtcttcgcagacaa

SEQ ID NO: 11511 - DNA, 23358 bp, Oryza sativa
gtctcgcaatttacaggcgaactgtgcaattggtttttttcgttcatatttaatactccatgcatgtgtttaaacattcgatgtgacgtttttggaagaaattttttgggatctaattaaacacaccctgatatatatactgctccctccgtttcacaatgtaagactttctagcattacccacataaatatagatgtcagtggcggatccatgatttatgtgatggttattcggaattctaaaataacagatatatcgataccgattgacatatattgactgtacgatacatcattttgatgcataatctttactacgaattgtgcgcatatataataaaatatatagaaacatttataatttcctataatcagcatcaaacaattttctattgatctaatcatctaagtatgagtgaagagtaccaaagaatttggaatttttggagattgtatagcataggtcgatagctttatgtagcaaagatattctgatttattgctaatgaaggaaaacactcataaaccacgaagaaactagtagctagcaaaggaatataacttatttcggtaggacaattgatatcaattagacaacaacatgtagagaaaaataactgagtgggcaatatatatatgtatatacaatttgcaaagataactattccctccgtttcataatgtaaaactttttaacattgtccacatttatatagatgttaacgaatctagacacaaaatcttacattatgaaacggaggaagtaggcattaaagtaattgcttattaattgccacaaccaaaatgtaaataagaaaatcaaattagcatgaatatattacaaaagaaagggagggactaggaagactattgatcttgttgggctgaggagagctagaaaagggtggaattgaattgttagggtataaatatcacaaatcaagatagactatgggggtacatataaattatggtcaatatatattagatttgtgtccaaaaataaattatgtgggatccgcccttgatagatgttaatgaatctaaacacatacatatgtctagattcattaacatctaaatgaatgtgggcaatgctagaaagttttacattgtgaaacggagaaagtagtagaattattgtcaagaagaactggtatttttagttgttagttgtatgcaggagatgctcgctacgctagtaacaccaactacattcttttgcagaacaagcggggccatcggagccacaacttccagaggggtatggttcaggctatatgcaacctgggtaccgtggtgcctataccggaggtggtggcaacggtcaaaacggtggtggtggcagtggttattatcataatccttgatgtggatcagtattgctataggtggtggtatgcaatagacaacgctatgtgtgtctatctagctatgaaataaggcatcgttcatcagcttgaaaacactttctatctctatgtgtttttttttttggcgaacctatctatctatgtgtatcgatctagctaccgaatttgacatcgttcgtcagcttgaaacgcttggataaaaactggattgttttgctgacagaattgaagataaagatccataagttttatagataatggaaggtttcccacaatgaaacatgtagccaagatatcaaaaactctgataagaaaaacaacaaagtaaaagaaaagaaagaaatagaaaaacaacaaagtaagagaaaagaaagaaattcaaaatcttgaaattgcggccggagtaatccttcttttcacagcttgttctgtaatgttaacacaaaccaaatccaacataggggaagagaaataatttcatcttgcttgaagttctgaccaccaaaccaagaccacttatagaagcatatccttagggcattaatagtgcaagctatggggcccatatagggctgtcaacgagccgagctcgagcgagtttggctatgtaggcttgagcttgacatgaactcgagccgagctcgagccgagcctggatattgatcgagcttgggagtgagctcgagttcgagctcgagcgagcttcgagcctactcgagcttggctgcttgacttggtgaaactccaaagaacttacttttgtataagagatattaatgcaaattatcggtagtcaaaattaatgggtgctacttgtcttgaatgaagcctctgcagcttttctcatgaattcatggctttgaaacattgcaattaacaaaagctagctactacatctaatatgaatagtagtactattactagcagccagataattgctttattgagaagcattgatgaggtcttgagacttgagcatgtcaagcacgatgacaaatatacattgacccatcaagaatatcttcctacatgcaatacattttatactaatcaagccctgccgagctattcgagctcgagcttgctaggcttgcgagcctcagcctagtcttgagcttggcttgtctagtattcgagccgagctcgaatcaagcctataacgaatcaagctcgagcagcttgcgagctccgagcttttttgacagccctaggcccatacccttagcctcaaaacttggcccaaagacacccaccccacagtacaagcacccacccatagttgtctagattaattggatggagacactaagtcagggtaccaagcccatagtggggtgtgaccctagcgcccaacccggtggaccccacgaaaatttatttcctccgctttccgttccaaccctcgcctcctctcctcgatggcatcaatcgagtactacttctcctctccatcctcgagttgagtactactccaccactcctccttctcctccctttgccgcgacgccgacgggaaaatccgacgaggaggcgtccccagcggcggtggctggcgcggtggcgggaggcgtcctcggcagcagtggctggcgcggcgaggaggaagcgagcgcaggagaaggatggaagcgggcggcgtcctcggtggtcggcgccggatctcctccctccagcgccggcagccgcggttgccggcccgcgcggtgttggtggctggcccggcgacgggagtcgtccctggcgggagcggctggcgcggcggcttgatatgatgatagattggctccaactccgattattgattgttgtttttgtgcatgtgagatgtgttgttcattggttaatatgagatctagggcctgggttcctcttgtgttcttgggacggatcaagatttctttgtttcttttgcttcttggtgattcctcttgtgttcttgggacggatcgagttcttgcttgggaagttcttggggtgtttcggtggcgggaagaaggaaataggtgcggcgggagaggattttggagggcaaatcgaagatttcgccaggaggtatgggcgcgaggtcacgagagagcgaggcgacgctgcccacagcgcgcgtgcccgtgactttcggcgtcgcgcgctccctcacttggaccaggttcctcgcggctttgcttggggccgaggggctctgctagggcgcgcgaccttgctccacgcaagcacaaatcctcgctggcgcggtgtagcaccgggtccacgtcattgcaccgtgagaggccttacttatgtctgctatacttaaggaatgcgtcagcttatgttgcagggtaacggctagcacggtgattccctctgtagtttgaaatgctagctccgctcccaccgcctcccgtcggcgtcgcctacgcccctccgctttctccgcgggtaccaggaagtctccgcagcagcctggccatcccccgtcgctcgtggtcgtggccccaggccttcgtcgtggtcgaagctccccctgccaccgccgccagctacatccacatctacgcgctttgccccgcaaggtgcctcgttccttcgtcgatgtcgtcagaggatctgcacggatggattcggccccaactcctccacagctgactccacggagatttttttttcatatataccaaaaaaaacttgtttcgctataataccatccttaaaataggattcgaccaaatgccactcttaagtcacatgcattcgctataatgcaactttcggcctttcttccatttccaaaatatttttccacaattttagcatttcccggacgcttttgccccagagtcaactggttgaatcggagcagtggattcaactaggagcaacgcttgagacggccgagctcctcgtcgtcggcaccccgtccgggttgccagaggggaatccccatttggacatgctggagctcaccggcgagccgaccaggagcgaggcggcggcgccgaggtctcgagagctcatgcttcgcagcgtctgctgctgcatcttctcctgctgcgccagagcggcgaggaggcgggagttcatcggggagactggctccggggtcaacgcggccgcccgcggcgagagcaagctctgctgctgctgctggaactggttgagcacggcggccttgcgggtcggggagaacgccgcgccgccttggtcggcgtaacgtggcgagcgcgacgccgcggcggcgagctcaggctcagccgagaagagctcgtcgagatttgacggcacgagcgccttccccctcgcggaccggatggaggcgggcgagccgacgaggccatcgtagtccgcctccgccgccgccgccgcggcgagcagctcgtcgacggccatgtcgcgggcgctcagcaacgtgcgcagccgactcagatgcaggttcccggcgctcccgggcaggcagagcgccggcatgctcggctgatgcgaccaagcgccgccgcccatcccgctccccccgccgccggccgacggcgacagcggcggcgtgaacgacgaccccggcgacgacagccccatccccatcgccgccaccgccatctccaacgccctgcgcggcgacggcacggccgaccccgtggacatgtacagcgggcagagctccgattcaattgactcaggggcaaaagcgtctgggaaaagctaaaattgtggaaaaatattttaaaaatggaagaaaggtcgaaagtggcattatagcgaatgcatgtggcttaagagtggcatttggtcaaatcccattttaaaagtagcattatagcgaagccagtctttttgggtggcatatatgcaaaaatatcagctcgacgcccccaattgaaatccacatttactctccctatccgaagcagctaccatccggccaacaatgccaatggctagcggcgaagtacctcctacgactctattctaccccggcgtcacgacgctggtctagaccagggagacagcacggccaacaaggagacagccggggaaaccgcttggatcccgatcaaaaggcggcattggtggcgggtccagctcaacagcgacaaccgacaacgagttgggttggcccgatggtggcagcgttgaggagtgagcgagaggcactgacggaagagcagctggatagacaggagtgacgtggaaggaaacaattcgcattcctagtagcaaattacagaaagtggtgccggattgggtggcaaattctaaaagtgttaccaattggatggtatataatgaaaattctcaaaaatcgacatgctaatcgaattgaggaagcagaattcatcatcccacatagaataaatccgaattaaccaaaaatttcaaaagaaatagcaaatcacagtatactaggtccgtccaactagattacaagcacttctaaactctccctaggccatagtaaggcagttacaaatacagacaaggttattttgtcagttttaaacagttactatgactagaacatcaatatgataccaacagacataataccgcaaccttctcaattgtcacagcaaattaagcaccaagccaccaatgctctgaacagtaacatagtagtagatccatggaacagcccaacttttaaagcctactcgaaactgaaacctgccagagaaaatgcagtcagtttatagcctgagaattatctgcagcaattgaactgttcagatacttgacaagaaacttaaaaatatgggaacagacttatacaaaaaaaagtagttttaataaaaaccaatgttccgaaatttctttcatacaaccctattttttaagaaaaatgtttcataaaattagcatctttatgcaaaatactcaaagccattataatatatcttatctcaagtatatactcacataataggaccgaaatacacattcctaggctacactatctctgtcctcactctcccactgcatgacggcaaaaaagatgaaaatgtgaaccccaatagtagagatgtattaactagttgtataaacccacaaagggtcatgctaccggcaaccaatagaggagaaggtagctaatatgtctatttactcaactataacacattcaatctttgttcaagtactacagataaatataataggttagagtcatagccaaatcaatgatatatggctatatgcatatacctgaggttttatgtaaagttttgctccacaaccagggtttgtgaaatttaccaaaaagaaaggtggaattcaattgaccaggatacaatttaatcatagtaagatgttctagtaaattgtatgcaaaaacatggttaatggtattgaaccatttccacctgctcttaacaagagttcatcagcctaaactacccctacatatagaacacagaccaaccatgttttctctttaacatcagaaagtaagcatcagtcaaaggaatttcattcacagggggccaggtaaggaagtatcataagcaattgcagagcataataaaacaaaaaaaaaagtggaaaataaaagtaaatcatagcaggttgaaaggtagaaaaacaaagagagtatctaagaataagctacagtctaaaggcaccaccgcaccatgctaatgtatgtgtgctactactcagataattcaagaagggtgttaaacgcacaattaatagacatatagagagaagcattgcttcattagctgttcacatgcatgcagttagcctgtacgaagaacagaatgatgggtaatatagtcaacaagggtatggaatcgagcataaataagagtggagacacaagacatttcactacagtgcgttattccatggaactataaattattaaatgcagaaagacagacaatcttgctgctgttcagaaatcagaactaatatgtgaactgataaattatcagcagaagacaaatattcaaaactattcaacaatttaagcaatgtacttcacaataaaatagatattatatagctttatgcaaactatctgctaacatgatggattagattgagctccacactctcaccaaaagcaggacaggatttttcattttcttttcaattaggtattcctatatcttgattttctaacaaagtaggagattctagattatttgctttctttcacacaaatgaagatgaaggaaaaattcagaagtatagaaagaacgaatggtgttgctagttatcttacaaatattaaatgtagataagaacttcagaattttggtaattctcccatcaatcgcgttacatttgactatgactaacttaagatgttttgatattgcagatgatctctccatttgactacaacttcctttcatttccacctcatcatcatgttcagtaacctgcaaataataacagtaacaaaaacaacaataaaatacttggccaagatatatcaatgttatctaagaaatgtaaccacaaaacggttttccatttagaatatatacctcgaaaaaaaactcaagaatgagtttctctataactggtgtgtgtctaagaatggaagtgattccatgcaaatcgaaggccacacagaagcagttaatgagtaacaacgtcttcaagttactaaatgtagggcaccgcatcaattcctttttgaaaataaactggacaaaatgggcagaaaagagatcaactaaaacttgatgttagcagattatttaagaactcccttgtggtggcagtgtatgtgaaaaggtcattctagttgttatttacgaatgtccagtgatggacagtctttctgcatatgaaaaagtgggataatataaggggggttaaagataaaagtggaagcatagcatacctcttgttcatgagctgacaacaccaaattcttagcctgtgataaagcttgcataatcacacaattggtgttgctatgacaaaagtcacaatcctcacaaaggcattcctcaaaatcagcattaccacttgtacaactataccaatccccagatcgatcgtgtactctgacaaatgcatccactattaacggcataacctcaaagacaggagtccggtgccaataattttctagccgcaatgaaatgagattaggggcagaaatacgagtgcgggatatttggctgaaagtgcaatgtctgatattgaggcatttcatggactgtgaagtgatcttcttggcatctgacaagtcacagaagaagatatctagatgttccagcaccggacagcatgagaaatcgggaaaactgtgcatcaaatggacaccagaaaggtttagcttcgccaagcaccgggaggctagaggcaggtcgtctagcttgagctgaaagccattaagaatgagatccagccggagcacttggacctcgcacagaaccgcatgccggaaccagaggttcacacggcgggcgtcgccgtcggacgacagccgggtcaagttgagccagcacgtctcgagcggcgcgcgcccgcggaggagcagcaggtggtccacgaaatcctggagcttttccatgggcgccggctcccgcatttcgcggtcggtgatgcgcaggcccgtggcgaacttccagaggtggcgccaccgccgcgcgagcacgcacgtccgcgcggcgtcccgcgccggcagggacccgaggatgtggtggaggatcccatccggcaggtctcctgtccggtcttcgtcgccgtcgctgctccgaggtagggctctcttgcccatttccaacgtcttcccttgtggacgcattccgtcgaacaggcggcgggcgtcggggccacggtgcaagaaacaaccagtgtgactgtacggacgcaggggcagagcaaaagtgagagtgaaatagagaaggatacagcggcctcgccgccggtagcctcacccgccggccgccgcgtccatcctgccctagtggctagtgcttacggggaggcgatagaaggacgcaccttgccggggctccgtggtacgaggcgacgcggctgcagtagcgcgattctatcttcggaggagtcgccagcgagctcgtcggagatgtccgccggcggcggtgtcggtggccgtggcgccgccgtgcccgcgtctactgctatggtattcccaggctggccacctgaccgaggtaaaggcccaattactggataggattaacgggccggaccatacaggcccacaagcgtgggccatgaacatttcagtgctgggcccatttaaaggtccaacacgtaggcccgagtagatttttataaagaagcctcgtttggacatacgattcaattaccttcctgtgcaactcaactcctgtactctgtacaatttattgttcaaaactactctgaatgaaaaattcagcatgttcttacggtttaatctgcggaaaactccatatacactctcatctataacgaaaaggaagcatctctcaattcgacatgacctccacagattgacaaacatgctcaaacacattaccagatgtgcatactatcaaacatttcagacggagcaatgttcacagagctagacatgttaaaggtagcagatttatcaaaccagaaacccatagattacctgcacttccaaatccttttttttagggccctacaattacaaattctgacttatatttccaactgtcaatatgactggaactgacatatgacacctacagacagaaaatggcaaccttctcagttgtcacagcaaattaagcagtaagcaccaacgcggtgaaaccattttagacctgtagatccatggacaatccagtttttagaccttacttgaacagaaacctgtcagtaaaaatgcaaggtaagttcacagtctggtaataatcggcagcaattaaaatgttcagttacttgacaagaaacttgaaatcccaggacatactacaaaacgagttaatttcaaagagtctgaggtttagcaatttgtttcatataaccctagtttctaaggcaaagtgctccataaactagcatatttatgcaaaataagtttacagggcacagatgggtgattcagtcaacaatgtctgcaacactcaatgacctctcgaaggtaaatttcaaagatgaaggtaaataatagccatatgatgtcagaaaacatgtatatttaagagctattcgacaagtcaacatattgtgttgctgtccagaactactcaatcagaatgaatgttaacaacattaacaggaaatgaaagctattcaacaagtaaacagttcaaattgtagaagccaacatactttgtgtctatttatattattactcagtgcaacagggaaaactctgtacaatttcatggatcatacttgacaacaaaatatactggatgatgtttcctttttatcccttctagatagtttttttcattctttttttttacttttccttttcttttgttaaatctgtatttgcatttttagtaatttatttctttcattaacaaataaataatgcaaatttcagaaaaagtggaagaatgaaaaatgtcaatagcaagcttacgttttggtgattgattcctccgtttgataagaacttttatgtccaatgtactcaaccacttcccaattttgtaaaccacctcatcaacttctttacagtggactttcactaccttaaggtgttcagatattgcagctggtttccgcaatggattgtcattctcttctgtttgcatcatagatttagcttcctgtagcacgaaaataaatatcacatttaattaatcatgcacaacaactttaacagtgcagcagttgtaaaaacaaataccttggaaatttgaagagtgagcttccgtagaactggtgagtgttcaagaatacaggctagtgcccagaaattagacagaagacaccactcattgagtaacaaattcttcagcttgctaaacatagggcaccatctcaaatcacttccaaaaataatctggataaagtgcaagcgacaaagtcaaccaatttttgttgtgaatacaataatttaagagccaagacagtagcaatgcatgaattttgttaaggtgacaaaatggtgcatataggtaaggcaagtaggcaacaaaggtaagttacagcaattaacataaaggagataagatgtcaatgtaagcttactatttcaggtccagctatcaacttcaaactcttagcttctgatagacctccaaggagcacacaattggaactgttgccgatcttatctatcataccatgacaaccatcacagtcttcatcttcacaattaccagtgtaagtattactacaccagtcatcacaatcctggtggggtctgacagatgcttcaactaatgagggcattctttccagaaaaggagttctgccccaaaaaccttcaagaaagagcctaatgaggcttggtgcataaatgagtgtgcggtgatattcactgaattgacaacagaagatccgaaggcattgcattgactgggagaagatcttcttgacagagtcaaagcagcaattcttggtgaaatatagctctttcaatgcgggacagcttgagaagttaagaaaacaatcctttaacactataccagaaagttctatcttagtcaagtgctgtgagacgagaggcatgccgccatctatttcaatgtatctttcattgaagttgtggattttgagcacctgaacttggcatattagagcatacatgacccacatcatgacacattggaatggattactgtcttcgtcctcgtcactgtcgtcatctgattcaccgtcgtcactgtgttcatctgattcatcgccatcactgtcttcatctgattcatcctcacctctgtcatcgtctgattcatcctcgtcactgtcttcacccttttcatccttctctcgacatgaactgaattccaaatcaaactcgcgtagaggcgagcagccccggaagagcactagatggttgacaaacttcttgaaccgcttggagctcttccatctctccttatcagcatcaaggcgcaggacgtccgtggatctccagaggtggcgccatcgccgggacaggacgcaggtcttgacggcctcatcggctgacagcaaggacaggacgtgctggaggagctcgtcggggagggcgttgatcccgccctccttgctggcctccgccatctcctcgcctctcgagccccttcgcctaggaggcattccgtcgaacaggtggcgggcgaagggcaccgcgcggcaagaaacgaagagccgactcaccgatcacccaggcgctggtggattagccgccggtcgacgacgacggcgaggaggagccctagcctggcgccgcaagctcgccggatccggccgccgccggcggagtcggtggctctggcgccgcgtgccccccgcttctagggcctagtgcttcggggagtcggggtcgcggctctatgacctaaccgtcggcctttgaacatttccgctactgtgggggctctttcacgacccatggacggttcaatttcctgaatggaagaggtttattttggaggaaataaaaatctcacaaatattatgaccaaactattaaaaaactatagatttaacattaaatttataaaaaaactacacgttaaagatagagtgtcataaaattatatatttattggtaacaaaattatcataaaactaccgatttagaattgatttagtcacaaaactacgatgcattgtttgaaaattgcttttaaaaacttatattaatctatttttaagctaatctattgctctgttttatgagtcaggggaagattcccaacccctctaaaagaacacagtctaagggtgtgtttggttgagctgtggcttttggaaaagctgttgtgagctatgggctgtggaaaagcggctgtgaaaaatcagttgtgggaaaagcagaagcccgtttggttagagtagcggtgaaactgtagcttctagaagaaatacctataatgcccctaaaagccattaggagtgtaggactatttatatgcaaattactcgtaaaaacctaatatgtccaatatctcatatttaaaaggccgatttggaaagaaaacatttataagtttttcatccatcaaagtttttcatcaaaatatattagcttttcatccatcaaagtgatatggtccacataaacagagcaaaagataaacagttcatacaatgataccatatctcaaaataactatcctcctcttgttctaatcaaagcatcagctatcctagtgcgaatagtattcatggtattatcattctctgtatcttcactctcatcgtccgccgtgtcacttgtatcttctagtaagtagtcctcatcagcatcacatctcttaaactccttatcacgtaaattgctatcacggataaagttatgcaaagcaagacaaaccatgatgatatgcttctgagtagtaggtgagtaacttgggatgcccttcaaaatacgccgctttcaataacatttcgacgtcggggcagtggcggcgtcagactgcagctccctcacctgataggtgaacgacgggcgcttctttctggatgcacctcctgcattagctttgttgttcagttcaaacatcaatatatatgtagaaatgtgtatatattgatacattctggacacattactgttctggacagcaatatatatgggcatcagtatatattggtgttctggacacattgctcggtggcaatatatatgtacatagcagagcacacctttgaactaaactaaacagcaatatattattgaaattataagcacataatgatttaatttattccataaataaatcatgacattgcagatgtaaactagattgaacgcatcattagatctacacatgtaaactaagtagtaaaacatgaacagatcaaatatgcgcaacatgtcgaacacgtaccgaggtgacggaaagaccggttgctcggcaagaactactcgtggttgcgagcgtcgacgaaggcgcgaagcacgcgagcggagaggaaggcgagccatcgcggacgaacagggagcagtcacgcgaagcgcttcccaaaaaccgtattgccgccttctcccggtgcaggacgtcgaaggcagaggttccggagacctactctcccgatcgccgattcacgccgacgagcgggatggagtagtctacgagcgacagcgcagcacagagtaggaggcaaaccctagattgatttcgcgtgtgttgcgtgaaggcggtgacccggtttatatagagataggtcgcctgatcagggcgcccgcttaaccgaaccagataagtcgcgcgtaacctatccggactccacgccgttttcacgcaccgaatttttcggaatgtttccaaaacaaaacaaatccgaatttcccgcagcaaaacaaaactgcaaaaggaggctgcatctgcgcaagggtgaggagccaattttgcggaccattcgacgcgtacgtcgtgcacgcgcgccgcctgccctgccctgccaggcgagcgatcgcgcgcgtgtgtttcccctcttctctccaccacacatgcttcaagtggctaggagggcatcctcccttttaaggaggtccccctctcctagaataagcaaggtggtactaaactccacatgcatgccatctcatgaggtgggcttttgtgattttccaaagaattaatcttcgaatgggccttagcccatctattaattccaacaatcccccaccaaatctcaaaatcccactagagatttgtcttttccaatgtactgtttatataccagcgattcgatggagaccgattaaggttgaacatccacctagaactctaagctacacttactcacaacttgaacaatggactacgccttgaattgcaagtcttgtgcaagcaagtttcactcagagtcttatctggtactagaccgtctgtagactacccctcgggtggagcgtataagtcatactcctaggtctttagtaagcttcctagaagattcacccaaaatctccatagactgcgaccaacagtcaagcttacaaaggtgagttctttcaagaatgcatcttcactaattaaagccaacagaactcattaaggcatagccaacctgccttgcagctcacgagagtacatgcatcttcacttagagagggtatagattggtactctcctctagtttactaatggtttgttcttcccaggttctaattcacgggatcttcgatcacatagactgggttaccaccatagtataactcacatgggtctcaaacccatctccttcgatgcattgtctatcacatttcgtgatagtccctttgtgaagggttctgccaggtttctagctgtttggatgtaatccaacgttataactccggagtttctcaatttcctgacagacttcaatcgtcttttcacatgtctagactatttcatattatccttagaactattcactttgacaattaccgtttgattgtcacagttcataaggatagccggcaccggtttttcaacaataggcagatccattaatagatcacgcagccattttgcctcaacagtagcagtatccagtgccgtcagctctgcttccatggttgacctcgtcaaaatggtatgtttgcaagacctccacgaaacagcaccaccacccagtgtgaagacatatccactagtggctttgatctcatccacatcagagatccagttagaatcactatatccctccagtaccgcaggatacccagaatagtgaagccccaattccatagtacctttcagataatgcattactcgctcaagcgcacgccagtgatcatctcccggattagaggtaaaccggctcaacttgctcacagcaaaggagatatcaggcctagttgcactagccaggtacatcagcgagccaatgatttgggagtattccagttaattcctagcaattctcttgttcttgcgaagcaacaagctaggatcataaggtgttggagaaggcttactatcaatgtagccaaagcgattcaagatcttctccacataatgggactgcaagagtgtaatcccattatcacctctaattagcttaatgcttaagataacatcagctactcccaaatccttcatatcaaaattttgagacaagaatgatttaatctcatttatcacctcaaggtttgtcccaaatatcagtatgtcgtcaacatagaagcacagaataactccctcacccccaccatggcgatagtacacacatttatctgcctcattgactgcaaagcctacagatgtcaatgttttgtcaaatttctcatgccattgcttaggatcttgtttcagaccatacaaagacttcaacaatttgcacactttgccttcttgaccttcaactacaaacccatcaggttgatccatatagatctactcatctagctctccattaagaaaagctgtcttaacgtccatttgatgaacgagaagaccaagtgaggctgctagggaaagtagcacgcgaattgtggtcaatctagcaacaggtgagtaagtgtcaaagaaatcttcgccttctttctgagtatagcccttagcaacaagccgagccttgtactttttaatagtaccgtcaggcctaagcttcttcttgaacacccacttgcaccccacaggtttacatccatagggtcgctctgtcacctcccaagtccagttagcgataatggaatccatttcactacggacagcctccttccagtagtctgcatcaggagatgcctatgcttctgaaattgacttaggagtgtcatccacgaggtacacagtgaaatcatcaccaaaggatttagccgtcctttgtctcttactccttcgaagagcttcactgacatcctcctcagtgacatgttcatgtgtatgttcagtttgttatggtggtgtgattgaactgggaattatttcagagggttggctcgaaccactatgtgtatcttcattgggaaaaagctctcgaaaaaggtagcatcacgagactccataattgtaccaacatgcatgtcaggtacctcgaatttaactattaaaaatctataggcaatgttgtaatgagcatatcctagaaagacacagtccacagtcttaggtccaagtttgcgcttcttcgttattggtacattgactttcgccaagcacccccatgtgcgcaaataagaaagtgatggttttctcccaatccatatctcatatgaagttattcaaagcaagacaagccatgatgatatgcttatgagtagtaggtgagtaacttgggatgcccttcaaaatacgccgctttcaataacatttcgacgtcggggcagtggcggcgtcagactgcagctccctcacctgataggtgaacgacaggcgcttctttctggatgcacctcctgcattagctttgttgttcagttcaaacatcaatatatatgtagaaatgtgtatatattgatacattctggacacattgctgttctggacagcaatatatatgggcatcagtatatattggtgctctggacacattgctcggcggcaatatatatgtacatagcagagcacacctttgaactgaactaaacaacaatatattgttgaaattataagcacataatgatttaatttattccataaataaatcatgacattgcagatgtaaactagattgaacgcatcattaaatctacacatgtaaactaagtagtaaagcatgaagatcaaatatgcgcaacatgtcgaacacgtaccgaggtagcggaaagaccggttgctcggcaggaactactcgcgattgcgagcgtcgacgaaggcgcgaagcacgcgagcggagaggaagacgagccatcgcggacgaacagggagcagtcgcgcgaagcgcttcccaaaaaccttattgccgccttctcccggtgcaggacgtcgaaggcagaggttccggagacctgctctcccgatcgccagtgcacgccgacgagcgggatggagtagtctacgagcgacggcgcagcacagagtaggaggcaaaccctagattgattttgcgtgtgttgcgtgaaggcagcggcccggtttatataaatgtttccaaaacaaaacaaatccgaatttcctgcagcaaaacaaaactgcaaaaggaggctgcatttgcgcaagggtgaggagccaattttgcggaccattcgacgcgtacgtcgtgcacgcgcgccgcctgccctgccctgcccatctatgaggtgggtttttgtgattttccaaagaactaatcttcgaatgtgccttagcccatctattaattccaacatatatatgtacacatatttgaactgaacaggaatggtaatatatatatcgctgaacagcaatatatatcgtccctcaacttttaaaactggtgcaactaacattactcgatagtatttttgatgtttttaagttgacgttgcacatatttgttttcttttgacttagtctttatccctcgtaacacttacgtgacacaaggaaacaataaaaagcatcaataagacccacatgccagcaagtgaggggaaaaactaatttgtgtgtcccacgtgtcatcacctctctttcttcctcttcatctccctctcttcatgctcttccccatcttctctcccttgctggcctcccctccttcccctcggtgtttcctcccatcaatgtgtcagccctaagaaggacgagcacggcgtaaagggcccatcaagaaggaaaacatattcattaacatgtagtccattaaataccatcatcttcgtcattttacttttagagtaaattttattttgtgctatgttttattacgatgtatcattttggactatcctttaaccaatatttgcattttcaatccaatatttgcactttcgatcaggtaatcttatatttacctttgtttcactttttactacccgactttttatcaatgaagtccaacagctatacttaaaagaatcttatactttgtctagagtcgtagtcataggataggtctaatcccatcctaggttgtaatatattgggacggaggttgtaatatattgggacggaagaagtactactgttttaacatatgacaatttgatgtaaatgggcaaaattgtgagagtgatctaaagtggcacaaacataaatttacccggtttaaagtgaaacatttattaaaggatagttcaaagcgaaataatagtaataaggcggcctaaaatgaaatttactccttaagcaaatgcttatccatgtcttttatttaaaaaattacagataaaacttttatatacatttttttagcaatttaaaaccaaataatgtaaaaataaattatgctaagaaaatcataaaaccaacttcagaattaagttttaaaatttaaatcttagcctataagcgtgctatggggctttatgtgtggcgtgtggtttgcctcgttaattcagaggggggaggagaggatggatgtgtagaaacagaacaaactattgaccgtgcaacttcagccggcacacggcaacttgagataatcacataatctcctgacaggagaagagagaacacacatatataatctcaagtagtaagtgacagcactgggcgaaattagtgaaatgcagacgactgcagtaaaaccagctcagatacactgctagaagatctaaacaactcaatatatgattatgtatccggatcccagatgttcctcgtcctgtgaactactagcatattactcagttcaacatagtggagctagcatagcaatctcatagacaaaagacagggttcttgtcactgtgaaattaagccttgcgttcctggaataatcaagaggttcttcatctagaagatccatcgtcgagacatcaacccttttctactttgtttttcgaccaggcatcaacccatacttccttccttgaaactgaagactgcgcatacccaatgatattttgaagataagacacagtttatcatttttcaaagatgaaggtaaatacgtggccatacaaatgatacaatgtcacataatatgtacaataattaagagctattttatggccaagaacttcaagcctgagttaatacttaatagcaggaaatgaaagctattcaacgagtaaacagtccaaagtgtagaggtcaaaacatattgcaacttcctatttatattactcagctcattatataaaaagaaaattatattactcagttcaacatggaaaaactctgtaaattttcaagtatcatacttgacaacaaaataaattggattatgttttctttatatcccttccaaatgctgttttacctattttcccttttcttcactaaatctgtatttgcacttttagttttcttctttcattcacgaatattttttttcaaaattcagaaatattgaaagaacgaaaaggagctaacttcagaaacctcgtgttcagcaatttgtttcatataacgttatgtttaaggcaaaatgcttcatcaagcctcacatgtatgcaaaatactcatgtcattatacatttatactatctagcatttcgagtatatacctacattagtaggcctgaaatacacattcttaagctactatatctccttccgcactctctcactgtgcaatggcagagatgataatgtgaaccccagtagcagagacacattaacaaacatttatgctaccggcaaccaacggttgtggaaaaggtagctgatgtgtttatgtaccaaaaagaattccattttgtataagtattgcacataaatatcatagataaatgggttacatatgcatgtgcctgaggtattatgaaacattttgctctaaaacctataggtttccttgaaacaaaatgcagatctgggttttgcattacagcattaccgacgcccctcaaacctgcgttatgtgaaatttattaaaggaaaagtggtattcactcgaccagcatgcagtaatatcttcaactaacattaagatgatccaaaaatatgattaatgatatttaacagcttccacctgcccttaaaaagaatttatcagcctatactgcccctacactaagaacacagaccaactatttttccccataacatcagattttatacaattacaaaagaagaaatcagtcaaggtttttcatccacaaggaactatagaagtcatcattagggcaaatgcagcaaaaataactagacatgaagatgggcactgaaaggcactgaaagttatgtacaacctacagactcaaaggaacaatgaaaatattcaagaaaacagttaattctacagattcaaagtattgctcagtttagccattcacaagggcatgaaactgagcatatatagtgagccatttgtaagagtgaagtaaacaacagttcaatgtgttgttgcttaaaactattactcctacttgttaagtaaaagcataaagacagagaaagcttgctactgttcagaactaatcagtgaggcaataaattatcaaaaagtttaatattcaaaactattcaacagaaatgtttagattgggtttccgactcccacgaaatgtcatgcagcatttccattttcttttcaattaatctggtgattggtactcctacctctagatttctaacaaagtaggagtttctgcattatttgcaatcaagtggaaggcaaatttcagaaatacagaaagagcgaataatgttgctagttagcttaccgatattaaatgtagataggaacttcaaaattttgataactctctcatcaaccactccacatttgactacgactatcttaaggtgttctgatattgcagacgatctctccattcgactataggcagaagtttccaatttagaatataaatacatatgtaccgggtagaaaaactgaagagtgagattctctagaactgggagtgtcgaaggatgcaagtaatttcatgcaagtcgaaggccacaatccagctgtcactgagcaacaaagtcttcaacttgctaaatgtagggcaccgtatcaattcccttttgaaaataaactggacaaaatgcaaacaataaagatcaactaacagatgatttgagaaggaaaagctggttctgtaaaaggcagttcatgtgaaaaaaaggcataacaaaaacaaaccttttgtgagtcagcgaccaacgccaaattcttagcctgtgaaaaagcttgcagaaccttgcaattgttgtcactgggacaattgtcacaatcgtcataaggacattcctcaaggtcatcattaactcctggacaacacctgatatctccagaagcaaaggtgacaccgaaaaaggcatccactaataacggcatgccctcgaacacaggagtccggtgattatataattatccaggcgcagcgaaaggagattggggacatcaatacgagtgcggaagatttcgctgaaatcgcatgcagtgatgttgaggcgtttcagggattgggaagagatcctctcggcatctgacaagctgcagaggacaatctccagatgttccagcaccggacagctcgagaaatcgaggaaattgtgcaccaaattcagatgagcaagctctagcttcgccaagcgcccggacacaagaggcaggccatctagcacgaggcgtgaggcacttcgaggggcattcaaccggagagcttggacctcgcacagcacggcatgccggaaccagagatccacgaggcgggcgtcgccgccgccgccgtcggacgacagcccggcgaagctgagctcgcaggtgtccagcggcgcgcgcccgcggaggagcagcagatggtccacgaaatcgcggagctcctccatgggcaccagccccaccccgtcgtcgtcggcgatgcgcaggcccgtggcggacttccagaggtggcgccaccgccgcgccagcacgcacgtcgcacgggtcggcgccg

SEQ ID NO: 11512 - DNA, 6491 bp, Oryza sativa
ggtggcgggcggtcgcggccgcagggcaagaaacaaccactggactgcacgggcggatgaagctggagcaaagcgagtgagaatcagaggcagagacagacggagacctcgccgccggcagcctcgcccgccggagctgaggaagatggtagtgtactccagccctcgagtcggagagtgtccgaatgaggaagaaaaggccaggaaataaagaataaatgggctggaccagaaaggcccatttaacagggcacattgaaaagtccaacttcgagcagtacagtacaactttaggcctatgtggaaggcccaaccttatgggtaaacaggcctaatctcatccagctcaaaattaatacattgtgctatacatttgtagattaattttctctcaaaaaattgtagaatgtaaatatattataaattacattgtaacttgcatgtaattggtatgtaactttcatatgattattatgaatagttagatttgctttaaaattcgtgcgagtgacaaagggaaaaaaaatcccaatgcacgtaaggggtgaggagatttaatcccacgacctccacttcataaaatagcatgttaccgcaggatttttttaaaagttccatacaacttatattctataaacatataagttatatctctacgtttcttttcgtttgacaccggttagttcaaaattgcactaatcaatatcattcatttggaaacaaaagtagtattatggattcttttttttaaaacacagtacaaatgtggtgtccacaacgcatgcacactcactcttataaacacatacgcacatcgtacccctatgagcacatctgaaaagactgggccggcatattttactgtcgatggatacgtcacctactactgaaaaaataattagccgtaaataagagcacccgtgttaaacttaggatttgatcccgagtggatataaggcccaatgtaattattctatgattatatcatacttacatttaatttttttagaaagtttattaataaatatacaatatatacatagcccgagattaattcctcgggtatgacagaaagcacatccatcaatttgcatgtgccaaaattttagttcactttggtggcctattacactttgatgggccaaaatttggtccatccaaactaggtctaattgaccaataactctgagaggaattgagcctcacaaatggggcaacgaagagcactggaaccttcgtttcataccataggtcattttaattttttcctaagtcaatttttttaggtttgatcaaattaataaaaaaatattgtaatattttcaacacaaaacaaagaaactaccaaaatatataacatgttcaatattagatgtaatgaaacatataaatgttattatatttttttataaatttggtcagacttttaagtagtttggtttaaaaaagtcaaaaaaaattataatatgcaacgaagggagtaataaatttcaaaaggttggtatagaaattcaatgtttcatggtttgatctgcataaaactataggtagattctcatccataaccaaaagaaacatctatcacaaatcaaaacgacatgagctctatggatcgacaaacttgcccaaaatacattaccagatggagcaatatttacagaactaacagatcatcatcccagagagaatgaatccgagttaaccaaggggccaaaagagatcaaagcatatggttggtatattaggtccaactagattacctgcacttctaaatccattatttgggcactacagttacaaattctgtctagatcatttcgtcagttctaaaccgcccctatgaggctgagactgcaagaatagggcatgcttgtcacagcagattaagcaccaacgctctgagtagcagtagatcctggagagcccaactttaaaacgctactcgaaactgaaacctgtcaaagaaaatgtagggtaagttcacaatctgaggcagtaagcatcatctgcagatattacaatgttcagttgcttgacagtaaatttaaataccggaacagattgtgaactatgaagagaggggatgatctaatcttatctaaatatatgtctgggacttaaccgatcagatgtgggggagaaatatttactccggttaatgacttaaccgatcagatgtgggggagaaatatttactcccggttaataacaccaaccgatactaaagatctaaatgatcatttaaccgggagtaaatgataatctttatcccagttggtagtatcaacctgaactaaagatcctcggccccctgacatgcctctgacagaggatgaaccgggactaaagatgatcctttaagatcaaaatttttttaaccggcatttttagtcccggtttttaatgtgaaatttgatcgacctacgaaaaatggtttctccacccatgaacacacgcccaaatagtcaaatacattaccagatgtgtgtactattaaacattactggcggagaaatgttgattaaagcaagatagcagattcatcatccccgagagaatggatccgaattaactagcatagttccaactagattacctgcccttcttaattccgtctactacagattcttactaggtcattgtcagttctaaaccgttcgtgtggctaagaactgacataggatatactaactccatcccataatacagcaaccatctcagttgtcacagcactgaacagtaaatagactagtagattcatgtacagcccaatttttgaaccctactcgaaactgaaacctgcaagagaaaatgcagtcagttcatagtcagagcatcaactgagcaattaaaatgtgcaattccaagaaactcataataaggtaacagactacaaaaatagtttttttttaataaaaacatggttagcaatttgtttcatataaccctacttaaggaaaaatgtttcataaacaagcatctatatgcaaaacaattatgccactaaaatatataattatatagtatttcaagtatatactcacagagtaggcctaaaacacattcctaggctacgctatctctcccactgcacgatggcagaaaaaaaagatgataatgtgataatgtgaaccccagcagtaaagatacgttaactagttaagtaaacccacaaatggtcatgctatcagcaatcaacggttgaggagaaggtagctaattgtctatgtaaacccacatacgatctttgtataagcattatacacaaaaataatgggccatacacaaatcgatgatagacatgtaactaaggttttatgaaaagtgttgctccgaaaacctgggtttccttgaaataaatagtgaaacctagggggttttatgaacctccaaaaccaagattttgtgaaatgtactaaaagaaaggtgaaattcacttgatcagcatgcagctcaattaataacagtaatacgttctagtagtaagtagtaacataaagatgacacaaaaatatgattaatgatcatgaaccatttcccattttccacctgctctcaacaaaaaagttcatcagcctaaattaccccctcacaaacacagaccaaccatgttttctcacaagtcataacatccgagctacaatcaaaacataaatcagtcgaaggcgtttcattcacaaggaactattgaagccatcaatcggataaaggaaatagctggacatggacatggcaagaatggttttcttcataaatgtgcaaccagtacaaagaagaaaaataactcaaattattgagcatgtgagactacaggtttataaactgatgaaaacaaggcccatgtaagaaagtattttcacagtattataaaagaaaacgaaggtggaaaataaaatgtgttattgcttacaattactgattgttaagttataaaaaaaaatacaatcgtgctgcttcggaactagtaatcagcaagccaataaattatcagcacaagtcaaatattgaaaactattcaacacatcaccctactgtttatgcgttgtacttgacaataaaatgaccgtacatagctttatgcatacaatctgccaacacaacagattagattgagctccacgttcccaccaaatgcagtgcaggatttttcattttcttttcaatttcgtacagctatctcttgattttctaacaaagtaggagtttctacattatttgctttctttcataaatatgaacctggaggaaaattttagaaatatagaaacaatgaacagtgttgctagttatcttacgaatattaaatgtagacaggaacttcaaaactttggtaactctctcatcaatcactccacatttgactacgactgacttaagatgctctggtattgcagatgacctctccgtttgattatagcttcctttcatttccaatatatgttcagattcctgcaaacaataacagtgacaaaaaataacaataaaacagttggccaagatcaatcaatgtaatgtaataaatgtaaatatgtagcggttttctatttagaatatatgtacctgacaaaaaagctcaagagtgagtttctctagaactggtgagtgtcgaaggatgcaagttattccatgcaagtcgaaggccacgtagaaggagtcaatgagtaacaaagtcttcaagttactaaatgtagggcaccgcatcatgtctcttttgaaaacaaactggacaaaatagacacagaagagatccataaaaactcgatgttaacaatgatttaagaactcccttgtggtggccttgcatgcaaaaaaggttattgcaattgttaattacgaatatccagtggtgggtacacatagattctgcataggaaagatagaagtgtaagcatagcgatacctcttgattctgagctaccaacatcaaactcctagcctgtgataaagcttgcagaagcattctgttggtgttactataacaaagctcacaatcgtcatgagggcattcctcggagtcagcattaccacttgtacaagttaaccaatccccagagtcaccggttacactgacaaatgctttcactaatagcggcataacctcaaacacaggagtccggcagcgataatcttgtagccacagggaaagtagattcggcacatcaatacgaattcggacattttcgctgaaagtgcaatgagtaaggttgaggtgtttcagggactgggaagagatcctcttggcatctgacaactcggaggagacaatctctaaattttctagcaccggacagctagagaaatcaaggaaactgtgcatcaatatcacaaaacgaagctctagcttcaccaagtgccgggagacgaaaggcaggtcgtgtagctcgaggccgaagacattcagccggagcacccggacttggcacagcagggcatgccggaaccagaggttcatgctgcggttgtctccctcggccaaatcgatggaacctagctcaaacgtgtcgaggggcgcgcccccgcggaggagcagcaggtggtgcacgaaatcatggagcttttccacaccgtagccttcggagatgcgcaggcccgtggcggacttccagaggtggcgccagcgccgtgcgagcaggcacgtccgcacggcgtccggcgccggcaggaacccgaggatgtggtggaggaccccatccggaaggcatccaatccgatcctcgtcggcgccgccgcttcgagatggggatcccttaacccttttccccgtctcccctggacgcattccgtcgaacaggtggcgggcgtcgcgttcgcagagcaagaaacgtccacaacgcaagggacgatgcaacggggggagagagcgggtgaggatgagagacggtacaaatgcctcgccgccggcagcctccctcgccggagctgaggcagaaggtaaatccagctatgacctatgagtgaggcattgagtcctcgccgcctcggctggacggaagaaaaggcggagacacgaagtcaagaaaggataaacgggatgggccagatttccgacccattacctctctttgggctgtcaagtcccacatttggcccatgcaaggggcccaacctttgagaatgtcggcccaatcccatccggcatgatccataattttgaggaataagttcacttcatgaccctcaaatgtgatcgaaatctaatccatgaccctaaactacaaaaccggatatctcaacccccaaactcctaaaaccggtgcaatttaactcccttggcggttttaggaggctgttttgctgacgtggcgccacgtggcgcctacgtggcaatattgaccgagtttttcttacacatggtgttgacgtgacacttacgtagcggtagaaataaaaaatatgcatggggcccattagtcattcacacaaaaaaatgtaggcccactgacatgtgggccgacatgtggggcccacatgtcagtccttcttcctcctcc

SEQ ID NO: 11513 - DNA, 40051 bp, Oryza sativa
aggagcgcagagcacgtttgggggaagatggcgcggtcatgggaggcggtgtcggtggacgcggcgccatgccgcgtcgtgctcctcctcaccgtaccatggccgccgagagagaggggggttagcaagcctcctccacactaccactgttgccaccaccgccacctcgcccatcctccgcgccgccgacgggatctccgtgcctagcctcggcgccgctaccggatatccgccgtgctgctgtcgcggctgccaccgccacagctctactgtcgcggctgccactgccgccactaccgaacgccgccgccgtgggatggcaatgccgccgccgccggatgccgacgccgctcgctctctttgtccctgcgcgccaccggccgaaggggaagaaggggagagaaagagagagaagggagagagggaggaggaaggtctaacatgtggaccccacatgtcagtaggcctacatttctttttgtgtgaatgactaatgggtcccacgcatattttttatttctaccgtcacgtaggtgccacatcaactccacatgtaacgaagactcggtcaatactgccacgtaggcaccacgtggcaccacgttagcaaaaccgcctcccaaaaccgtctagggagtcaaattgcaccggttttaggagtttgggggtcgagatatccggtattgtaatttagggtcatggattagatttcgatcacatttgagagtcatgaagtgaacttattcctaattttgatccatgagctatgacgtatgggtgccaccgtctcttttttttttaactgtaatatgtaatgctccactctagtcagcacgccgtgcgaaagtgttgtacgataaaatcatcgtccaaacgataggcttgttcattttgttgtcaattttaaccttatcaaactttggaaataccaaattttgatatgttttgatattgtcaaattttgttagcgttggatgtatttagtttgatatactttttaaaattttgatagtgtttttataagaggaaagtttcaaaactatcaaatcatggtaggatggcattggtagaatacttttagcttgttatcttaccaaaatttagtaataatatcaaatgatggtagggttgaaacttgaaagtggcaataaaagtgaacaggccttatgacttgatttacaccaatttactcatttttaatagttgaggacactctattcccgattcggttttgtgattaagggatgtttcagtggactttttccagcatgatttggtccatccaaactaaggcgaaccgaccatgttccgggatgaatttggcctcacaaatggatcatctaatattatcaatataataatgatctttcctctaaaaaaaatggatcatcttatagcattagattatggtctggcccgtatgcacataacattttgcagcatcacagggaagtaggcttgtccaaaatgaacacggcctgagctgagccaggccacaaacacgtaaataaaattcaaaaagtttgtagaaattcaatgtttcatggtttaatcagcagaaaactccaggtacgttctcatccacagatcaacaaacatgcccaaaatacattacaagatgtgcataccattaaacatttgaggcggagcaatatttacagaccttggatatgctattgctaaaggttagcagattcatcatccctgagttaatgaatctgagttaaccaaagagtccaaaagacatagcatagcatagttggtatgttaggtccaaccagattacctgcacttctaaatccctttttagggccctgcaattacaaattctgactaggccattttgtcagttctaaaccgtccctatgacgaaaactgacgtgatacctgtagtcagaatagggcaccattgtcacagtaacagcaacttaagcaccaacactctgaatagtaatgagtagtacatccatggacagcccaattcttaaaccctactcgaaactgaaacctgccaaagaaaatgaagggtaagttcgcagtctgagcagcaactaaattgttcagttacttgacaagaaacttaaagtaccggaacatactacaaatccacaaaaaaaaaaatcccatgttcaacaatttgtttcatataacactatgctttaaggcaaaatgtttcatagaacatcatatttctgcaaagtatccatgccattatagtagtatatggtagccccgaattacacattcctaggctacaatgtgagatggcaaagatgataatgtgaatcccagtagcagtcataaaacacatgtctgccggtaaatacatttctcgacttctctttccccggccgcaggctgtggcagagagtcagtaaaggtctttcccagcagacagttagccagcaaaggcaacttttcctggcagaacgagcgtcctaaacctatgttatggcgcagcaaccaacgcttgaaaataagttcaatacagtgcattactgctcacagtcattaattatcaaatgcagaaagaaagaaaaattttgctgctgtttagaattaaacagcgagccaataaattatcagcacaagtaagatattcaaaactattcgacctatgagcttaccgcttatacaatgtacgtacttcacaataaatagatactatacagctttatgcatactatctgccaacataacataaatcattagattgagtttcacgcttccaccaaatgcagggcatgatttttcattttctttacaattcggtactctagtcttatctcttgatcttctgacaaagtaggagtttttacactatttgctttctttcacatatatgaagttgaaggaaaaatccagaaatatagaaagaatgaatagtgtcaatagttatcttacggatattaaatgtagataggaacttcaaaactttgataactctctcttcaatcgctccacattttactaccactaacttaagatgttctgatattgcagatgacttcttcgtttggatataacttcctttcatttccaccttatttttagtcccctgaaataataacagtaacaaaataacaataaaacatttggccaagataaatccgcgttatgtaataattgtaaccaggaagcaattttccatttagaatatataccatgccacgaaacttgagagtgagcttctctagaataggtgagtgctgaaggatgcagctaagtgcctcaaagtcgatatccgcagattgacaaagtcttcaacctgctaaatatagggcattgctgccagtacctattggaattaaactgcacaagatgcaaacagaaaatatcaactaatactcactgtaaacagatggttaaagatattacatgtggtggcagtgcattggaagtgataaatgcataacatacatcctgtgcttgtaatgctcgtgaccgtgacagaacaatcaacaccaacgtcttcgcatgtgataaagcttgcggaagcgtgcagttgttactatcatcatatcttggaggagtattccaatctccaaattcaccagtgactccaacaaaagcctcggttaataacggcataccctcaaacacaggattccggttcatactaaaacggttttgctatatttgtgtcgccacaaaatctcatcgattatagtcgatttttcagctctctgatttgctttagattagcactggatattatgatttgcgtatgcgttgtttgagatctgcgcccgactacctgcaatctatcatcaatgtattactgatccagagcaaacacaaagtaacgtgctcaactgatcgatgtattactgcccaaggtcctatcattaacgtgttcaactgagcaaacaggcaactttattgctgtaattatatatttatacaaatttacacagtagttacaccccacttacatatgtaattttgaacttacatatgtaattttaggacttacattgtaaatacactaaaattacatatgtaatttagggacttacaatgtaaatacatgctgactatattttggtgaaaaatatggcgccataaatatagttactccctattaaaaaacatacgaagtgagaggagattcggtgcacaaatatgagtgtggaaagtacggctgaaaatgcaacggaagatgttgaggtgtttcaaggatcgggaagagatcttcttggcatcaaccaggttacagaaggatatatcaagatgctccagcaccggacagctcgagaaatcaaggaaactgtgcatcagcttcacaccagtaagctgtagcttctccaaatgccgggagacgatggccaggttatccagcgctagttggacgccactgggagcgagtcgcagctgcagcacacgggcctggcacatcaccgcggcatggcggaaccagcggtccacgcggcgggcgtcggcggcgaagtcggacagcccgcccaaactgaacctgcactcgtcgatcggcgcgccgcgcccgcggtggagcagaaggcggtgcacgaagtacccgaactcctgcatcgtcacctccttgtcccagttggtgatgtgcagtctcgccaccgacttccagaggtggcgccagcgccgcgcgagcacgcacgtgagcacggcctccggcgccgggaggaaaccgaggatgtgttggacgacaccatccggcagatccctatcctatcgacgccgccgccgccgccgccgctggcgctcggacgtggggctttccccggaggcattccgtcgaacaggcggcgtgcgtcggggccacaccgcaagaaacagctggaactcacaatggaggatgcgagagagagagagagagagatggaggcctcgccgtcggcagcctcgggcgccgcatcggagcaggagtcgaggcgaagtggtccaaccctagtgctgtgaggattggggagtgaagcatcggccctcgcggctggctgggtagaggagccgagcatgaaagtcagaacacgggctgggccgtcacggcccattggactgtgggctctgagcccattatgaggcccatatccacagatatttccggcctaatttctgtggaataagttcatctgagatcccttaacttgtcaacgaattcaattttcatccttcaaccggaaaaccagacacaacgtgtccctcaactgtcaaaaccggtgcaatataggtctcatggcggtttagacgatggttcctagtggctaatttgactcggtcttcatctgacgtggcagtgacgtggtgcttacgtaggtacgtggcaatttgattttggaaaataataaaatttgtgggtccatatatcagttacactaaaaattaatttaaaaatggtgaaacccacgtaagccacacatgtcatcctcaccacctcctcttcttcctcctccctccccaactcccctttcttcatctctctctcccctctcctccctacaggcgcgagtgaggactgaggaggggtggcactgcgcggcccatgtgggccatgatggacaactcggtgcgcttggaccagcgagtgccaccggagccgtgcgtgacattctgccttgctgagcccccacgtgtctcccacctctccgtcccccggccttaagtcccacacggaagtcgcctgcgtcgtcttcaactctcttgccggctagccgctccacctcccgaaggacccggacaccgtcggcgaggaggccggcgaggcgtgcggggagcgaggaggcagagcctggcgatggcggtgcgccatgggtgggtcgccgactcgccgtgacgctcgcctgcccaccactccacttcgcccgcccctccgctccattccgccccgccgcgacacatgcccgcccctccatctgctctgcccacggcccgcggccgctcggtcctccctccatttgctcttcccatggcccgcggccgctttgccccgccgcgacgctcaatttgattgtagcagccctgaaacttgcttatttctttctgaatgttaccctaacggtgctcaagagagtttgcattcctatcagactcaaaatcacggttagcatggtagtggtctgtgatcctttgccaatatgacatccctggttgctcattgccaataataggatctaagctaatgctctgccatgaaatgcacaattaaaagtcctccttacgagtatagttgctttatcttttggctgatccttttgcaccatttcttgaagtatgaagatcttcatttggcattagcacttcgacatcagtgtcctcggacatcatgcgcacaaaggaatcacctccacttgccatttcaatctagtcactgcaataaatatataaattgatggcctttctaatcgatctcagaaacatcaacaaatgattgtaatgtacgtcagattatactgtttataacatgtatttatttaggatatatattggttctgcagtattaacgactcagtacaattgtacaaacagttggtcattctgaagaaatttaggacacttgtacaagattagtgtctgatatatcctagtttactgaatgtgaactgcttatatatcatgattacgtatgtatggttgtacgtagaattcagataacacttacaaatctgaattttgttagttctgcaccccctccattgagtcagtgttatctgaataacagaagctttcacgttttagatcggtattaaacaatacatagatcacataaaatttttggagcaagagatgcaatataattaaaatagactaatactccctctgttttacaatgtaagtcattctagcatttcccacattcatattgatgttaatgaatctagacatatatatctatctagattcattaacatcaatataaatatgagaaatgctagaatgacttacattgtgaaatggaggaagtagcaaataacaaatgctcatatactgtacactgctgccgctttttttttatgcatcagttcagtaaaaaaaaccttgtttttcagtttctagaatattgacccaacctgacactaactgatgcaattatcgatgagtaatgcacatcggcaaaagaaggttgatttcagcatattaaaggccggtctgaccgtcttgtggccgatcagaccgctactatgtggccggtcggaccgcccctgatcaggccgagacagtgaatacataagtgattgtgtgtgtgtgatgaaaatgtgagcaccagtgaaaatacaatgacctaatgtggcaatttaatcatctctttgctaggtcattacccccttgatagtacgacgaaactaacaaataaactagcaaatttgatcgcccttcacctcgatcaattttaaaactaaaacactagttttaccgttttcttttcttcgcttcgtgccatcaaattttaatccatcgatagtcatccatgtgcatacatgacgtggacctaacttaaaatatatctcaatagcaacggttagtccacaattagcacttgtcattaattaccaaaattaacaacggaggcctagatgcttcactgtcgaggaggacgaggctggcgaggagcagatccatcgtcactatcaccatcttcgtctgccgaagagactaaagaggggcttggagaaaaaggggagaaatatgaggaagaagaaagggttacagaggctgacatatgggtcccactatcataaactcagaatagtgagggtgaatggagaggctattggagtaaacaataagtttaacttgcaaaattagatagagagttagccaaataaatatttagagtcaaatttggagagactgttggagagtagtattggctcacatggcacattaaccatgatagggtgaatgaagaggctattggagtaaacaacgaatttgacttgccaaattagatagagagttggccaaataggcattttgagagtggtattacttgacgtagcacattgaccatggtcaaaagcactaagtcagccaaaaagttaggaatatttcgtggaaccgacatatgtcatcctcactctccctcacttgttcatccttctctctcctgtctctctcctccctttttccctttggcagtgacgagggagcttgggctatcgaccacgacggtagcaaccagctaacctcgacaacagtggcaacgaccgagatggcagcttgcggaagccgcgggtgaacatgaggagctggtgcagggtagatcatggtccagccacgccacctcctccatggccgcaatctgggagtcccatttctccgccttcctcttcatgctcatcgtcccctcaactccatccagttcggcttctcccccaagacgccatcctctctatctcaccctctttcagcggggaagaaacggggcagagaaaggcgacaacggctatggggttaccggctggcgacgcatccaaagctcaggtagacgaggtggcacccaatccaccgcgatccagatctaggaggcaaagaggcagagtggtgtagcgaggtggcacccaatccaccacgatccagatctaggatgcaaataggttgcatggtgtggagagaaggacgccctccatgagctcgattgccgaatctattagggagggggtcgccggtcccgcggccatggctgacgggcgggagagaagggaccgacgcggggagaagagacgggcggcacggcccatgattatgtgcatccaaactaagcgaactgacttatgacttatggcctggcccgtatgcacatacgagattcctaattggcgcgtacgcaccccgggcgcgcacttccggcccacagcccacgcggccgtcgatgctggtacgatcataatttttttttctcgtgacgctttttctttaagtaacataactaactatattagttaaggataatgatataattaaagaaagatttttttctttttgagagattttttttactaataggttgagaatttgtaagttacatttgaaaatttttgacttaaaatttaaactttgaagttaaattttaaaaactttcaactcagatttgaaaactttcaattcgagatttaaaaattttcaactttcatctaaaattttaaaaaaactttcgacttagatttgaaaactttcaactcaagatttgaaaactttcaactttaatctcaaatttgaaaaactttcaacttaaattcgaaaactttcaacccagatttaaaaactttcaactcaagatttaaaaactttcaactttcatctcaaatttgaaaaactttcaaacaagatttgaaaactttcaactcgagatttgaatacttgcaaatcagatttggaaatttttaagttaagatttggaaatttttaagtcaagatgtaaaaactttcaactcaaaacattcgaaaaaatattcgtgctaaaaagatttaaaaaataatcagaaaaaaccgaaaaaaccgaaaaaaaatcatcaaaaaaaggaaaaaaaatagcgtggggagccagcgcgcatgccagcaacattgctggcgcgcacgcgcggactagcaacacccatgcacataaattattttggagcatcacagcaagtagacttgccgaaatgaagacggcctgagctgagccaggccaaaaacatacaaaaaaaaatccgaaagttgatagaaattaaatgtttcatggtttaatctgcagaaaattccaggtcacgttctcatccataactaaagaaacatctcgcacagcgacatgggctccacagattgacgagcatgccaaaatacattacatcatttgtcccaaaatataagaaccaagacaagacaacttcgaatatggacaagaatatcacatatagtactataggtttttatattttgggatagagggtatcaaatgtgcatactactcccctcattaaacatttcaggcggagcaatattgacagagccagctatgctcaaggtagcagattcatatcttcccagagagaatgaatccgagttaaactagagtccaaaagacatagcatagaatagttgggtggtatataaggcctaactagattacctacacttccacatcccttttagggccctgcaattacaaattctgactaggtcatttcgtcagttctaaaccgtccctacgggctatggctggaactgacatgatacctacagacagaacacggcaccctcgtcagtcactgcaaattaagaaccaaccctctgaatggtgatagagtagtagatccatggacagctaaacttttaaacgctactcgaaactgaaacctgtcaatgaaaatgcagggtaagttaaaagtttgagcatcatctgcagcaattacaatgttcagttacttgaaaaaaaattaaatactagagcataccacacaatgagttaatttcagaaatcccatgctcagcaatttgtttcatataacccaatggtttaaaggcttttttttttaaaaaaaaaacagcatatctatgaatgtgcatgtgtattactcctacatataaacaagataactcaaggaggtgaccaaatgcaaaatcaactaacatactactatgaaggtaagcacttcactggccattcatgtgaatgcagttagcctgagtatatgaggtaagccaccaaaaaagattggacaaaaaaaaatattaaaagcagaaagacagacaatccttctattgttcaaactaataatcaacgagccaattatcagaacaagtcaaatattttaaactatttgacagatcaatatgtaaatgcacttcatgataagtaaacctcatatagctttaggcgtaccatctgccaacataatggaatagaatgatttccccactcccaccaaatacagtgcaggattttcaatagcttttcaatagaactcctatatcttgattttctatcaaatcaggaatgcaactagctttctttcatgcatacgaaagctgaaggcaattttcagaaatatagaaagaatgaatagtgttgctagttagcttacgaatactgaatgcagagaggaacttcaaaactttgataactaaatcatcaatctcatcaaatctgactacaactatcttaagatattctgatattgcagatgacctatccattcgactatagcttcctttcatttccaccctatccggtccatgtccctgcaataataacagcaacaaaaataaaaataaaacaattgaccaagataaatcagtgttatgtaaaaattgtaacgaggaagtgattttccatttagaacacacaccatgcgatgaaactgaagagtgagattctctagaactggtgagtgtcgaaggatgcaactaacagcttcaaagtcaagaacagcagatgcgcatgcactgattaacaaagtcttcaacttgctaaatgtagggcaccgttgccagtacatttcgaaattaaactggacaaaaagcaaacagaaaaagattaaccaatactcacagtaaacatgtggtctaagaatgcacatgtggaggcagtgcatgagaaggcataagtgcataacatacatcttgttcctgaactaacaacaccaacttcttggcctgtgataaagcttccggacggtataccctcaaacacaggagactggttcatataattaactagaccaagtgagaggagattcggcgcataaatgtgtgtgtggaaagtatcgctgaaattgcaaccggagatgtttaggtgttttatggatagggaagagatcttcctggcattggaatcagacaagtcgcaaccagcaatctctagatgttgcagcaccggacagctcgagaaatcaaggaaattgtgcatcaatttgacaccataaagatctagcttttgcaagtgccgggagacgacaggcaggttttctagctcgagctcggatcccctgctcacacggatatccagccgtagcacccgggcctggcacatcactgcatgccggaaccagcggttcacgcggagggtgtcccggtcggacagctcggcgagatcgagctcgaattcgtcgataggagcgcgcccgcggcggagcaggaggtggtgcacgaaataccggaactcctccatgggcaccaccttcctccagtcccagttggtgatgcgcaaggccgcgacggacttccagaggtggcgccagcgccgcgcgagcacgcaggtccgcacggcctcatgcggcgggaggaagccgaggatgtgttggaggacaccatccggcagaccccctatcctatcgccgccggtcggaggtggggcttcccccggaggcattccgtcgaacaggcggcgtgcgtcgaggctgcagcgcgagcagcaaatagcttggaactcacaatggaggatgcgagcaagaagagatggaggcctcgcagactcgcagtcggcagcctcggccgccgcaccggaggaggagagtcgatcgacgccaagttctccaaaccctactgctgtggggattggggagtgaagcaccatcgacccccgcagctggctggagctgtggagcatggaagaataaactcgagtgagacgtaaagtacggggaataagttcactttaggtccctcatcccgtcaagttttaaaatccgcactaaaccgaaataccagaaaatcttagacctccaagttgcaaagccagattaaatttgctcctccagcagcagtgtagatgtctggattcactgatgtggcaagttgacccggtccgctcgtatcgagtaggtcgactaggtgcttacatggcaaaaacaaaaatgggtcctacatgtcatgtcatccttacttttctcccatcttctctctccttcctctcagtctctctctttccttttctcttcatccatcacgcaagagatgggagtgtcaccgagcggcagggaggagcggcggccggcgggagaggagaaaggtggttgcagcgtcaccgaggagtgggaaggggatgcgggccggtgggagaggggcaaggcggctgcagccctctcatattgggattgagatcctctgcagtcaaatgtacggtgtctttatcactgacatgtgggcttcgactgtagagtattttgatcccttgtgttgtggggagtcgcctatgatcgcagcgctcagcacgacactgatgcatgtaatcttgtagctggtataatctaatttccatttttcataaaaaaataaggcttgacttgtgttgtgttcacgaggagttcggatcgtagaaggagtatctaactgtattttcagttcttgcatcaattaagtcatagctgcaagatcgctcaggtcaatcgtgggatgacgcaattcagtaggatctgggcgggttttgtggatctttttcaattgtaacaaaatcctggagtatggagtattataatagaaggaaccgagaaaatgctgcaagttttacgcagcgccaaatactctatctctgttattcttcagttctccagtttactgttgtgaaacctataagtgtcagaaaacaaagtgaggctgcgcatgagaattttgagtgttaggttagccaaaccaaatcaaattacaacaagtggtatccgagcggttcatcattgattctgaggctatgtcgaccgacgatcatagtcgaaacaccccactgcggcggcgtggaagattggaggcggaagtggcaatgagggtgaagggtagatcgttatgcagccggtgccacgggaggctggcgtgccactatgctaccctaccctcacgagaacaaactatgcagattgggcgctactgatgcgggtgaattttgcaggcacaaggcctgtgagctgccatcgacccggggtatgccaagttcaggaaggaccggcaaacaatggcggcccttctccaagccgttcccaaggaaatgttgtgccccctatcaaagaaggacaatgccaaggaagtatgggacgcgatcaagacgatgagcgtcggtgtggatcatgtttgagaagtgcgcgagcaggcattgcagtctcagtacgaggccatccagttcaaggacggcgagacgcggaggatttcgcccttagtctgcacgcacacgtcatcgacatccgtgacatgggtggcgcccttaccgacgatcacatgttgaagaagctgttgcgagtggtgccattccactatcatcagcttgccttgtcgattgaaccgatgcttgatctcaagaccatgccgctggaggagctggttggtgccatgctgccatcgaatcctataaatctgttggtgcgtctggcgaggcgctgggcgacctagttctactcacagaagaggagtggtccactcgaatgaagaagaaggagcagtaggacacatgaaagggactggctcctcgtccagcctgaagaaagcatgcgcgggaagcatggtggctaggggcgctcaggtgaggatgcatcagccaaagaaggtggcgcgctgacggcaccgcgtgacaagtcgatggtatgttgtttcaattgtgacaattatgatcactacaccacggagtgccacaaaccgcggcgggagcgacgctaggaggcacacgtcgctgaggctcaggaggagcctgtactgctgctagcgaccgtgagtgtgctggtcaccgtggccgcacgaggacaattgtgctggacgagcccgccatgctagctcaacttcattttgggcgccgagaagaactatctccggatctctggtaccttgacaccggcacaagcaaccacatgtctgtccgcgaagagtttttcactgaccacgacgacacggtgcgcggcgttgtgcgcttcggcaacggctccatcatcgacgtctgcggttttggcgacgtaacgctggaatgcaacaacggggcacaccgtaccgtgtccatggtgtattacatcccagactcaagagcaacttgatcagtcttagctagcttgatgagaacggctgtgcaatccacattgaagatggggtgatgatgatcagggacagggcgagtgctctggtggcgagggtgtcgaggaacaaagggcgctcgtacctgctggatttgaaggtggtgcggcccatgtgtttggtggcgagctgcgccgaggtgccgtggttgtcgcatgcgcgctgcgggcatttgaattttggctccctatgtcggctggctcagggcgccatggtgtgcggtctgcctgacatcgaacaggtggatcacatctgcgattgttgtcaaagagcgaagcagctgcatgcaccattcctgtcggaggcgaaataccgagcaatggagttgctagagcttgtccatggtgatctctgtggaccgattagcccagccacgtcgggaggtaaatgccattttctattgctagtcgatgatatgtctcgatacatgtgggtggtactgctagcaaccaaagattaggcaccgacgacaatcagggagttctaagggaaagttgagctcgaggctaggaggaagatgaagattctccgtacagacctagggagggggggtgtgaattcacctcgatagaatttggtgaatactgtgcaggacgtggcgtgaggcggcacctcaccatgccctgcacaccgcagcataatggcatcattgaacggtgaaatcagatgatcgtatcaatgccgtgaagcctgttgaaggcaatggaaatgcccgggaggtttcagggtgaggccgttgtcactgcgatgcatatcctgaactgggcaatgacgagggcgctcgacggccagacgccctatgaagcttggtacggccagcgcctgaatgtgcattactttcgcacctttggctgtgtggcgtatgtgaagaatgtgataccacacttgtcgaagctggacagaagcgaggcgatggtgttccttggttatgaggacggaagcaaggcgtatagggtgttcgacccggaggcgaaccatgttcatgtgagcagagacgtggtgttcaacgaagaggcgaagtgggactgggcggcagccgtgactggagacgatgaagctaatcctgggacgaagaggcgaagtgggactgggcggcaaccgtgactggagacgatgaagctaatcctggtgaaatcttctctgtcttgtacacttttcactctgtttcagatgatgtacagtgctctgggcacgccccgccgcatacgagccacaggatgctgttaccctagtgtgggactcattgccgggtgtgcactcaccagcatccctcttgatgccaatcaacaccacgcagacaaaagctgaggtggagtttgcaattccgccgacggacgcattgcaaccatctgacgaggcaccgtgacgcaattacacgcttgcaaacatcagcaacactactagcccagtacgggagtttcagtactctgggttgtgccttttggcggctgatgagccagcaagcttcacggaggctgaagtacaggcctgctggcacaaggctatgattgatgaggtgaagagcattgaggaaaacaagacttggagtctagttccaccgcctactggacatcgaccaataggtctgaaatgggtgtacaagatcaagcgtgatcatgatggctatggtgaagtacaaggccagattggtagctaagggttacatgcaacaacatggcattgattttgaggaagtatttgctccggtggcaaggattgaaaccgtaaggttgttactggcactggcggcttaggagggatcgcaggtgcacgcaagtgcgcatgcaatccggcgccgggaggaaaccaaggatgcggtggaggacactgtcgggcagatcccctatcctatcgacgccgcggcggtcgatcagatgtgaggcttcccctagaggcatttcgtcgaacaggcggcaggcaagaggcgacaggaactcaccaatggtggatgcaacggggcgagtgtggaacggtggaaccctagtgtggacggggagtgaactgtgaagaatttgcattgcaggggtaaaggcctgaactctgggccgttaacccggcccattcagtcgtgggcctgaacagtatcatacactgggcccgtagggaccaattgttactgattaactgagatgggccgcaatccaggcctaccttacactgacatgggttatggttgaggcccatgcaaggtttatctgtcaaagctgacgtgccaaaatgaacctggcatgtttactgtagcagatagtagtagtactttgtttagaacagaaacatcatgttcaagagttaatctgcagaaaacgggaacgttctcgtgcatctgcgtaagatgcactgaccacaacgaaaaggaaacacccatcactggcttacaatctccacagattcagaaatatgtccagatacattaccagatggaagcactctcaaatatttccagttttcaagcggtgtaatgttgacaaagctgggagaaaattcccaaacatatgctatcacctgtaaagcaaattttgacaccaccaacatgaaaggagtactacaaaacaaaatcggaagggccaaatgcagcagggcaacaagctcctatagtatgggcactgtacagtaatggtaatgtacaaacatcatcttctacttttgatgctaatttgggatatcacaggattaccaagacaacaatcgcgcaaacccagcctttttgctgtcccaggtgactccccaactcacatagacagatacatctataatttacacttactttgcggcttgtatggctccatcctctcctagatcctgtccaagctacgtcaatcaattgtctgtacagcaatgcagctcgggggtcccgaattccagtaaaatgggctgaaaagcttcaccagtagcaaacctcctagtatgacctcaactagataactgccgacgactatacaattctcaacctcatcaaatgggagaaatgctatgcaagttgcattgcaggcgccaatagcctgtgtgtttcacaggggactccaggtatgcgaaatgcaaaacacaaaggcgtgtttcgctcgtagaaatcatggtggctgtacctggctagtcagccccagactgacctgcgctatcccggagattttcacgatgatataagcaaattgatttttggaaggagccagaagctcctgaagggtatatcataaaatcccattcaatactctctggtagtaatcatactgccgagtacgccatgcatccatgctgctactgataagtgaaagcaccagagacacgcattgctgcaaccataccaagatagcattagaactgtaaaaccccctctgcaaatgatgagttacaagacagttgactaacctcttcagtaagactcaagtgaaacctcttcctcaagttctgaatagtgcgaggaccacctttaaagcaagggaagccggaatcctgatacatggaaagttcggcattatacacatgaaagatgattactgtattgatggacttacattgccatgccaatcacagaaaggagaaaaataagattaggtacatagacgtaacccccacccccccaaaaaaaaaagaaagaaaaggacatattaaaatgatgtgtgtgagcaacatgaaactcggagtatgcaaatgaaacgttttatacattgatataccatatggcaaatgagttttgacctaactgaaactcgttagaatggctcttccgcacattcaagatagtctgacacacatggatgataaatatgaattctgagttatgctatgcaatgttctatacccttgatatatttatgttgagtttttttttaactcagatcaaacccattagaataactattctgcacccaaatccattagttgcaacacgtcatgcaataacccacatgccaacatcatgcaaaaccaaccgcctttgcattaacaggttatatcaagtatgcggtaaaatattctgcagacatgcagtagcaagtttccatttcaagtattgcatgtatttctggtaccactggtgtacaatagctatgctaaatttgtatagttcgattcagggtgtgcgtccgaaaatatttttcagaaatagggtgttcgcttcaagagaacaccttatattaggatgggttagtctattttgggaaaaagcacatgattttggtggaatggcccgaccaacatttttttcagctttgttctagtaagttattttataagagatgaggtggtgatggaacaaccagtttcattcaaaccatacagtggggtacattcggatttaggataagatggtgcattacttcaatcgctacttgtgtgaagcatgcaagcatagacaagtgttatataagacgaacactatctgataggctcatctaatacatctagacaaacatctaaaattttagatagaaagttacctgcaacatttctactagtagtataatacgctctgcatgcttccggcaagtaaggaacccttgaatgcatagaacctgaagcgtacaaatttacatggctaaataagaccattgaacttggagatgtcacaataaccaagagagtaattcactactagtccaaataccttgaagtagtcaaagaactcactgggtgttccctctgcatcagaatccatcacctaccatggtccccacaacaaaatttattataattcaacattttaatctaccataaagtttaagttacaagctaccatcttacttcaagaagctcccttgtcagtttaaatggtgcactttcaaaattaacccctccaggagagttggaaagcataaagccaaaatcaatatgaattatatgcccttcctcatctatcaagagatttccattgtgacgatccttgacctgcaatattttaacaaaataaaattcagcgattatttaggcccaatcatgatgacaaaaaagagtatagcactcacaatcgcaaagttaatttatttctatataataaatgaaatatttgatgaaaaataagaacagcatcaaacagcctttttaaattttggaagtgctacaagtatagttgtgtattgcaagttacagaagttcaattgaaactttaaagtaatcttatgaaaatgttgcagcacaataattgcactgcaaattccattcgaaatggtctcgaacttccagcaaattaaatatccagtcacacaggtcactactcactagtttccccctttacactttaacataaaggctagaaaactttctttatcagtaaactttggctggccctcaaaccttttgtacttttaataacattccacaaagaatctgtataaactggaaccattggatgctctgctggcccaataaaacctcagaaaaatgatgggagatttacaggacaaagcagaagatcaatagatctgtaatctgttctagtagtgcacagttcattagtagctaaattcaaaatacaaggggtccagaaggtaagccactgtcatttgttgagatggccccacagaacaataacaaaatgatctccagaatttgagaaatattatagaataataattgcaaacctagatgtatcacgcatataaactatgatatttggttttaatacctggagcaggtagcacaggattgagtatccagccatgctttccacaaagtttctctgttagtaacacaaaataaatcaataagtggttcaaatacattgttactagtgtgaactgtttttatgattcgtttagtggacactattggctagtgccttaaagtggtttaaactgaaacatgacattaaaaccagccaatcagctgttgtgaaccatatctctgagccacagaacagtcaaactctacctgggcaagtttgaagttcggagaattttcttcatacttggctacatagtagtcacggagacttgtgatatcggggaaccgactcttgatggaatgaattgacgcctgcagtagcatgacaaaaaaaggccaagctaataactttcagtatgcacagaaattcagaaagctaacttaatcataatggagagatgactaccgtatcaggaatagtctcaattagcgctgtatatgcagatgtgacgataacttcatagggtcgcaaccaaagtggtaaaccagcttcttgatatatatctgagagtacaacaaattttcaaaacaaagcaaagttacctgttaagagacattccaaatggagagatcacaaggtaaaggcaaatcatcaatgaggttctttcagaatcttgaccaaaagcaaatgattccagcaagcgttgctggtagactacagtacactcacattgcaacaaattcaactatggtaatccccactgaagtgggttcgtttgctggacataatgagggtattttatgtgcaaacaagtgttcacatcatgagtaacctgtaaataggacttaacatgataaattgttttcctatgtcctatatacttcagcaaacagcacaatgacatgctcacgtctgaggcatatagttgctaatctaccaagtggaatttaaacatatccgctaaatataaatttggtatgtaattcttcagacatttggtcagcttagatcaaaactaaaaagtatagtggtaagattgatttttttaccatataagtgtgcaacaagctgtacagctaggtgttcttgtcggcaatcatctccactcttgacaataacctgcaattggttgaaacatttcataagcctggcattaactgatggcatttcatttctataagaagtctcaacgaggtacaggatacaggatgctcaatctgaagcatgcaacaaagatcaatagattgtttacagcttaaatttaggtgcaaaaatttagtgaaaccaattccataaaataaatctgattgtctacttagttctccacaaagtttagagatgcacttgatagtgcagtggcaaggggtgtggtttcaaccccaaggtcccgtgttcaattctcaacactcacaatttcttctaattatttgataaccaagttcctccttggttctcctcttttttttcctccacaaagtttagatagattatttcgactgtaatggcagataacatcaatccaaaagattggaagaactacatttgctgatgcaaaatatacaatgagcatcggataagttgatgatgtagctgtcaatataagggagtagggagcattggattgaagaacagaagaatgggattgggattgggatagaagggtgaagtagatcctaaccctcaaatagtttccccaccaaatatcctaactaattctccatctttccccaacttctataccacaatccctatcacacactcctattcttaaataacacagaaatattcatttgggatagagtactgcaaaaaacaggatgttatgtaacttacagaacgcagatcccagccaggtaattttccatgaacagaagaccgtcgtattctctctctcttgacagcccagatttcaccagccaaagcatcagttggtttaggatctccaccatcagttgcctacatgaaacagagttaataatttaatgaagatcaacagaagaaaccagattgttagtgattcgaggattcacattcaccttagattctatattttgagcattctggccaactcctttcagtggaagaccaggtggagcttctccttttaatgctgcagcctagtcaaggaaaacaattcagcaaatagttgtacaagaggtatcgaactgtaaattggatgataatgcaataaaccaccttgtcttatttgatgactactaattcctggtgttggttagctaaacatctaggatattcgatagtttaaaaaagaatactctttagcaagattgaaaattgcaaaaagaaaagccttggagaaggaatctaaaaattttcagctcctaattaacttcacttaaaaatcaactcataaatcagctgcaccttgacttcctctatggcaattgtacttggaacgcggcgatggtccttcttccgcgttggttcattgtcatcaacatcatccatgttaactcctggaaccgcagataaagtaacctttacccactcaataggctgatcagcaattggttgggaatctcctgaaggctcatttgaatctgctgtagattgtcgtgacctatgtcccgaatcagaaattgcaacactccttgaacgaccaagtttctcaaccgagaaactaacgtttacaaattttactttggcctcccacaattgagccatagcttggtcaataacctgagaggtagacttcagcattctgtctgtttcataattttgtgtttcatgccgactccacaaaggatatgcccatggaggtggctttggcaactgcacatctccattagccaagggtatcccaccttttgacaatttgttaacatctgatgaccctttggagtgactacaaaaaggaaagaactgagtttacagaatgaattctgacttaagatccaataataaataaaggtaatgaagatcatcagttctgccatttagcaggcatatggtacttttagacaagtatataagaaaacaccacaaacaaaaacaacaggagttttaccataaatttcatcaagattgtagtattgtacaaagaactgcataccttggtgcttctgctttcaaaacttcaacacatataagataaggagctttttccctggagttaagaagaacagcttcatcttcaggtatatgaaccactcgatatatgccctttcccatcggaaagcatactcctgtgcaaaaagaaggcagacgaaaagaatttcaggggacatttagctactgcgttcatcttcagtgattgatgcttaatccaaaaggtagcatatgttttattttcttaagattaactggtactttctttgttactagagataaaacaaagaaaagacagaacaagacagtctttttagatgcatgacaatgcatagtgtacagttttgctacctagatttcaatatagtcaaaaccagataacagtttaccagcttcagcaaatggagtgaaagataggcagcggcactacataaagaacataaagtggagaaagcagcccatgcaacaaaactacaaaagaacaagtcagctcattaaactacacaggtgattttgctcaattatttggtcatcattgggccatttttcgttgcacaacaaccaaaatgaacaagggtggccatagaacattcaaatctaattccaaaagggatattttaacttgtgagcaagaaatatttatcagtaaaggaaggtggccagagctcaaactgcagccagaaaaaaataatggaacagtaaagcataggccatctgggatatgtctaactgtcaactcaagtagcttccatctaatgattataatgtgatgttagagttgcagcaccaagatttgatgctgaaaggctatgtgtaagaacataggaagacaatgaaatacagtgatatccacaggatagcagaaactacctccatttttctcagtagaagcaatctgtgaattgatctctgtaagagactgacacgggaaaagagaacccaatgggataaattagaatagtgtaactattataaaacaaaaaatataaaatatgaccgaaaggggtgaagcaatttagcatacctctcgaagggcaatcttacgatcttccataggaaatatgtctacaaggccataagatgtatcacacaaagattgcacaagctccaatgaagcatagtaacatcctttccgaagctctgctattgcgttgtttggtaaaggtggtttgccactttgcttatcaccgtttccagtgggaacagagtttttctgaaaaacatacagcttcagttaaggtcttagcagtcataaaaagaaggcacaagacaaaaggtatacaagcagtgtaatcagagcagcagatgctattgttatcagacctagaacccgtcaaactaaatgtgctttcaggacatctacaccataaaactgagcaattggctagataatatgtattaatacataggaaatacatacatgcaattgcaatggaaggaaatttgaattaaagggtgaaccaacaacgatctatacaagacagcccatatatgatgttagcttctttaccaaaatgatagactagtagtggtgttgtagaatcctcttttttcttttacaggtgaagggaaaacaaaataggaacatacttgtcataactgtttaagaaattcacacctaagctccaccacgtaaaacactacatgttgtacattgcactaataagtaataagtcatgaataaatagtgttgataactatccataaaatgccacacctaagtaataagtatatgattctgctgaaaccagaaacggtgagtactcaatatggcgatgcatggtagtactaatatgcacaagcctaaagttcggaagaaaaaaagaacaacttcagggaactgatgtcttgcctctttcaataactttgaaccaaaaagctcagagtcttcaagtgagcgatctctgtctcggaatagtcgcttgaaaaagctctctgatcctgggctaccctcagaaataccgttaggctgacaactttcaatatgcccactcttagcatcttcagggtgcactctaaacaacctgcggaacgacaaaaactctgaattttcctcgtcatcaataccactagtccccttaccatcatcatcatgtttatccagcccatcgcttctcctctcctcatgcttgtctttaaacaatttgcggaagaaattttccttatcaccttcctcacacttatcatcatcattcctgtcatgagcagctccctttttctcttcattcttatccttgaaaagcctacgaaagaaattttcatcatccatggtcctgtgtcctttgtcgtcctcctctttcttgtttggtgtggtgccttcctttttctcttcgtttttctccttgaaaagttgccggaaaaaaccatccctcttgtcatcttcgatgttcccagcagtcttttccttatcatcttgttgcttactatgccctccgtctttcctctcctcatttttatctttgaaaattttgcggaagaacccttctttatcatcatcctctaagctcttgcccactctttcctcatccccatgccttccatgcaggctctctctcctctcctcattcttatccttaaatatcctgcggaaaaagccttccttttcttcatcatcaccctgcctatcttccttatcacggaacagtcgcttcaataaaccctctgagcttggtgtcaattccatgtcctcgtccttgctgtccctaagcaacctgcggaggaaaccatctctatctccttcttcctcctcgttctctttctccttactaagcagcctcttgaaaaatccttccttatcaccatcctcttcctccttgtccttgctgtctctaagcagccttttaaagaacccttccttgtcctgctcatcatccttctccacggatcgcctaaagaacgatgctgcatcacgcaccttaggtccaatgcttagtctcttgagtagcttgttatcctctgacgagggtgtcgctggctgcttcactccactgcccccaacatcctctgcagcagctgcattgctcgcacctgcggggggactcaagccgagtgagggtgatgatgcaagggacagaaggcgctgcttcgatgagcgtatcctgctaagcatggggttcccgcgtgggctggcaattggcgacggcggcgcaggccggacgaggggtggccactctccctgaacggtcgccgcagcctggcactgctcctgcaccctgtcgatcccatccaaatcgtcggtgtcctcgagctcgagctcggcggctagcagccagtgcaccttgagggcgatgcgcagcgacttggagcaggtgtcgatcacgaagcggtcgagcgacgggctgggcttgtgcaccatcatgtagcagacctggaagaggtaggcctcgagccccggcagcggcagcgtgtacatgcggttgcagaggtagtcgcgcaccccctggtggtcatgcttgtagaggtagctgacggcgatccactcgcagaagaaggcggagtcgaagaagcgaacgagccagccgctgctccccacggggtgcgccgccgcgtcgccgccgccgccccccgccaccgtgatctcccgcggcgactcctccggcccgaagctcaggctccgcagcccgagaaaccgcaccatggccggcgacccctcaacacgccaatcaaaccgtcactcacctcctcctcctcccctcaccaccatcacaacgaacaagctcgatccagcgcagcaaaccctaggatccagagaaacggaacagcacgcgctccaccgccgccgccgccgcccaaaccctagcctcgccggcgagggggggggagaactcaccggggcagctcgatccggggccgccgcgcgagccctagcctgggaatcgaggcagcgatattcgcagatcgaattgggaagaaaggggggtagaacacggaagcaagcgggtggggggaagggggggagagattcgaacgaattgggggaggatttggttgagatttgaaatgtcgcggcgtcgtcggaggagactttggtttgaaattcgtgtgaaaatgggaaagattcgtacggttttttcgcttgggttctcttcgccggcgtggggggtggtggtgtggtggtggtggtggtgggggccgtggaatcggcgagagcccggagcaggtgggggcggtgatggccgtggcctggatcctctgtgcccctctctctgctgtgcccaccatgtgtcgtgtacttcgtgtgttcatcgtgttactccgtcatatcgtttggataattggttattgtttcgcttttgcttatatttataagtcaaattttaaagtttaaaattaaattttaaagttgatttttatgtttcctcattgtagtatattttaccgtattctcttttgaattgttaaaacactaatttaaaagctttactcatatttttttaaaagaaattgctaataataagtgttttgcataaacatgagcgaaacaatgataccgttgtgctgctgaatagttttggctgataaatcataaaaaacaaacgagactaggatatgtgtggttaatagctgaaaaaaaagaaaatggtgaaaagtgcctaaataaattaaaattaactttgagaatttaatttttttatggcttatatgagctagcaagcaaataacgaggattttattttgcaatacttaagctcgatcgtgtatatgcaactattgtaatgatacaaaaggagataactgagagagtttttttaatattactagctattttatcaacaatgtcttttgttaaatagatttataatgttgtcataagtttattgtatgggatgcatgacttgaactaggtaagttgcaaggtttgatggtacataaacctattagattctacaaaacagcatatggcagcctacatgattccacatttacctaacccaatcatcaggagtgaaaaaagaatatgttatattcggtcctagattcatttttatgggacggagggagtagatatttgtgattacggcctatttttaaaatataagattcatcgagaattttttttataacaaatgcttcaaaacaagctaaactatggaaccattgaggatttttgtctcctttgtcacatgatttgtccatatgcataattttacaacaaattcgaatatcgataaaatgtcacaaacttgacatcatttagtaacgaaaccaccaagctctacaaaatatcatggagagtatgtggcagcctacacggtacccattaatccaaccggttgaataaaaaaattgaggacaagatacacgtagcgtaattatatgcatgtgtatcgtcgaatatcacattcatggctaaagtctatatttagaaacaaagaagattcatcaagaatttacttgtaacaaatgcttcgaaatgagctaaactgtgaaaccacttgaaaatccatccttctgccacacaatttgttgtatgcataattttaccacaaagtcggaaatagtatggataaaatgccaagaacttattgtaaacgagggagaatttatagtcaatttgcagcccaaccttttggtgatagctaatttgatcatcatctcataagtacttgtatccctttccacgaagaaaagctgaaactttggtacttcctccgtattttaatgtatgacaccattaacttttttataaacgtttgaccattcgttttattcaaaatttttgtgcaaatatgagaatatttatgtcatgcttaaagaatatttgatgatgaatcaagtcacaataaaataaatgatagttacataaattttttgaataaggcaaatgatcaaacgttagataaaaagttaacggcgttgtacatgtacaaaatcaacgggaatatgcatatggactgttgaggcgtgcggtccaatcaagtaatcaactggaatggaccgggcctattgctggcccattgggccgatcgcggtggccatgagccctccgtatctgatttccatcctactgccattctgttgccttttcatttgttttgtcttcattttatttttcttcttcttttcttttttttaaaaaaaacttgttttgaaccagcgtgccggttaatcaattgacggctgaaacacgacgccgacgtacgaagcagtaaaactacgtcatctacgtgtacaacagccaggaaaggaacaaagtctacatgaaaaaaaaatactgcatattccagttgatcagtttacttcgtccacagtctacacctacccctactatttattactccctccgtttcatacataagtcattttgatttgccttttagttaaatttatttaaatttgaccaagtttagagaaaaataaagtaaaatattcaatacaaatcaaacatatcaaaatatattcaatgctataaatttaataaaactaatttgatgttttaggtacgttgctaaacttttctataaatttaattaaactttaaaatatttgattagaaaaaaaaattcaaaacgatatgaaacggatcggagtgagtcctaccaacgctgtgttgaccttgccaccacttgacggccaacgaccacaccactgccagcgaaaggagcgaagtcaacacgtgaagcattcagtttgattcagtttacttcggtcttgtttagttccccacttttgtttttaaatttttaactttttcatcacatcagaactttcttacccacaaacttctaacttttccatcacagcattctaatttcaattaaactttcaatttccccacttttgtttttaaatttttaactttttcatcacatcagaactttcttacccacaaacttctaacttttccatcacaacattctaatttcaattaaactttcaattttaacgtgaactaaacacaccattaaaaagccacaattcgtccactagtactatttctgtttgttctcgccaaaggttgttgattttcgatcgctggctaactgcaagatgcacaccagctagctctgcgatgatcattgactgcatatcgccgtatatgtatgtatatttatatcaacttgatgaatcaatttgacagtaatgtgatcgacggacagaccatttttcgtgcgtattctttgtggtccattatttttttctaaaaaaaaaagtactactccctctcgcattggataataattctcgacgttataagatattagaatttgattatcaatttattttattatcaataactttataagattcaataactttataagatatttagtttgaataccctaagagattagtcttaaatatactacaataaaactaaatatatgtttatttattaatagagaaatgcccaggggtcttctgggtagcttcacaaggtagggctagaagatttggttccgaatcctcacactttctaattatttgatactaggcacttccctaatattcgtgtctttttttatttaataatatattataataataaagcatagtcaaatgtatgtttcgaagactatatagttgttcaaaacgttaagaattatggaattggagtttgatattaggccctctctaatatttgcgtcttttttatttattaatatattataataataaattatagtcaaatgtatgtttcaaacactgtatagttgttcaaaacgttaagaattatggaattggagagaaataattcacatgatttatgagggcacgtttaattatttgatattaggtcattccctaatattcacgtcttttttttatttattaatatataataataataaatcatagttaaatgtatgtttcgaagactatatagttgttcaaaacattaagaattatggaattggagagaagtaattcacataattagggggtgtttagatcaggggtgtaaagttttagcatgtcacatcgggtattatatagggtgtcgcatgggttgttcgggcactaataaaaaaactaattacaaaatacgtcagtaaaccgcgagacgaatttattaagcctaattaatccgtcattagcaaatgtttactgtagcaccatattgtcagatcgtggagtaattaggcttaaaagattcgtctcgcaaattagtcgcaatctgtgcaattagttatttttttagcctatatttaatatttcatgcatgtgttcaaacgttcgatgtgacagtgtaaaaaattttggagtgtgatctaaatagggccttatgaggacacgtaccgtatggattgatgcatgcatcctctaaggaattaatagggaggctataaatagttctaattcggatttatccacatgcacaaatacaccagcaattggaaagttgggagagtagaagtgaaccagggtttaatatttcagaccgaaatttcctggtttataagaagattaagaacaggcatatatttggtcaatggtcatggaaaactctggcttagctaggctaagccattcgatattcttccagctttgacaaggtctagtggcaaatactagcactccaattaattactggctatctaattaatttacctctttcttccctgcaaaggacgtactgcctgcttggaatggatcctcagttccagcttgttcttcaagaagtaattacttctcaccacttgtgccattttagtcaagtttctcgggctctcagaacgaaatggccactctctgatatacacatgctctgacttggggtgactacaacaactctgaatttgtcatacgaaaatgtgatgtcttgcaagcaagatttatcgatttagccagtacccaatggacaattaaaatgacaaagtggaatggatgaaatcctagcggcgataccatttctaaggccttgtttctttcaacttgggattattataatccagattattgggagtaagctgaaaaaaacagacaacttattaaagtagcttattataatctggaacccagcttattataatatgttaagcttatttaggtgagcttttttcagattattgggtgaaaaattacccaccatgccaccccatttcctgtttagacttgcaaacccaataatttaggctctaataagctagaaaagaaacaactaatcgcttattctactacagattataacaatttagcttatagtaatctgactcaataatctagattataataattctaagctaaaaaaacatggcctaagataagttggttcgtattatgatattttctaaaatttgcaaatgaatgatatttgttggattttctcagtaaacaagctagcatggcatacgcttgatctctgaatatctttttgcattaatcaggcatagaattcgatcgtacgcgtggctacctctgcgtatgcttgcttgccagccaatgcctacctgcttgcttgtttgacatggtctctctctgaagtctgaactttctgaagatcgatctgaagttattaaagttcgaagcttctgagatcactgcaggaaatggagtcatatgcatcgtgtcgcctctttgatccatttacacatggagaaattgatggccttggatagctactagctgtcgcgtgttgatggttgccggcaattgacttggcacgcagcgctggatggctctgctctttcggtccagatctagggaacaagtataatatggaaaattgacagtttcttttcaacaaaagcaaggtcctatttagcttagtaatcttagctaaaatttaaatttcagaaatttattttaaaattgtttttgaggtttttttatcatagcttatttttttacattagcttttaaattactaaggacacatatataatttttttactcataaattatttttttagctgttaataaaccattttacgatttgtcatctgtaggccaaacaattacacttcggatgacatatcatttttttagtgcaatgaatatctatgtttttcctttgcaattatgatatgtattttttaagaaagaaatatatattacacatgcctatatgactcctactaggaaaatcaatatcctaggatgggcacaatcagtcatgctaaatttgaccgacgaaatctaaaaacacgtcggtgggggcatatgaaaacatgttttcccctgaaatagatggcacaagtatgccccttttcattaagaggaagtatcaaatcgtacatgcatgtgagcccatcacaaatatttttattacagggtgtgaagccaaatggcatgggaagcaagctattaccaccccggcagcccggagctttcactgtagctcgtctgacaaattcgagtgtcttggcctatagccatgctctgctgctccacatcaagtaggtaattgttgttgctgcagagctctcttgaatgagacatgcaattagcctttaatagtcttaaaaaaaatattgagatgtgtaatcttgtctgaggcatttaactcaattttgaaggattcttcgcttgcgatccttccaaatgtaccatcaattgtaaaattatcactccttacattgaactcttctatcttttcatggcacctgtactaatcttggactgagatgtagtatgttggatgtagtgtattacttagtcccctcccctccaagagaaaattgataaggaccaaacggtccaagcatcgatacaatcttccatcaaattggagtgattccaattgtcaaaatcgcacatacatagcatgtgtcagggagtgcactcaagtgagtgggtgcgagtgtgtaactgtgtatgtgtcttccgtgtaaattactcatagatacccctccgtttcaaaaaaatttaaacctatgtccagattcaaaactaggtttgattttttttttgacagagtagtagttcatataacatggtagcatatggcttatttttaggattttatccttgcaaaagagtatacgatccatgcgaaagaacttgcatttatgtcccgtcttcgcttgacaaagatggttggcaacaacagtgtgttaggacatgtggatgatttcgtacaaaaactatacatacatttagataggatccattattctaaaaaatgtcctaaaatagcttctggtttttatctctaatcagatttttttttgttgtgaatagattcatctctccaacaaataactaagactaccaccgataataaaaagtagctccacctcatcaggtaactattgtcgccgatttttcaagaaaaatccaaaattttgggattctgttggccatggtctcgaagtatttttattttcaaaagaaacttagcgacacagctacaaatcgggtgcaaaaaatcgggcgcctcctacagcactactctttaccctgtatgcatgttagacaacatttatctcttttcctatgtacataactaacttttcacaaacttcaaaaaatttcttatgcctaaattacttatctaatccatgaaccaattacactattatatttgtcgcaattaaatctctataataagatcccactcaaatatattttgatgaaaaaaaatgtctgttgtttcatcccttagaaaaaaaatgtttcatgatttgatcaaatgttttattttactgtataaaatatttcagagagatgccacatttaaagtatactgactgtaacaccggcaatgattgtacgaaacattgagtctcaacaggtaaaacataaaaaaataatacgaaagatacaatatatttgcaaaaacttgatatcgttgaataatttttttgtcacgtacaaacattaaattgtaattgttgaaatattattaaatatctactaaaaacatcatatgcaatatttgcaaattaactagtgaaacatcatatagatattagttgaaacatttaaataaagcagcaggtgcaacatttaaagaaatccattaaaaatctaaatatttttttattagaatataaccatgtgtggtcttattctgaacatttaattgcaactaatttaatggtgcaatcagatcatgaatcgaatgaatagtttaaaagaaaaaaatcatttaatgtttaatagtaagtttgttatggatatgttagaagagagagaatagtaggaaaagtatgtttccgaaagtcaagacgactacaaatcaggtgtccgattttttctaaaaatttggcgttgtttcacccgttgcatgaaaatgttttattactaaaaaaggtgaaacacattcaaatcacaaaatgaaatatttttctacaatgtatgaaacaacggtttcaaatatattgaaccatgaaacacatttgagtacgtcaaaaaaaaattaaacaccatagaaaaccccacaacaacatttcaatctaattaataaaacatcaaggtacatgagttgaaacatcaaaaatattcgaaagaaaaacctagatctacctcttcctccgctacagtggttagccaccacatcgaccgatgttgaacttggtgcaatgagctcggccacaaccacgtggccaccttcatcgacaccgcgcggagctcggcctcatccacatggccaccatcgtcgacactgcgccgagcttggccacatcgacatggctaccgccgcgctgagctcctcgtgggctttgacgcagagtagttgatcgccatgtggagatgatgcaaatagagaggagaaaaagtgtggagagagaagaaaggggagagagagagagagtaagggatgagggaacggataagaaactagtgaggagaaaggctagatacttaatctccctatcggtcgtccggataggatcgtttccaaaagtacatgcatggaaatagcaaaaaaaaaatgtatacaactaagcaggcaacgttgaggaaaaaagcgcctcataatatagacttatgccatgtttgattcagcttaggattatgataatctggattattaggagtaaactgaaacaaacagatagcttattatgataaattattataatctataagccggattactataatctggtaatccactctaaaggtgctttttctagattattgggtgactaacagctaataatccaaaactcaaacagctaacagcttattttatgtcggcttattataatccaatttatagtaatctggctcaataatccagattataataatcttatgctgaaacaaacagggccttagaccaaatgcctaaagggcgccccaagcatcctcggaaactttgtcagcctcatatacacatcactttcttgcatgcgtctcctaattagtttcagtacaacgttatatttgtcagtatatatgcttttttttatgaaaaatatagcggtataaatatagacagtcccctcacttatcctccaacactatactcgatctatacatgctattcctctaattttaacctgagcacaattaatcaacgacacaagattgattaattactaattagtcacactcgaaaaagaacaatgtcagggtcaattccctctggcacagtgacagtcgcctgccacgtgtccggcagcgaccgcgcgatcctcctcgcgctctccaagtagccctcgaacttgtcggcgctgacgtcaccgccaaccttgcccgccgccgttgtcttcctcgccgtctggaactcgccgccgtcggagtcgctgctggtggcggagctgctgccaaggtggcagtggagcagctcgcgcgccatgagctggcgcttgagcgcggcgcggcggaaggaccagtcgccggtggcccagtcgaaggcgtagagcgggaggaagcggtggccgtgcgccgcgacgaagtcgatggcggcgaggacgtagcggagctcgtcgccggagaggtagtaggcgaagctcaccctcgtccaccccggcttcacgccgtggtaccccctgacgatggcggcgcggatgcggagcgagagctcgtcgccgacgccgagcagcgcgtgcccgtacggccccgcgcacgcgcacccgcccctcgcctgcacgccgaacaggtcgttcagtagcttcgccacgaaccgcccgtgcagcggcagccgccggtcgtcgccgtcgccggggaagacgaggaaggagaagatggggaggcgcggggcggcgacgttgccgagcacctccacgttggggttgcccagcagccacgccatggcggcgtcggcgtgggcgcgctcccggagcgcgacggcgccgccgcggccgacgcgcgccttgacccagaacgcgagcgcggcgcggaccttgccgacgatgggcggcgtgccggcgtcctcccgctcctcgacgccggcgaggtacaccgtgtcgcgctcgctggcgccgttcacgtaggcgacagtgccgccgccgcacgtcgtcggcggctgcgacgacagccggtacagcgagcggctcatcaggaggatccccggcgtgcccggcccgccgacgaacttgtgcgggctcaggaacacggcgtcgtagccgtccacctctccgggcctcatgtcgatctccacgtagggcccactgctcagtgagacacacacgtcagcttcagacacacacatgtacaccccatgcatgcatggttagttagctagctaggacatgcatatgcatttactcatgaatgataaactaattaatcaaccatacgtatcttttttcatatataaacagattaatactcaatccgtttcgtattataagttgctttgatttttttctattataaactttgctaagtttgatctagtatatagaaaagttcagcagcattttaaacaccaaaaaaacttcattaaatttaacattgaatatattttgataatatgtttgttttgtgtcgaaatggctactatgttttcctataaaattggttaaacttaaagaaatttgaatagtaaaagtcaaaataacttatgatatgaaacggtgagtattcatcaattattaacatcctttattttttcagaaaaaaagttcaattatatgtttgcattaaaatttctggttatgcaatgatatcagtatgaacaggagtacagagcagagagataataataaagcaatcacattgtttctgaatggcacatgaaaagaaaataatttcagtgtcttcacaagctagctagcttgtgattcagaagttcagatgggttaagacttggaacttggaaggtcaatggctttcactatcaagatgagctactaacaagactcttcgttctaattaattaatgtaaaactagaaaaaaaatggatcaaggaattggttcgagattgcttctgtcatcatcagagaagaaaacatctacaaggactgaataaatctccacatatagtttaattaatgtgtgtactaacacacacattctttatcattcttgcatgttatgtattgctttggtataccatttgctaatcttaattatcaggtcaaaatgacgatgtcatccaatgcaacatgcatgcagcagctggcaggtggattgaaatgcaaaaaatagccagattggaagtcaatacagtggaacaaatcaggaaaaattacctgtttctgaagaggaaatctaagtaatcaagaaacgcgctatctaactcccctctctagttaggttaagtttttgaataaatatgctgctaaaattaaccatcaatttgaccaagaaaaaacaccacatgtatattgatttcatcagcagattggattgtatgtacagtccgtactaattaagaaatgcgtcaactgtcaaactggtggatagcataggatcattatcgaagaaaatgagagttccttgcaccacttggaaaccctagcttccaattcatggacttccgatacttgtagatcattgtattcatacttcatcaaaaacccattataaaatcatgaaaaaaatgaaaatgtgatccatacacatttcatcaaatggcaataatcaacaattaatccaattaatccattagttaaatactccatccattttatattataaatcatttgacttttttcctagtcaagtttgactaagtttatataaaagtttagcaacatctaaaataccaaactaatttcataaaatctaacatatgtttttttaaaatactaatatgtttttataaaaatttagtcaaacttgactaggaaaaaaaaacaaacgacttataatatgaaacatatggagtatttatttaattaagtaatgcatcgggcagtgtgattattagctgtgtctgtgtgcatgtgccacgtgtacctggcggcgaagtcgaagcaggcgaaggcgccgtgctggtggaggaggcgggcgacggcgcgggtgtcggtgagcacgccggtgacgttgctgcaggcggagaaggaccccagcatggggcggtcggcgtgctcgggggcgcgcagcgcgcg

SEQ ID NO: 11514 - DNA, 13688 bp, Oryza sativa
caataaacgggtggacatccactcgagctgttaaaatagtttccctctatatataggagtatatgcacacaatgttatctactaatttagtaatttatgaatatcttttttggagactttgtgagcttgtatatcaagttactccaacatatatctcctgtttcatgtattgattcgaaatgaagatatgctcaaaattcaaagataatttattgagggatgttaatagaataatctatcatggtttcatgagatgacttatgggccggggattgcatggtaatgtgatttgcatgccatgtgtgttgccaaattgcagtcgtctatcgattgttagttctgccgatttgttgaattaactatagaccttgttgcatcagcttggcgaattttgtaaagtttttaagcgaaccaagtcgtaggtagttgtttgcatacttccatttggttggttttcagtgtagccgcatcgccatgaaatttcgtcaagtgattaattaccgacagtgccgccggctgtcaattcatccgtggataaatgtcgtcaaacaaatctaatttgtgttggaaagcaacaaaattggtgaatttctgggggctttatgcggcgaccgggatatgaattttaatctgagtagattggtcagatttgaggagacctaagcacaacacggcttgtaattttgtaagttatacccgctttgaaatttgctcatgcatttcagaaaatatatgaaaccagaaaagaaaagaaaagggcaatgcacaacaatctttattagcgggctctttccgttgtcacataagtaaatttggtgacgtaaacgagagagagatgagaaaaacaaaacatcgttgctatgcatgacatatggttagagtcgactcttagcatttattaaaagaatatttgttatatgggttggagaaaagggaaaaaaattagtaacaaatttttttggtgtattaatagttaaagatagtgttgtctcaattgttttagctaagagcctatcttcaccttaatttgtaactgccctaaggcaataggaggattatataagaacccaatgctaataacttgccgcaaccaattgagattgggccaatctattttgtccatagccagcgttgtttaggatcatggacgtcgtagaggcaggggagaaaatggtaaggaaatttccggttgtcatttttgatttgcaccgactgtttctgtttcagttggtattagtaattgttagtgtcggaaatggaaacgttaatgtcttccgaaaatggtagcggaaatgagatgatggtttttccgaccgttttatcagtaaccgtaattatccaataatttccatcaaaattccgaaatttccccaacagaccagccagcccaacccatcggaagcctatgaatgaaggaaacctggtaaatttgtagcccattaagaggaggaagtggccaagggaaacactgtaaccttaggacgtaccatatagtctttgctgaactttgattttctcaacttattgatgctgaagttagttgaattttgtttatattgttcaccaaacttattatcatatcattaataatcatataacggtgttatgtggagtataatgatgtaagaataaagttataaaatcatcttcatgcatagttaaatgtctgactatgccacgctccgatgtttccgacatgaatatttgacttccgagttccaaccaatatcagtagattccgttccaatgatcccgtttcctatataccaatattaccgatatcgttcagttctaccatttcgattcctttttgagaaaaaaatgaaaataaaaaatggtagaggatttctccgactgttttcatccctacgtagatgtccaaatcagggttttaaattttgaaattgctatgtctgccgggggcaccgaaattaccgaaatttcagaaatataggaaattttgaatttttttggctgaaattgtttgaaattttgactgatactgaatgaatttgaataaaatatggccaaattcacaaaaaaaaatgcaaaaaaccgaaaaattcgggcgagatatgagcttgccggtggtggggaggggggaaaaatttcgaaaaatttgaaacgaaatttcaaaccctggtccaaataaaacatccatcaatttttttaacatgtcaaaagagtcaaatcgtttcaggtatattcattccgctaacaaggagcaaccaggcaagagtgacaaagaaacattcaaagttgagattcaagataacttcactcagagggcggatctacctattaggcagggtgagtcgatcgaacaagctacgagcctacgacccttgtcgcccccacatcctcaagaccctctacccccttatagtagttattggttatcaaaataaggtataataaggtgtaaacatccaacagattattccgactcttcacaaagcacgcacatcgcaaacaatgattgagacagttatgcgattgaactataaatatgatatgtgttgtgttcaattctttttatcatgtgagcatatccgttctctgccccatctatatttgtctgcattgtataaaaaacataaaggattaacgtccaattaaccagatcatcaagcatgcatcgtcatgaatatatataggcattgatattggaaaccaattaacactcacgatacgcaacggataaaaaggctttggcgctctcaccaacctggtacacgtcgaaaaaaaaggcgctgatcgatcagcttgatgcaccaatcgcaccaacagattggcgtcaaacagaaattaccgagggcccttcattatattaacattcaacactcccagttcataacaaataagcatacttggtggagccagaagatatatgcaaagttagaatgcaactgtcatacatcagactttctgcataagatatctaggaaagttaagtaaacaatttatttcttacttagcaactgccaaagttccagtgaaatgtttagtgagggcagaacatgcaaataacaaacttcaggggaaaaaaaaattataattgtaagttcatattgcgagtttagtttactgctgttacagatacaaaaccggttacagctagcaggagcaggaaaggcttctatgatctacaaacattcttaagaatttctgagtttgaaacaggaaaccagggttgccggatcaaggaatcgaatcacttccatctccaacaccacccctgaatcaacatcttgaatcccttgatgttaagcaaactgcaattcgatgcaagtagagactctgccggcaatagggttggtggtgcttgctattctgccaacctgtttatgaatctcatgtcaattctccactttctttcatatctgggcattcatgcaacacagcatcgcaacatcctctgagagaaattgcaacctactggaatctgtagctctctttagtgttgcatgtggttcctctaatgaatggctactctgaagaatgctctcatgaaacatctgaagtgtgtcatctgatgaaacttcttgcgcagagttcttcaggtcttggagttgtccaatttttctttcaagctgtctaggagaggcgttgggacttgagatcagaattgtgtaaggaaaaaaaaatattcttgcacatgagtaagaaaaatgactcaatagtaccatgcccaaggaatatatgtatttggcaggtgagtatcaattgcaccatcgctaacatgaaaagtaaaagtaatgtcctgaatggctttgttagcgtcaaattctgcagttccaatttgtgtttctacccagatttctgcaaagcaaagaaataagatttaaaaagtacacaaaaatgtctacttcgattggttaaacattccatctaactgtacaagtatcataaaaggcaacctaacaaaattaacatggctaaagtaaaagacatttgaagtacttcaaagaggtcaattaaattgcagatgcattaattagacaggactcagtacctagctaggaaaataaacaaaatcaaacatttactaatttggttccatatcaacttgagccaatcttgttgcttataagataacatgattgggactttttacttatctttatctttttttttcaaaataatgccagttcagtttcagaatttctcatagaaaccattgcataaaaaatgtacatgaaactacgattaatcatggtaataattcaaccgtacttcaatttagacggcactataatgtatgaggaagatctccataggtcatttattagtttacaaaacagtgcatggatttccagcttcaattttccacctgtgtgctgacaaaatgcaggaaaaatctctatataaaatgtggagtaataggatcatgctgatgacttaacaattttagtaccaatttctgctttgtaagcactgagctcagctcatccgtgttgttactgattacattagtatttgtttatatgctatcgatggctgtttgcacgtgtgccacttatacttttttagtcttagaagttgttcgcatatattagtcttgtctaaaaaatatatcagattgactcaggaggttcaaggttttatttcaaaaattggttgagtaattttatatctctgcctaagatgtgacatagtttttggtataagatttacccttttatgcagatcagttgaaggcagcaagacagtgagttcatggacataaattggaattcgaatttgtgcgcataaattctgaattctaatgaaccaaagtaatgagactacttatcttcattttatccctccacatgactataagaactgaggaaatatctttttttcaataacttgctcttcttattctttaaagatagcgttctaagtgaggaagcccgcctatggagtttggtgggagctaagggactctccctgtttgtggaccccagctagggccttttcttttgttctttttggtgtgttaccgcccatgcagtgacttgttttgtggtggcgtgaattcttgtacttcttgctgttttttggcgtgtttgtacgcttttcttctattaatgcaatgatacgcagctctcttgcatattcgagaaaacaaacataacgttcgaaatgcataacattaaaagttcagtttacacaaggaaggagactaaggaattgattattcctttataaatttggtatagcgtttacctcaaggcaggagcagaagatgctggtgcctctttatcctttttctactacttgattctgtcctggataaatgattgcaaagaggcatggtcttacgtattgcacattgcaacttgtatatgcagccggactgtcaagtgtcaactgtgtgagagctcaaccaaatctcttgtgttctgtcttgtagaaaaaaaatgaatgtgctgtgctactgtcactgttctgcaagctgttgtacttcaatccaacgttagatagacatcggcctgagttgtgtagcaatggtagctgaatcaagtgaagtctgaactgctgtgcaattctggtgctctctagtttacagatccacatgtgtccaccaatagtaagagctataattttttgaaagggaaactattgagatcctccaaatggccgtttttatctccaaggtttcggatgaacaaaaaaagcagccaggaatttctacctacaccctggcaatggcaaaagcacaatgaatcagctccatcaaccgaaatcgctgattttgagctagtcaagaccaaaatacagattcctacatgcaattagcagaaacatatttgcacatcatctgcatttgaaaactcgaggaatatggagtttatgaagtactggtgagtagaggctttaaaaactttaaaagtataatcagtctatacttgattccttgccctcctattccaggtatcccttgaatcttcagccaaagctagtagcaagtataaaagaaccagcataaatctgatgcagtgatgctatccaattcacctcttctatgctctccttctattcagtagtatgtaaaacatacaagcatacacttgactgttttgaacttaaaacaaatcaatatagatgcctcaatttgtgggggaaaaaacataataacctgggaggtaaaacaaaatgaatgaaatgagagcagacagccatgctattaaattcaatgtagatggctgaatttgtggactgtatttccttcattttggttcatgacggcaaatatttcatatttcaattaatatggtttcaagtagaacgcaaactgcaccaatgtgttaattattgcctagttttagacttaccattggcagaatcagtgtggggcatcaaaatgtagacttaaccgtggaattacagcctgaaaattgaattgaacatgctggcaatgaactaaccttgataatgtatcacaaactgaattatttgaataaattccacagttctccgccaaccagtttaggcaaatgcgtatgtatacatagacttcaaccttatacaacaaaatacgaaacaagaatttttgctacgaatcacaataattcataccattagttagttcgtagatggaattgagcttatatggtgaagaagtaagatttgggagggtgtagagacctgaagcgcatggagtcgtgggggcgagcgcctgccttggatcttggccacggcggcgcccttgagctcacaggggctgcgaccctcgatcccagggcggaggcggacgcggacggggggaagcgccgtcggggcgggcgcgccctgaccttatcgatggtgacctccacgacggcgttggttttgctcctcccctaaccccccgcgcgcgcgccgcaaccggggtactcgcccggggaaggcggcggagagggcggccgccgctggaagagccccattgccgtgacgaggaggaggggatggcggcggacagggcggtgtgccggcgggtggccgcccgtgtgggcattcggtttcgtttattcgtttttgttttttttttaagaaattcgggtgtgtcgtttattcgtttattagaactcactcaagacggagggaataactgaagactgaggccttctttagtttccaaaaaaaaaaaaaatcacccaccacatcaaatgtttcggcacatgtacagagtattaaatgtggaaaaaaaaccagttatatagtttgcgtgtaaatgcaagacgaatcttttaagcctaattgcaccataatttgacaatatggtgttataataaacattttctactgagtcttaataaattcgttttacaattttcaggtggaatttataatttgttttgttattaaacaacatttaatacttcaaatatgtgtccatatatccgatgtgacacccagaacaaaaaattttgctaactaaaccgggcctgaaccgataagtacaatagttggctatactacgggtttcgataagtactctatacagtttttaaatctaatagaaaaaatacccgtgcgttgcaacttgtaaaaatatttttggatcgctatacattttactctttggttttggactaaaatctcattccttacttactttccagtcccatcctagcccgctaccttcttttgcttggcatgtctctctttgacgcaaccattaagtggagctgtatgtccagctcgcaaaccggcggcatgctggctagaggcagagcctaaaggagcacacgctactgaaaagggtgaggtgcagtaatcggaataggacagcactagcgagatgcgacgacgcggtcgtcaggactgaagaatgcgcgtgcatcgcaaatagggattagcgcgcaagcggcgggactggaggcggcggctgcatcggtcggcaggtttgctcttgttaattgttggacattgatggctataagggctgttgggctttccgtcatatttggctaaccgatgggtataaccgaataaaatttggttagttgagtatgaagaggtctcggttccaattagttcagtatcggtctttttttttgacccctgcatgtgggaggtgagagagaagacaggataaattttactctaaccttgagtggctgatatatgcctcctcttactcaaagataagaggagcttgttctcggtggtggcggatagggattgagcactttgaaaaaaaacccctcaaaatttgtactttctccattacatataagtcgttttgacttttttttatagtcaaacgtatttaagtttgatttgactaagatataggaaaatatatttgcatttttaacataaaataaatacactatgaaaatatattcaatgttagatttaataaaactaatttggcattataaatatcgctaattttttctataaacttggtcatactttaaaagtttgactagaaaaaaaaaatcaaagctatttataataggaaacggagggagtatattacactgaggtccaccgcagctatctctcgccataaatacatgatccaatgactgcgagcgagggggcgaaccctaaaatcggcggcaccacgtggtagggtttttcgccctagaacgagccttggattcgtggattatgagatggcacaagaaaaaagtcgacaacagtggcagagctggcgatgttatcgagcctgtgcagctaatagtgtttttcgatgatcaactaattttagaacgtaggtggttattcttattggaggtggggcccaagcgatggctcgacctaccttggagatgcctccaccgccattgatcaaggggaaacaagatgcctaaataggatgtcatgcatgtttagatagtgaggtggaggatagaaaggaggatatacgagatttctaccaagcaaagcaataagattatttttatttttcctggtagaattgctaccgacatgtggatccactaagttttaataccacataagcaccatgtagctgccacaacttatgatgaagaccatgttagcgtgtcgtatacgcacaacatctagcgaaatcaccaataataccgttctgaaagtcgttttacaccagttttaaatagttgaagaaatcaatataccgattttttgattgaggaatatagatcagatttgacatatatgaaacaaattgggccttttccgagtctgtttgtactcaaatccattttgcaggcccaaacggtataatctcagcatgcttaactgggcctcgttgactccaataatgggcctaatggttgttttggtccagtttttaaagtctgttcacttttgcgaaattaatttagttttgtaactggagatgaactattttaattaagtttaaagttggccaaatattggattttaaagttaaagccggttattctgaaaggataattctttagatacctcaaatgtacttttgcgagattttttaatattactagctaaaggcccgtacgtttcaacgaatattataagagataaaagtaaaatcaaaagcaaacattataagtttatagcatagttagttgattaggcatataatgatatattaaaagcaaaagcattcatgtttgtgaccttataaccccacatatcagcttgtaacatcggaggcagaactggaatatcatcattagtattatttaaagtagtataaatttgtggttggagttggagggtagtcgaaattgataatttctcctagagttgtaagcggttatttgtattatgtttttgtttttttaataaagatgattgttgttgttttcacttaaaatctgaattcatgcaagttccctctcgtgacaacaacaacatcacggtcgcttttacgagctgagctatcatctgttccaatcacagtgatactgatacacactgtactgacactgacagtatgaaatcgagctagagctttagctccctttcgatgacagcgccctggcaacagattaccatcagtgtatactcgcaaagtcacaatcacaatcagttgctgtttgtcttagctagctagcttctcacttaattaattaactaacagccgccttctcggctggagttcttctagatatacttacatgcatttatacgtcgtctagttagtatatacaccctaaccaaggacctaattaaaccatcattcattagttgtacaaatcagatcacatatcacaatcgcataccgtgttgtgacagaaagctatacatatactccctcgtttctaaatatttgacgccgttgacttttttaaatatatttggtcattcgtcttattaaaaaattaagtaattattaatttttttcttatcatttgattcattgttaaatatactttcatgtatacatatagttttacatattacacaaatttttttgaataagacgaacggtcaaatatgtgttaaaaagtcaacggtattaaacatagaaatagaaacagagggagcaagatgtaacgacatgatccatttttggtgatggctttcggcatggtgatcaatttagtcctccgtttatttgagcctattttcttgctagggcttttagtagggagtatattcattaatggtgcacacaagtttccactggtggagaaagcgtttgtagtcccggttcgtaatccccctttagtcccggttttcaaaccgggactaccaatccgggactaaagatcgctatctttagtcccgggtgaaataaccgggactaaagatcgagctgaccttttttttgcatggccctgttgctgcatggtttatatatatatatatatgtatatatatatatatgtatatatatatatatatgtatatatatatatgtatatatatatatgtatgtatatatatatatatgtatgtatgtatatatatatatatgaccaaaatatatatttacattaaagaaaatgtgtacatacatatagaaaaatagacatatattaattacaatccattatgatgtcctagctagctacgatttcgacgtagtagtagtcgttatctcagaagctaaggacctatgaattgtatttccgtcgtagtagaattcacccttgggatcaaggatttgttcgttgatgaatcccatgagttgttcttgaaccgccacgataaattccttgtgtgtgatcaggttatccctcatacgaataaactatatgaatgtatgaaattaattagtaattaaacaacaaatcgatacgtacgcaatgaaattttgaatttatttgtacgtacatcgagctctcttgtggtgatgatttggtctgcaaggcagtggcaatactcgcacacgtagtagccgcacaagttagttccctgcttttgctttgtgcactataaataaatgacaaacgatgagagatctaattaatatacacttgtatgtatttgaattggagattgaatataaatgtagagcatgtgtactcacaggaaaattgaacttctgcctaagtctttctctccatttgtcgcggaccaaatgacggaaccgataccaagccctacatggagtttaaagctatgattcgtagtagcaattaattataacaagattcttaattaacataggaacttatgacagtacctatctataagttcgaaaaccttgtcaaacgtagactcttttttatccattgagtcatatacgttgacggtgcaggcctccaggtcaaagagtaaaaggacccagtggaatctgcaatgtgcgtgggatgcattacatatgaaacacttagcatgttcgtacgggaatgaaatttgttataggaagacactaaaaactctgtgttgtacggcaatagtatgaacgtcttgtaatgctgtgccttcagcagatggacgagattgtcctctgtggcttgcggatactggtcgagcattgcgacgtttactttccgagggtcgatgaatccagtatcaaaaaccccccgccgtcgggccctttgaatctccattctacaacgataaaaggaagtatatattatatatagtctacttatatataaggacctaattaattaaaggaaacgtaataagaaatctaactgaacgatacttacaaaatccagcaactcataatagagacgtcgagggcgtccagctggtatagttcgtagatacccttgaaattgatccagagaatgtcatctccttgcaagaagtccgtgtccctgatcctcgctccgatcatctctctactggtggcgctcatctccatgtatagttgatggaacttgtacatttgtgtgggtagggactacagctgctcaggcttgacaagcggtttaccgagttcgtacatgtatttcacttccgccttttcgattggtgcgcctcgtagcaattgacccgtagttagcccggtgtcattaataaattcttgtattccaaaatcttcaccggtcactaacggctcgatctcttggtttggttgctctccaagctgagggactggtttggactttccagaagatgctttcttaagtgttcgctcatagtccgatagctttatggcctccttggcaggtgcagacatacccctgaagaatttcctggcactcgggtctataggaatcttcttttctggacttcgaggcttcaattgtctcctgacttctgatgccacataagcgtcaagctcctcttgcgtgcaatcgtaccccaggtccttgttttttgcggcgtcaacttttgccttcttcgttgcccttgtgggggcaggcggtggagcttggggggcccttgacttggaaggtgccggacgaggagcttgcggaggagtctgtgtaggagcctgaggaggagtcggtgaaggagcctgaggaggagtcggtgaaggagcctgaggtggagacggtgctggagcatgaggaggagacggtgcaggagcctgaggaggagatggcggagccggaggagatggtgcatgagacgccgcttgtcgcccagggaggatgatgtaccgcttgcgccatagtataatggcgtggcttgtgtctcgtagatgcgtctcaccgtctcctccaaggtaatccaactcgaggtcctcgtatgtgccttccaccaactcaatttcgaccttggagtatcctgctagaatcggcctgcagtggtaagtacctgaagggtccgttggtatggccatgcccgacgccaccttcacgtggtgagaggttatttattagtaatcaacatttataagcagcaacttgcggaatggacaaatctaaaatctataaactacgagcttacctttattgataagttcttgaagggaatatgcagctcacatggtgtccgctgagtgatgtcatcaacggggcaggtggtttcgtcctgggtttgcatagcgtccatgctctgtgatcctacctgccccgttgaggcgcagctgctacgattgcctgaagggctcaccattgcaggtggaatggtcggctggggatcatgggaccgatgtgcggccatgcgttcatcaacctttcttgccacctcctcttgcatgctgagctcgtagctcgataccctgtactcaagatctgcaatcttcgcctcggtatctctcttgctcctcattcgactcctatacgtgtggatgtcctccttgaatccaatcttccaaggaatcacccctttccctcgtgttcgtcctggatgctctagagtctgcagggcgagtgacagct

SEQ ID NO: 11515 - DNA, 596 bp, Oryza sativa
caaagggacatctataggtataaatacaaggccccctagaagaagaggggacacacccaacagactcggacaacatagacgccacaaagccacaagccaatacaagcctacataggccaagacaagctgctagatatcgacatcagagataagcctaggaaaacccgatatggtacctacgggacccaaagagaggaatctagcgctatctctgatctcgctggatgcggatttgaggaggaaggctaccctgttgtcgactacgagtcagatcttcaggccgccacgtcgacaacagttagataggctaccccaaatattgtactggtgtgattatgatgaataagatcaacgaccggcttcggccaacaggatgtagggttattacctgataattcaggggcccgaacctgtataaaaatcctcgtctctatctcttttacctcagtctcacgtatatcttagtaccaacaatcctcatactatgcaaataccagaatcgcgacatcaaacgtcgatagtggcgcgccaggtagggtgattttggtgcttcaggatttcgacgagatgggttcaagagatagattctccgacaa

SEQ ID NO: 11516 - DNA, 740 bp, Oryza sativa
catgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttggtgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgc

SEQ ID NO: 11517 - DNA, 19352 bp, Oryza sativa
cactgagtttgttaagttatacaatatgccatcgtattttgcttaacctctataatatacgtcaccgtccatttagacttcgttagtactgtataattttgttctaatgaccgaaatatccccgggacagaaattccaaaatttggctgaatattctgaaatatcatattataaacaaggcagagaagatattcatctcaaactttggaagttttacaatctgatatttggaatttttcgtcccatggctatttcggtcattatgataaaattatataatactaacagatgctaagtagacaacgatggtatgttatagaagttaaacaaagtgcgatggcatattagaacttgacaaacctagtgacatattatagaataaggacaaaatcaataacacacgatggattctctatatattttaggaaaaattagaaccatgccattataattttgcaaaatctgatatatgtcatcctgacccacatgtcattgactcatgtgggtcctacatgtcattgagataccgatggcatatctcaaattttgaaaaattataatggcatggttccaaattaccctatattttatggttgtttagttcattacctatctactatcgtgcaacatttttataaaaagttaaatcttatgctataagttcatatcatacacattaaattacatacacttataatataattttcaaattatacaatgccatcttcacattttataggagaaatatgaaaaatgatttattatctatttaattatgagaaaaagtattagtccaaattaatgtatatgtagaaaaaaataatatgaaagaattacggaaatacctacaatcgtatatcatgcagtaagaaaaggagaccacaatcgaatcccttattgttgagcaaaattgatggcattaattttatctttttttagctaaatctatctgactataattaatcagcccgtgttagtagaagtctgcatcttcatgcatcaatatatcataactcataactcataagactattagtaatagccaagtacactgacccaacaatacttaatatatcacaagactatcgggtaatggacaactcatctttgattgtatatcacaggagtatcggataacagacaactcatctttaattgtgctaaagaaaaaaaagtaaattatagttcgtactatgtattcttaaatgttttcatattatgtcagcctttaaccattcttttcatttacagaacaactaactttacatttcaatttggaccaacctatttcatccatctccaagtccaatgactctataaccacacactaactctctctttctctccattttattttcccccgatagttggggaaccgctagatccagcaagaaggagcctggatctagcgtctccactcttcatcgggtcgactcctgcctccgtgagtcgctacaatagtatgcatgacaagagggagaggaaaaaaagatggctcatggagtgcaactagagggtgcagttgcgcatgcaaagacagagaggagaaacgatggtggctcataaagaaagagtggtggtggcggtgcgtggagtaatagttagtggttactggtagtatgaagagtttgttgtcgactcaaatcgctaactgagtttgttaatttttagaatgtggaccactagtcattataaagaaatagtcattataaagaaatagctagtcttataaagtagtaaaatattgagatatcataaaggtgagagtactcgtctagagcttttaactttttaccatttttaaaatatggtaattaagaatttactactcacaatctataatacgtggatccttatgtgtatatgacacgagaatgctccttctcggtcgcgcgaggggaggggaaaaaatcggtcgctccacccttcccccatcacgtgcgcaccagcaatctctttgggcccccaccacatgtcccctgtccccacctgccacttgtccacacacacaactctattgcaacaaatcacccacatattttgaaaaccctatattaagggaatttggtttactttttgttccaccaaaaaagtttcacgtagtgtactcataatgtttcactatgtatagatctaatgttgcagtgaactaaaatattccattgcaacaaaaaaacccacatattttggaaaccccctattaagggaatttgatttattctttgttccaccgaaaaatgtttcacctagtgtacttataatgtttcactatatatggatcaaaagttgcagtgaactgaaacattctttcactatttgctgaaacattgtttttatataaggtaaaacaacacccaattgaaacgagtgaaatattttcgatctacttagtaaaacaattccgatatacctggtggaacatcgtgcaacatttaaaaataattcaataataaggtaaattttttttcgtcgaaatatatgcctgtgtggccttgttttgaagatttaattgcagcgaatttaatgatgcaatcggattatgatatggataagtaatttaagagaaaaatcagtttaaaatagtttttcacgtaaagcgtccgatttttctccaaaccgatcagacgcacgatccgtagactcgtccgtccgtatatacatgtgggaccagcggtaaattcttaataattcccaatagtaagagtctgagcgtcttccccttccctttgtggcgtaaaagaaagaaaagaaaatctcccgtctctttgtctcctccgctccttgcgccgccgagacgagtcgcggctgaacaggggaggggcggcgatctccatcggggcgagcagagcaggggagaggattcatggtgagcatccgcatcctctttctgattcatctctctctctcccatcgggactacttttgtctggaatttgcttgcgttcgttcgttcgttcgttaaccctagcttctcttctagatctggaagaagctcttcccttaatttcagagccttaaccttaatacaagtaacagtttgtttattccccgagaagtttgaacccccatgtcccaagttggatccgctcctgtacataatattggcagcttgtggcactcttgaatggaggtcttggaagatactttagtacctgttctattagattggtgtgttataggccctgtgtggaatacaagaattttgctcggttttcacctttaattttccttgtatttccaccttgttttgttagatcgctgttgctcacttgcttgcaatgtaccgttatctgaacatcatatgctttttttctacttgtggacaggtttatcactctagctttgttgatgacaccgggattaccaaagcatgcggctgtcctttgcttccactaaaaactcatataaggggcccagcgccagcattcgatcaaggtatactgacacggtgacaacataaaatacattgtgatatacttccgtggtttcactctgacagaaccatgccaagctgctgatttatgtcgtgctattacagacaaggctgacattgttgatgaagcaattacattcttccgagcaaatgtcttcttcaaaaacttcaatgtgaaaagcccagcagacaagttactgatctatctgacattttacatcaatattgccctgaaaaggctggaaggttgccgaacactggctgttgggacaaaggcaatcattaatctgggtttggagaaagttcctgtgcctggggaaccagggtttcccttccctggtcttttcactctaccccaatctcaggaggaagcaggtatatgacttcatccgccactaccacatttgtgtgcttgtattctcttttactccctccgggttgataatacttgtcgttttggacaagagcacgctttccaaaaaacaactttggccattatttttaattataatatgtataaaggtgttaacaaatatatgattttattaaagtactttttaagactaatctatacatgtagtcaccatattttaaaaatgattcataatcaaagattctaaaatttgacctcacccttgtctaaaacgataagtattatcagtccgaagggagtagtttctcaactgtgtgaaatcattgttgctttttattcctagagaaaagcttgccttatttctcgaatagttagtttttcttcttttcccccaattgtttatccatgctgcttttcttctataccatactatttgtcctggctagggaaaaaacaaaagaatgaagcctattggaaatttagcttttgtgagattacaaggggacctttccaaactacagcaatttatgtcttagatacttttattttggatttaactaaatctgtagtgaactccttatttgatgtcctgtatatatgttttttttttgtcaatttctatggtctaaactataagtctgctctgggtatagaagcaataagttgcttactgactattgacaactgtttttaggaacatccaagttgtaattgcatcagttttttttttacttctagggactaaataaaacagtaactttccatctctcatggaatgtgatctcaattaagcatttctctgttggattcagaactattgaggaattatctgaagcagataagggaggaaacaagtggaaggttgcttaactgcgcatacagagctaatggtactccaaacaaatggtggttggcttttgcaaagaggaaattcatgaacattgtcattctttgaagtataggtattttccgcgacatgtttgagcaattgagcagcttgtaggaatggtaattgcacttgcgtacttatttctgcgaatactttagagaattaaaggaacgacaatgattctacacctcgattgatggagccaaaggttctaatgaaacaatggatagaatgtcaacaatttgtttattgcaatggatgaacacaaggacacctttcagctgttatgttgaatttctatttttcatttttattgtactccgtccgtgcccttaaattgggcatgtatttttcagatgatgtttgaatagcgaatgttccgtgtaggacatttgtacagatttaatcaggtgtaatgagaatgtgaatatatattttcctgatccctcttttttgtatcattcgtgttaatcctttatctgtttttttttcaatatgattataagatatggagaaacctggacgtgcgcttccctgatcttgccaaacgttgggagtaaactgctgcttataaacacctcaagtgtgaattggcatggttaatttcattattcgatgaagcattctttgatacaaggtgcttataaacgatttgaatgcaaagcccattgcatcactgagacctgaggtgatattcaagctctatggcttgtcagtcaccatgtcattcgacacaaaggatatctaatgccaggtgttcatacatagattcagaaaaacaaaatatcattcgacacaaaggatatctaatgccaggtattcatacataggttcagaaaagcattattgaccaccaacgcaacgcccaacagaactgttacattgtgtaaatcctcttcgacaaaaaaaaaagaaaaaagaaaaaaaaaggagagagagagagagagagagagagagagagagagagagagatctcaacctgatcacagagttaaatcccatgacataaggacatcagaagactaaaatgtcgtttttagcgtgtttttaccatctaaaagttccatcatcctggcatgagcaaatccaacgtgttgcttcagcaatcttcatcagagtataataaactggctaattcaacaaccatctccgggtcttcctttctacatgtttgcccagcatagtaaataatatgttggtgttcaaaaacagctaggtttggaaattagcccagttacaagctttccagatagcattgcacaaagattctcaccagtaaatagccagttagttatggttctgcaaataaggcagaaaagggggctttacatgtgacacaaaaaacaggttcagtccatgcatttcttaccatattacatatatgaagatagctggctaaaagtaagacgaagcatgatatggttgaaagcatcaaattacttccacaaacactacacaggataagaagaggaaacctctttattgtttttaaacccagaccaaattttgcagcacacctcagatgaacatgtttccaaacctcccaggcaccttctcaaatgtgtggtcctgagatatttagtattagcatgaaataggtaccgtaatttttgttgggaatccatgctataattttctaaagaatgatgattatataagctaataaaaaggaacttgctcaaaaaccaagtaactaacaagagatattacccattgaatggatgagataatcaatcaaagtatcaaactaacgatgttgcaaagagcatgtatgataaaattgtcaggccatcacagttggtatgtgtcacacaatctcattggttgaatttgatttgaaaagttaaatttgtttgaaatggtaggcttgtagagatatggccaaagatatccacagctttcaatggaagttatctttagtccccagtcctctacaacacatctatctaccaaggattgtacaatggagataactggcaataagaagggctaccactcagcatacagatattagtctaaatcatttggacaaaattccgctgctaaagcaaattcattggttctagcacaaggccaatgctatggcatacagcatgtgatggagttctgtcagatgctatcgcataccttcatgttcaagagccgagcaaagaaaacatatgtgcaaggaataaaacaccatagtgatctgttaagactttaagaacaaaaaggaaaagaagccagtgccagtaggtttgggaattagcaatttatgattttgagtcacatgcagtaaagtacccacatcctaagtgactaagacactggacgaaaattaactcagagtctatgtatagaaacagttgttgaccacgctacaacatgggtatgatgctatttgtctgattttccaaatttaaacttgtcagtttcctatgctgctatgaagtgattattgaatctccaaatccaaagttggtcttgtttataaggatgtagaaataattccagaggtttttgaagatccatggaagaaataccatgcgtgcattctactatatgacccaaaacggcagctacatactcaaagacattggaagatcaaagcagggtttattccaaatatctttgaagatcaaagcagggtttattccaaatagcagtgcagttcacgtctgccagggatagccatagcattgctggcagatcctcctagagccatcagcctccatgccagagaactcatgctgtgattctcacagagcaatatagtacatgctacataagaaaaatattccatttgttatttaccttatgtccacactcttctttggccacaatcttttccttgttttgttttctaacttaccaggcatttatacataattacctatagcagagtcatagacacagacaagatatgcatatatacttctaaatcagcaagtgctatttagacttcatttacctttctaaaaaaatgaaccatataaaaataatgctcactattatcatctgattaaaaaaggtctagcttttttccacatatattattccctttagttctattggtagtgcaagtttgtaaaaataaatatcaataacaacacaaaatgataagttttcaaatcgagtcaatgtacatgcaactaactggtggaccacatgaatcatattctttatcatgtgaaaatgtccatgtatattatgctttgctatatggaacatccttgtggatattcttcctcatttcatgccctttcaaaactctggagaaacctgatacacaacttattctttggagaagtaccaaaagatgtgcggatcaagcagctcttgggcatcgaaaagccgcataacacttacgagatcaaatcgttagtgcaacattgaccggaacatgcttaccaacaaagtcaaagatttcagtttgcacaaccactgaacttctttgtcttagtgttctctccttccagaaggtctcgcatggctttacagttcctaaagaaaagtagcataactgattaataagcagaactgtccataaaacaaccaaatataagttcatcactgtaattatgatcacaaacatcttaaaatatgcttcataagtatgtctagtagtgtttcagtgaagaataacactttgtagaaacatgactcacttttcatcttgggctcttagctaattcattactatcagcatccctcttctgcccatgattgattcatcaaccagaactgttttgacacggctcagagtgctcccttttcatccagtgctagtcacgtagtgccccatatgaacctggctcagttggtatgccagttttaattgggatcactattaatatacagaaccataaaggttttaagtcatgtacacttcacccacctgcatatgtttggagctaattctactcttgaaggtgtaagcatacatttaaagcagatggagaaggcagtgcaaagattttaaattaacttgctgtattctgaactgctgggttacaatttcctattgtacttgtatgacaaaaatggcactttaatttgtactctgactcatttcaaatctaaggtttgtttttccaaacacatcctaggtggcataaacaaaatataaagtggaaaacgtccataaaacgaataaaacacacacacacacacacacacacacacagagagagagagagagagagagagagagagatttcttagattttgaatcattgctcatggccaaaccacatcaaagattgattgtaaagtttggaccttcggtggtggggtgtgtgggtgtgtgtgtgtgggtgtgggtgtgtgttggggctatggggggatgtggaaaaaatgagccaatttttaatacacctaacaacggtatgatgtttttactactgttgaaaatacaagttatatttatgttccatttcataactaacaagttctctttcatgtcactgcttgataatatcataataacattgtttcagatttcggcagtgatttgatctgatcaaaaccatatggcgagctcctcaggctgcatgtacaaagtattactttataaaagttgtcctttgctgtgaaagaatcagatgcagtaacggattcttcatatacagcttcaagagcacccagggggaagatccataagaatgtcccagaacagagcataatatcaggctatcagcaggatccacgaaatggaaaagaatatgatccagacatggcccatcgaattcaagctcatgttcaagactggttcccttttgtattagcaacagaaaccagaagggtacgggggtcagtcagttataagatgcaaacgcaaaagtgacagtttattagctgctcaagcattgtcagcttaggtagcatattccaaggcatatccagattttactcagtgatctttgtgctatatatacctgagttcaacaattaaaatacagagcaaggaaaatattggaagcaaagaatgacgagaggagcagtaatgggcagattgaataaattgtcagggtgagaatcacagtgcagttctcctctggcatggagggcaagaggagctgaatagctaatggatgataaactgctagcctttccctgccaaaggagagctgccctgccattcagtgaccctgaattcagcatgcgagcttcaagctgtgtgttctgttttcagtagaatgttgtgaagcacactgcatgaggtatgtgatcatgactctgtttttcatattctttgagcatcatccatgggtgaggccataacaacctcctgttttaatagtttatagttcatgaaactaatagttaaagagttaaggccttgagggtgtactacaaatggaaagatctagcaacaactctaagcgacacattcacataacatatccacagttaaagaaggtatcatgagtgtcaaatgacaattaagagaaaaatcactatatttaataataaaaacccaaagaaaagtaacaaaaatacatggatttaataagatatgaagtacctagatagggatgtatccgaggatttgaactggggttgtcagaccaagttggtggcatgcagccttgcaacagcaacggctatattcataaaaaaaaacagaagatgatggtaacaaaggttgttctacttcttcaccacagcatgccaccttgaagagcatcctgtccaccatcgaacctgccactgtttatagttagaactcatttatagttccatagctaacccagtcgctaatccaaatcaagcaccatagatatttggcatgttctaattaaccttcctatccaaacagtgggagcaatcatttgaaaatgtgaaccatccagtttcttgccaatcctatttaagttagacagaaaccctcatatacttaccctcaatattaagagcttcactaatcggattctccattaccacagaaaattagaattttggtacctaaattttccaattaatgaaatcatttgaaaataaaaacttaatagtggtacagcatttagcatgaggtagagcaagatttaagacatggaccaagctgtcacaagcaacagcattgctcagaaaaatgctctagaaaatcaacaaagctatcatgcatcatgatttcctaaaggattgcaattttattacttatagcaatgctactcgaaaatacaagcttcgatctaaattctatatgttagatttaaaataactcagtcttaatatgctacattatgcccgtcccagtgacagtccttatttttcttttaaaaatgtgctattatttagaaaaattctattatttagatctaacatattttaaaataactccgagctgtggccgttcagtggctgcagtgcttatttttcttttttgttataactatatttgttcagctctaatcttgtttaatttagtctaataataggaccttcccctagtatcttagtctaataataaggatccctccctccctccctccccctctctctctctctcttgatttggaggtgaatgattaatgtttatgcatgatactaataattattgttttttgcctgctctgctttttcttcttttcttagcaaaggttctcctgcttgctagctaggtggtaatagtcatggccggggacagagtcaaggccagggggagtataaatgtgcatctgtggttccacctagttctgtgactactgcagctaaactcttctttcatgatgcacgtaagagggtcaaagaacttgattttgggaacctgctcaatataaagctggagaaactgacaagtagagagcttgctgcacggctaacagatcaagctgaaattcaaacaaatcaagaccaaactgaactcaacaacaagcctggagagtcgctatgcatcacggtagaagtagtgcatctaattcttaccatgcggcgtggctctgttcaggagctcacgtcactgcctacaaatgaggcatcaaaagcattcatctcgatatacagtgtgttgaaggtcagggatgacaagttctcaaaagtaaaacccattgggatgctccttttgatgattgacactaaggtacttggtgttgtcatgtgttgtagttaacatttgtttgttcatggaattggcgcaaagtatcaaaggtgttcaaaaagagaaatagaaagagtacactaagtaacatacctaacaactggaaagaaaacattaatgaggaaaatatataatcgatgcagcaaatacgaagtaaatgatacacattgttgaaaaaatgagtttgcaatatttgacactggcacgtaaggaacacagcagaacagaaaattatgaaaatagctttctattttctaatatatagagagaaatgaagatttgtgggacaaccaggtaaaagtctaatttatagagagatgaagatttgtgggccaagcaggtaaaagtctgaaaaataatgatttagatgattgatacataatggcaactaagtggcatagctactatgcaagactgcagtccacataactactatggccattcctatatgcataaatctcattacaaaatgatcatgaaagatctatttgattcctaactaaacatatacttgcacataaagttagggccttgggggagacaaatagcatttgaaaaactagttaactacagcgcgtgaaggcaatgactacctgacatcgtgaaatgacacaatagtaccacaagggacaactaagccaccagaaaagaggtagaaaaaataccacaaaaaatttagtcaagcagttaaagcctaaagatgttatttggctgtcaatacaaaaggggcaagaacaacaaaaagcatctacaaacccaaaatacatggagagtcatccaacttgtttagatgtgtcatataggtcactctactttcaaaatgcacatttgagccatctaactatccacgtgagcacaccttgtacacctagcgtgccacataggattaaaaaaattggctgggtatccgcagccgctgtctcctaggattgcgcctccatctctgtttaagcttgtcgttgctgccacctaggattttgcctccattgctatttacattcatagcttgtcgccgcagccgccgtcaccatgtttgatggcaagcaagataaaggactgagaactagaagaactcatcaaaacaagcataagtgaaatgatttggtttccctaatttcgtgtatctccaagtgctagggttgtgagaaaggaaaaaaaaatacacatgcggttttctgcacatgtccgagagcatttttttcaattataggtggcatgccatgtgtacaaggtatgctcatgtggatagttagatgggcaaatgacttgcttaattcacattagtgacctatatgtgtattttgaaagtgaagtgacctacatgacacacctaaacaagttaggtgaccctccatgcattttactcatatatctagtactacccaccaaagaaatactgttaggcatttgcataagttatttttcatgacagaagtgtaagaactagaatccctggtttattttccaccgtaaatgacaaaagaaatgccgacataaatacattgtcggtggagtctaggagcaatatgccgaataacaggtacagcaaaggaaatacggaaccgaccggcatccaacattctataggattcaaatggtcaatatatccatcagtaaattcagtgtatcaaatgatttcagaacaacctttgtcaactaggtatttgttttatgcatctgaaaaaaaaacagtattagagaatggataaatcataccccgatgattgtcactgagagccttcaacttcatgtccaaagctcccatcatcacaaaccaaaggaagccaggccatacatatacggtctcctgaaatctctcctgaaacagtctctcaagcttcatgttctccaggcaaagtgagaagaattaagtagggggcatggccatcaggggagacctccactgttgccaagtacacataaccagccctaactcacacaactctcatgcccttgtaactgagatatgggtgtcaaagagaatatcttctgtgatgcccatctcgcaattccgttcctgacgactctagggatccagatgaggatgaggaagtctattgcatacacaatgcaaagccctcaatccttagtctccccagccataaaactgcaacccctgtgtcattaattcccatggtaattccaccctggagaattccatggccacggtgttcagcgtcattcaccatcgtaaggccagtaaatcgagccatccactagcacgccagcattgcctcatgttgctgtctccagcaaactcaacccatggatggcgatatggatgatccaattccaatcccatgggtctcggaggacgaaaagaccgcaagcacaaagcctgaattcatccctgtaaaccggaacagcgcggaagctccatgctcttcctgttccagctcgatgccaccgagcaacagcggggatgaagtacacgtcccagatcaaaggggtttaggatggcgagcctcctgtgggttcagcaggaggaggtcgccacgccacggcatgccaaccgtgggaggcgtagtcctccagctcgtggctccacggagggcgacggcggcggcggccgaagtccggggtgccggggaggatggtgaggccgccgtggtcggtgaagagcccgagggggcagggtccgggtgggtggagcaggcggcggaaccccggcgaaaagccgggcggcgcgggagcccacgagctgcaggcgaggaccgcgcggacgagagggcatggagggacgggagggcgaggaggatgtcgtcgttgagggaggcttacggtggtgctggtgctggtgctggggttcggttcggctccacggaggcggcgccgcccattgctcgaatcggaatggattgcgggggtgtgagcgcctgaacgagtggatggacggttgttgggttgtgtacaacggtatccattctctgtattagaaaaaaaagaagaagaaggtcaatcctagtcaaggtttgtaaggaatgtgtttttatggaaactccgttcgtaggactaccttgcatgacgccgttaatttttgtgtttgacgtttgaccattcgtcttatgtaaaaaatttatataattatcatttattttaatgtgacttgattcattaaatgttctttaagcatggcataaatatttttatatttacacaaaaattttgaataaaacaaatggtcaaacgttagtcgaaaagtcaacggtgtcatacattaaaatacggatggagtattgtcgacatttgatgtcgcgattccggtatttgcatagtatggggatcgttggtactaagatatacgcgagactgaggtaaaagagatggagacgatgatttttatacaggttcgggcccctgaattatcaggtaataaccctacatcctattggccgaagccggtcattgatcttattcatcataatcacaccagtacaatatttggggtagcctatctaactgttgtcaacgtggcggtctaaagatctgactcgtagtcgacaacagggtagccttcctcctcaaatctgcatccggcgagatcagagatagcgctagattcctctctttggttcccgtaggtaccatatcgggttttcctaggcttatgtctgatgtcgatatctagcagcttgtcttggcctatgtaggcttgtattggcttgtggctttgtggcgtctatgttgtccgtgtctgttggttgtgtctcctcttctcctagggggccttgtatttatacccataggtgtccccttgtccaagtagaactagggaaaccagtatggatacaatccgagtagtccttgtcgtttccatgtagaactctagtcattcttccttatgcggaactcctcctatatccgaaggttgtttccgtataagacatggtatgtggtgggtcctgccgagatttagtcgactactattaggtatgtggtatccataacactgacagtagcccctgacttcaatgcaaatgaacaaattcatattctcaaccgcagaccctggagtaactgttatcgagttcacgtgaccgttctcggtgagttcagagataacgttagacttcccttatcagcctcgtgcgggcacctatagggtttgtctgagtcaatctccggcgtcaaccaagaaaatacagagcatacgactaagtctcccgtcttgctataatcgagaatttggatggaagtcaagaaattttatctcggcgggtacaccatgtacaccatttcttcattccgtattccttgtcgagatccaccaaccgttctcgagtggtcgagaaggcacagagcttgcgacgaagccttgtcaacatctgttgtactcgccttagtcgatcttagtgtagaaccatagagacatggagttttcaacaatgtcgaatagaatttccttaaatcaatactcagaaaaggatattagatagaaatagcccccgagcaaacgctcaaagggtgacatgttataatgtgcatggaaaactgaaaatgaattaaatttacagaccaatgttttgtgtatgagcgtcttctcttttaccgacttcgatcagtcagtttgttgagtcatacactctccctaacccccagccttttcatcggagaatcgttctcggaggataagtctcttggacccttgacctgccttggttgaaaaagcgctgaccctagcccccagtcgtgaagttggaaaactcaatttccgattacacggcttggttaatacgcacggcgagaactcttacatgaccagatcttacatggccgtttgtctctataggatccgacaaggccttatccgctctgggcgtccctagccaaagttcccttaggtttctcagaggccttgtcaggacggcgtaaagggacatgaggataggtttcaactctaggtgtcgtcgtggtaagggatctctgggtaaaacacttggcgatattgtgtacctgatatcaactttgttggagtagaggtagtgggagaatcgttatacctctggtcgaggaccaggtagtagtcgtaactcgaccacttgaagtagaaatagtgggagaatcgctacaccgctggtcgaggaccaggtagtagtcataacttgaccacttgaagtagaaatagtgggagaatcgctacactgctggttgaggaccaggtagtagtcgtaactcgaccactagaagtaaatgtacgagagatcgctacgattgactggttgagaaccagtgagtaggtgtctctcgaccatttggagttgtgatacgaggaccgctacgttgccggttgaagaccagtcgtagatgttcctcaaccatctgaagtcatctgaattcgtggtgcgaggaccgctacgctattaccgtagttgtacctcgaccatctaaagttaaagcgcgagagattgctacaatttactggttcaaaaagcagcgagtagaattatctctcgaacgccaacggaggttgtagtgcgagagattgctacggtttactggttcgagaaccagcgagcgagtagaattatctctcgaacaccaatggtagttgcggtgtgagagattgctacggtttactggttcgagaaccagcgagcgagtagaattatctctcgaacaccaatggaagttgcggtgcgagagattgctactgtttactggttcgagaaccagtgagcgagtaaaattatctctcgaacaccaatgggagttgcggtgcgagagattgctacggtttactggttcgagaaccagcgagcgagtagaattatctctcgaacaccaatggaggcgctagagttggtttattacatgtgcatctcatgtgggcagcatgactcacatacccaactcgtagcatatccggatgtccgcctgcgatcatttcgggtgatcaagccgacatcgtttgcgagcaattatccgttaacaacccttttctcaaatagcctagccaaagccggcgctatgagataggtcgtcggtcttcgttggtaggttgggtgcgacagctctgcatttgccgagaacgttctcgataatgtatgtgcttgaccacaacctactcgagtgctcacttattcctgaaaaatattttctagaaggcaagatatatagcagagaatatcgagtatatactcaaaaaactgcatggatcttctagtattatcagaatataacgagcagatgtaaacatcatgcattatgtaaaccataaagaagcatgatttatacagaagaaaatagagcgagcccccagcgttagactgtagtcagcctaacaccggaaacactcgcataatagatattgtataaaagacatgctctaggtaaacataataaattatagatctgacaatactgtatgatctgaataggtatgataaattacatataaaatattgcgtacctttgtagatacatgccggatgtatctatgaaattagtagattaatttaaaaaaccaatctaccaattaacttgtcgcgtactcgttcgacatcatatgatctgacgtcttttggtacgccgcttatcttgaggcctggtcgatctcgagagatcaagttgttgatgatgatggttccgatctcgtcgggagacatactccggtcgggttggatctccccacagcgaagtcgtcgagtagcttgttgtcggagaatctatctcttgaacccatctcgtcgaaatcctgaagcaccaaaatcaccctacctggcgcgccactatcgacgtttgatgtcgcgattctggtatttgcatagtatgaggattgttggtactaagatatacgtgagactgaggtaaaagagatagagacgaggatttttatacaggttcgggcccctgaattatcaggtaataaccctacatcctgttggccgaagccggtcgttgatcttattcatcataatcacaccagtacaatatttggggtagcctatctaactgttgtcgacgtggcggcctgaagatctgactcgtagtcgacaacagggtagccttcctcctcaaatctgcatccagcgagatcagagatagcgctagattcctctctttggttcccgtaggtaccatatcgggttttcctaggcttatgtctgatgtcgatatctagcagcttgtcttggcctatgtaggcttgtattggcttgtggctttgtggcgtctatgttgtccgtgtctgttggttgtgtcccctcttcttctagggggccttgtatttatacccatagatgtccccttgtccaagtagaactagggaaaccagtatggatacaatccgagtagtccttgtcatttccatgtagaactctagtcattcttccttatgcggaactcctcctatatccgaaggttgtttccgtataagacatggtatgtggtgggtcctgccgagatttagtcgactactattaggtatgtggtattcataaccctgacaagtataatataagagattttgattttttttacttgcactatttgatcattcgtcttattcaaaaatttttggaattattatttattttatttgtgacttactccctccgtcccataatataagggattttaa

SEQ ID NO: 11518 - DNA, 24886 bp, Oryza sativa
  unsure (1)..(24886): unsure at all n locations
gcaaaaactcaaaatcccttatattgtgggacggagggagtactttattatccaaagtactttaagcacaacttttcgttttttatatttgcataaatttttttaataagatgagtagtcaaacagtacaagtaaaaagtcaaaatcccttatattataggacggagagagtacaataaatacagttataaagacatactatatacattgtagagatattttttatgatattaattgctaacgtagttcttagctatatgggttgcccatctctatatcttctattataaaatttgaaaatgttttcaccaaaattttgatatatcatccgtgtttgaattggttttaatttgatgtttctgttaaattctttctttttttttttcttacgccagagtgtccctctaatccgagaagcgcgataattaattgggcccacaccttttcacatgtcccttgcgcgctgcctcaattgggcccacaacgccctcactcgcgcgattttccgcatgcctgattaggcccacgacgccctcgcacgcgcggtttgcccttgccacatgtccaatcgcgtctcccttgtccacgatttaaaaattaaaaattgaagacgacaaatcgagcttatgcttattcctaaaggcaaattttaaattttagaacttaattttaaattcaactttttggttttttttatcgtaccttattttatatcatttgcttttgagtcgcttagaacatgtttagtcgtcaacacatatatataaaagatttgcatataaatagtcttttatttggtaataagtgtctcggataagcacatgaataaacaaaacaatacgcgatgattatttatccactgacacatatgtacaatttaaattggctcctcccgttgcaaagcacatgcatcttttctagtaagaaaataaaatataatgacttttgagttaattgtgtacaaatgaatatataaaatataaaacggttggtgtgctagggatccgttgaagtagccgttgtctactgggtgctggctctccatgcggcctgttattagctcttgattttatcaggaactggatttatccaacaaaaaaatcatagaccttctaaatcaagactctccaaaccatgtataaatgcctagccacaatctcctccccaaccattccccaataaattttcccaatctcagtttacccaacttcaacccacattttttacacaatttctatccatttggttccccagtcaactatacaccatatggtcattctccttcaagctttcaagctactccatatcaatgaaattgggcacaatctaatctagccagcttacaaggttttcatttgcaagaaaatatggtgcactcaccaaatcaggccacattttgtttagaccactctctttgttgggggttatatggcccagttctttttctcaacttcaaacttcaactttctcatttttcgttaacatgttctaaaactgttaaatgatatgtttttggcaaaaatagtttatgtagaagttgtttacaaaatcaaataaatccaattttatttttagatagttaatagttaattaatcatgtgctaataagttttcttgtttcgcatgctctaaaagtatgagagaaagaacagagcgtaagttagtttatgagtctaaaatatctaaacctaaacaaatagtagtaagtagcttttccatttgacttttttaaatccataagccactcttgttgtattaagtaaaagttatgtttaacttttttaaatccataagttatccttaccgtattaagccaaaagttagttaggtttgagattttttttttgcttatttaaggtaaaggtatagctttacacttaaatttagagcttaaaattcaccgacttataaattatattagctaaaaagctatctttaaattctaaactaagctttgaaaaggccaaagcttcaatttttctcctgaggtggaggagacgagaaagaggaggcactcatgcagtgcagcgaggcaatccatacacactctaagataaaggagatagaaaaaaaatggtaaatcaaacaaaataatattattagtgttagtacatcatatattgtacatgttattttttttgataagtagcatatggataagattaatgatggcaatcatcataaaactaaaattcgctctaagagaaagctgacctggtctatatagatagctagaagtgcttatatatttcataatagagagagtatcattgtatttaaattgcactagttctaagaaattggcacatcagtatgtttgatataatagttttaagagtaaagtgcatggtcggtcccaaaacttgtgcagttgtgttatttagatttctaaactctcaaaatacaatttttttataacttgtcaaattgtgtcattttggtcctaaattgccacagctcatccaagctagatcctatgcgacgttgatgtggcatatcacataggcgttgacatagcatatcacctgtcaatttgttgtaccgtctgtgtaatttactctaaaaagaaaaaaggaggacttttttagtgggcttcaatgggtcggtccgtgtaaaattggtgaatatgccacatcagcgtgtatgtggcatgccacgtcagcactatataggatctcagagggaccgtggtaattggagatcagaaaatacactttgacaagttttagaacctgaatatatattttgaaagtttagagacttatatgcataaccgtacaagttcaaggatcgaatgtgtactttactctagttttaaaattgagcatgcccatctgataattcggcaggatgtattaaagtatgacaacttaagtatgtcgatgcgacgacgtagatatgcaaaagtgctttcccggtcaaagaagaaggaggtgccatgcgtgactttttttttaaaaaaaaaaaacgcatcatcagggcacattgataaaggaatcacctcagccgcttggaactttcatgcaattttgttgcaaaattatgtgaatttgatattttcctcttttttaaaatataaaaataggaatgtggaccatttatttgcaagaggtatacatttactatttaacaaagacatacatggaatgaaagattttaaaaaaatactaaaagtttcaaaacacttacatttatgaaaaggaaaatgagaccaaaagaacacgcatttggaatgagtcgagaggatgcaaggattattttggatgggcacaagaatttaaaaagggaatgaaaataagagaaagaagatagaatgcaccatatgccaccatctatcttcaatttgcaccaacccaacaccactcttcctccctggttttctccagtcattttcctcggcaaaagtagtgccacactgcatgctttgttatgcaaatcaacaatcaggcaaaaagtatagcagtagcaatttgagttgagaaaagctagagatgagcctccatatatatataattcaactttcagcacgttgggacactagaggattttctgaatggcagggcaattctcctttggcacggcagtgcgtctcttttttaggcctctcatgccatgccagaggagaatcgcactgtgattctcaccctcatcagtcatcacacagtcactaacacaggcagagcgccagagcatgcatgtatcactttctgcaactaattgtgttcatgctctttgacgccattgttgcattggctgctagctgcttctttctttctttctttctttctttctttctttctttctttctttcatcttcgccttgagttggtactagcttggggagaactctgaaattccagctacctatatatatcctggcatggcaaggaaatcagagaggatgatcaagaaggccaggtttctggatatgccatgatatatgctaccaccaatcaggatcattcttggcctcttgggaagctcctctctctctctctctctctctctctctctctgagcttgcaattgcacaagcatggaaagcaggaaaggtcatgcaaaaaggggacggtgctttccaatattcttcgtttctttcctccaaaaacttttgttgaattgcaactgttagaagttagtagatcttaataagcttggattggaccgttgatcacctgatcggcttacctgaatgtgtgagagggtcttcatcaattaataaattctgctagttgagcctagcaattccatcatgtggtgattcgcatctcatctttgtcgatggaatatggaattggcgacagattgcggcgctgtgccttgtcgctggacattctcaaggatcttcttcttctcctcctgctgctgtgttcagagagctgaatgaattacgggggcgtctgttcatctggtgaagagctactggtactggggcttcgaaaggccgatttaacagcagtgcagccaaataaccttttgagatcatggatgctctcagagtctcagtcgtttttgcttacatgtaattcatgtggtttgttttttctgaaatttagttggccctttcaactgtttttacacagccatgtctctctctagctaacagctatcatgggcattgataagcaactctttctggctatgcacctatacttaaacaattgatttcagtaattgaaagagaaaatataaccattgacaaacatcctattccaagaaatacaatcaatgaacacaattttaagcaatttgtcccagaaatttaagatacacacatcaactcactagcactcatgatcatcaatacaatatatatttatcttctcagtacaacatatattatttagagataattgcacaaccgtttattttaataaaaagaacacgatgacaaatcaaagttagtttgttgctaacgaacagcaacacatctatctatctatctatctatctatcttctattatatactaaaagtccattaaactttctacaaacgctctcaatccgccacgtgtcactcctacaaacactcctagaccgccacatggcactatataatctcaccgtcgattttcacttaaattggtggacccgatattttagaccattggattagatctattatttaagaaagtaatcccttcctctgctgtgggccaaaaaaaaggaaaaaaaacgtacgtacgtacgtgtggcttaaacttcctacatacgctttcaatctgccacgtgtcactcctacaaacactcctaaaccgccacataccactgtataatctcaccgtcgatttttagttaaattggtggacccaataaagtaatcccttcctctgctgtgggccagaaaaagaaaaaaaaacatacgtacgtacgtgtggcttcgtataaccgtgggccggaaaaagaaaaaacataagaacttagtacgctctccctgtctcttcctcttcctattcttttatatctccatctctttctcttcctaattcttttatgttatcaaattaaaaacgagttaagttgaccatttaaaataatttaaatgtacatagctaatttatattctattaaaacgttgctctatttataattaaattgacaattttacatccaatgttttgctatatataagcaatatgttattgtggtatagactgtgcattttgcaagtttgcatgccatctaaataaattaaatacttattaacaacatatattatatatctatctatctatctattattatatactaaaagtccattaaacttcctataaaccctcttaagttgccacgtgagactcctataaacactcataagccatcacgtggcactctaataaattagaaaaaaatatataacttgaactggtgggccaattggatttatctcataaaaaaaattcttcctcaactactacagtacgttctcatctccttcccctcaatcccttctcctcatctctttccttttttctgtatggtagttaagatttttgttttattacttaataattaatttcttcacttctatctaacgagaatggatgtggactcttgattgcatgtcccatgcctaaatatataaatgattaatgatttgatgcatgcttttataaataacaaatctatttttaactaacaatttagaaaaaagataatagttacatagcaaaataatcataattttaaaaagttactccctctatatcatattataagccattttaacttttttcttaattaaatttctttagatttgaccaaatatataaaaaaaattaacaacatctatcacacaaaattgttttgttagatataacgttccatatatatccataatatgttttttttgaaaattttactatattttctataaacttggtcaaacttaaaaattgacttaaaaaagtcaaaatgacttataatataaaacggatgtagtatatctgtttttatttagtttgtttgaacggttgtttcataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttagaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaacttttcattcctcttacgttcctatttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacgaccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtcacaccaccgttcatgggcgtctacgacttcaccgccggcctgcctccgtcgccgccgactggtgcttctgcctacacggctggcctattatgccactgctgttgggcgtctacgacttcaccgccggcctgcctccgtcgccgccgactggtgtttctgcctacacagctggcccattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccatcgccgccgactgatgcctccgcctacacggctggcctattatgccaccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcatcgccggcctgcctccgtcgccgcggactggtgcctccgcctacacggctggcctattatgccgccgttgttggatgtctacgtcctcaccgttggctcaccttcgttgccatcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaagatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgactggcttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcatcgccggtcgtctcgtctgctgctgactagtgcccttacctctacatcttcatcttccgtcgccgactgattatgctgccgccgattggtgcttttatcttcacaactacgcgtcttcactaccggtttgcttctgttgccgccgacttgtgttcacttcattacggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgccgttgatgggaaacttcgtcatcatagtcggctatctctgttgccgccaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattacttgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgttgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgtcatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatacacctgactttatttttcagccctccacagtcttcgtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagatatataggcagcatcgcatcctgagatcgcaagtggcaattcctctttggtgcgaaagaacaatggcatcgcattctgcaaaactgttcacagcacaaatggcagcctacctttctctctctatctatgtgctgtctggactgcaaaatatttttacaaagaaaaaatcagacaagaagagaacaaacgctgggcatcgcatgcagcagcggcctctcgtcgcgtaacacagggtccacgtaggctgtccaggaaagacgcgagatctatctccaaaatcggaataaagctaactcggattcttggcatttcaccctctcttttcttttcccttttttttcttccatggcaatatggcatcgccgcatcggccgtcaaatatcaatacgacgaaaggggaaagggctctcgaattcagctggagaagcagcaaagcattgtgctgccggatatgccgtttccggcagcaaataaatgctgccaccgccgtcgccccttcgctcatcatcacaccaacacgatctcgagcaatcacaatatgtacaatatgtaatactacttgctactactatctgaggcattctgatgaggaaaatggttgagatcgagcctgtggatgtgcattgcagggcaactactccattggcagagggatggattggatatggatatggctgatgcttccatttgatcccatccctatctgccaaaggagatttgcccagcgattcactcctacttgctcatgttttttttttctatgtgggaaccgtgtaagagaaagaatatttaggctctacattatgatttaaaggcaggggctgacccagccttggtcaaggcctaggctagcccattgcactttgggttaagattgaacttacatgatggaattttgtactacgtagtgagatttcaatccaaatcctaggcattgacccgtggcctgggtctgcccctgtccaaaagtatgcatatgcacatgaaagcatcgaggtgatctcaattatatggaatatatatgcacgtacatgcatcactgcacatgcacatacctacgagtacatccttttaacatacaactggagagatgaaagcctgttgatacatccacaatctcagttaagtatccacacatgcataattatgaacatcagaatttagaccttgtgagtgaagtcatgcaccacatctaaggtttttctccattgtaatgattttctagtctggtttctagaatgaaatgccgttataactagcggcggcaatgcgagaaaatctaaaatttatcttgcgactagttaagctaatatgattgaaatgtactcgagctacaataattacaactagcggatattttcgtgtaattttttcgtagagcaagatttcaaaaagttgagttgtattttgagatacaactcttaggtccctcaaatatttggattgcaatcaaaatctataataatataatttgattttgattttgagattattctttgttggtcatatctctttttatgattgctcatacaaataaaattacgagtaaattttataaaactacagtactttgatcgaagtattataaaagtacagatttaaggcgtcgtattataaaactacatatttaacacaaaatttatcacaaaactatagatttaatactagagtatcacaaaactacatattttacagcttaaattcctaccactactgctatgttagagtgataaatgtgtagttttgtacttaacatgatgcaaaacatgaactgttgtgataattttattactaaatttatagtttggtgatcttccaccttaaatatgtagttctttgatgaattcggtcctaaatctgtagttttgtgatacacctttttaaatctatagttttataatagtttgtcaaagtatatgtagttttttgaaatttactcaaaaataccgaataaaatgttcttaccattagaacatttaaaatcccaaaaataatccaaaactcatcaagcgggcacatttgtacgtggtagaatttgggcttttggcccattttgtggttgcatcgaagcattgggccattcttttcgctgtcgttcaaaaggccacttaccacaattgggcccatccagaaacctcttggtcgcagccaccgcctagggttgcgctctctcttttatcccagcgccgccacgccaccttccctcctccctcctcgccgccgacgaactcccggccatctccgccatggtcgcctcctccctccctccttcccgactcatcgctgttcatctcctcaacctaacacccctcttccgcgtgcgtgtggtgagttgtggtgcaggcgtcggagaagaagcagtcgaacccgatgcgggagatcaaggtgcagaagctcgtcctcaacatctccgtcggcgagagcggcgaccgcctaacccgcgcctccaaggtcaccaacccccctccccccaaaattctcccaaccctcctctcgccaacctccatttcaacccccctctctctccggtttcttgcaggtgctggagcagctcagcgggcagaccccggtgttctccaagggtaggttaagctctccgccattgccgtctctctactctagtttactcttagcttcgttgtggtgatgacgagagtttgcggggggcgctttctttgcagcgaggtacaccgtgcggtcgttcggaatcaggcgtaacgagaagatcgcgtgctacgtgacggtgagaggggagaaggcgatgcagctgctggagagcgggctcaaggtcaaggagtacgagctgctcaggaggaacttcagtgacaccggatgcttcggcttcggtatccaggagcacattgatcttggcatcaagtaaaggccccgttactctttctcggatgaaacatttcgcttttcgtatctgcctgtttatgttagtcctgtgcctagaagattttaaagcattcattgtctccattcccttttgtgacctaggatagcgcttccaatatttgcttgaaattgcctcattcaatagatttgttttggattgatgtttacaagtgatagaattttattagttgtaagttgctaaacctgaagatggtttttttaagtgttctcgggtcattgacaattcatttggtacctaggaattgttagcatactgctaatgctatagatgtttatttgattgaggcataaacattgatgcttttgtttaagtggtgttgtgatttctaaagagcattgagctcgattttgaagcagaccatggactagatcttttataatctggtccatttgaaaacttactttataaatagaccttgacaaaacttataaaataattggacctgaatctcggctccaagatcattagcaccaatattcatggtctatttagattgtgcaattacctttgcttggcctagcaagctcaagctagcccatgaaagctatggcataaaaaagcaaaagtacaatgcttggatgtttagcccgacaaattgccatcggatgctaaccgatttggctttttgtcttgggtgagcttttctcggtagttagttggccttactaagcaatactttttttttcttttgctaatactaagcaactctccttgctaggctaggctatgcttttccttgcttgggattcaaacatcctcaatatcttgtcaccaaagatcctagcattgataccatggcacaagtggcacaaaatccacattactagatggtccgcgccaataactttggttctgggctcatatgtttctaacatattaacacacccatccacataatggtacatgaatggtgtagtggtaagatgtctaaacttgccacctagttgagttcgatccttggccagtgcaatttttttagtgatgtcattaaacaattggtatattaatcaacttattatagaatatagctcattatcaactgtcatatgagctcacatatgcattaccaggaatgcgtaacacaacatggcacaatattgatgcacaaaaattgtatctaaaatattttgttggcgatgagctcatatgagattaagaatttaatgggctatcatctataataagttgacgagtgcttaaagtggttaaatgaactcttacgttcctggaaatcatgtgatcaaatcttcatgatgggtgttttttcctgtctagtcttcttttgctggtccattcaaggtgtgcatgccacttaaaaaaaggaaaacaaaaaagattcccacccaatgttcgaactaagcttgctaggaggcaagagcaggcatctcatcaccacaccacacatgtataattgttctaatggtgtgttaatattttaagaagtatataagcccaatgcctgatggaataagccttttgttgttctgttttgtttttagcatcttaggacaacatcctttcagttttgcttttagcatcttaggacagcatcctagcgatcctaggacaacattctttcagttttgcttttagcatcttaggacatcatcctttcagtgcccgtcgatcctcgtcgtagtcgacgtcgccgtaccgaactgcctcccacatgtgccgcacctggagcctcaccctcatgaccgcagctcactcgatgtagttggtcttggtgaaggcaggccaaccaccgccggggctgacttccctgatgacggcctgaatcccgtggtgtccacggtaccggtccggggagggagagacgagccgcctgcaacggccgcgatctccgtcgaccaagccgttgccgccgggagcaccgccgtcatgcgcacccctgccaaggggtccgccaatgcgtccaagcccgtctgggctaccgctgccgcgcgcgctcctgccaggaacgccgccgacgcatccacgcccggctgggctgctgctacggcgcgtgtggggttgcgcggctgcccgttgctccacccgctcacgagctgcctccctcgtcagctcatcagcagggatgtcgtaggcggagacagagctgctggagctattgtcgcgcagagccttgagctctgccgccgccgcttgcgctgcatccgccgctgcttccacttccacccttgccgccaccaattccgccgcaggcagccttgacgccctcgctgccatcgcagcagtctctgctgccgcttgctggcgttcctcggccgcggcgagctcggcctcctgccggagccgcgcgctcgaggcgaccgagcgctaagactgtcctgcgggcatggcatgctattgggggcctgcagtgtgggggaagagtttgcctctgacgagctgctgctcgtcagtgcaggggaagagggatgagcaggaatagccgatgttccagctgccggttgaggacagaggggagctcgtgaaggggatgagcaagagatgtctagactacaggatagagtggctctagtaccaagtcatactatccgggggaggttggatacatatttatagccatagcttgctagctgcgggctagtctaaaggtgaaaggaaaacataaagcataaaagggatgctgtcctaagatgctaaagagcaaaaccgaaaggatgttgtcctaagatgctaaaagtaaaactgaaaggatgctgtcctaagatgctaaaagcaaaacagaacgacaaagaccaaaaaccaacaaggctactaagagcacaaggcttattccatcaatgccaaggttcctggagctgaccatctagtgacgtggatggttcctggagctgaccatctagtgacgtggattgcttacaacgtgtgacaaggtcttggcgccatcatctttgagataatccaagaaatgctattgacaagcgtccaaatccaaaaaatgccattagcaagtgtgagttccaagaaataccatcgtacaaacgattttgtcccaaaatgccatcgccgttagggttctgtctattttgcactgttaagtacactgttcatcctatagcacttaatgtcgcggagttaagtacattgttcatcttatagcacttaatgtcgcggaatggacggaaccctaacgacgataacggcgatggcatttttggacaaagtcgtcgtatatagtgtattgaaattcttcattgaatacccataaaaaatctttagcgaagaattcccttagaccgtagcgcaaaaactgaaattaaatccaactccagaatatctttgatacgaaaggtgttaaaaagaaaacactaaagagacaagcaatcatacaccttcacttgttttgaatttaaactcttaaaagccctgaaggctatctctcataaagaagtacacatccatgggcagaagggacactaaagagattttaagggactactccaaggggctctaaagggacactactttccctaacatccacccctctatttatagtcgaagatgacggaaatcccactacgaaaatgttcaaattgccctctgggtgaaaccctagctcagatgaaatctaggccatccgttgttccttctcaaaggaaataactcggatgtcctccatgttgttgcccgctccagatcccattttccacataaaatatgcatcgaaccactcctcccgcgcaccttgctagctaggcccacctaccagtgagatgagctgaaggctgaagcttctccggcacgagcaatctacggtggggcctgctatccgcgcgtatgctccttggccaatcaccacacgtacttggtcgtcgttgatccacgtctttgccgctcgccgaatacccgttcaccacgcgtctctgggaggcgcgctccacctatgcgaccttatgcgcttgtgcggcgagtatgagacaaccgcatgtcccgtacggctttcgcctccatgccctcgctgcgtcttgcatctagccaggcctcatctgcaactatcgtcttggaccatcacctggaccagcatggttcggcctccctgccaacaaggctgctagccggacgccttaccgcctccgtcttgggtcaacaagcaagagcctaattggcttgacctcctccaagccaagtcgatcagactcatgcacaagtgcatggcattgggccacgtgcacatatgcgcaacccaatcacttgcttgcatgagtacagtacacatacgctgtccaagtgcatgtatcgtctagcattgtacattactcttcgcgaatctcagacacttgcacacttgaccttgtgaatctcgttgcgaagtactactgacacggtgttcgttcatcgggcaccgccttgtactcaaccgtgtcaactggcatcctttactcttctggacctcaactcttccatgagtttagtcccgatctgccgttgacctagagagacctccaaggatcctgacgtcagtcccaccttgtcacatggcctcttgactgcgtcggacctccgttcctccctgagcatagtcccggtcctcgccattgaccaaggttgacttcgatcacctgcacacacacgtaaacaaaacgcccgttgttcgggcatagatatcacaaccttactcgtgttagtcagcacacatttcttgcacttccgacactcgccaattttccatcacaataaatcaaaaccacaatttgtttcacaatctcccccttgatggaaacattggcaacttcaagcaaaattttgaaaatttgattttgctccacaaagcaaataatattgcaagtcaaacttggttatttgaagagattgaaaaatcaagaccaagtgacagataaggatgcaaatgcaagcaagtgcgtgcggtgattggccgaggaggcgttcgcgcgaatcacgggttcaccctggagtgcgtgcgcatgagaagcttcggctcgtttggacatctgagatatttcctttgaggagaaggaacaacggatggcctagatttcatctgagctatgggttttgccccaagggcaattttgacattatcttagggggatttcatccatcttgggctataaatagagaggtggatgttagggtgagtaggctccctttggagccctttggagtagtcccttagagtcactttgccggcccatttgcccatgggtgtgtacctctttatgagagatgtccttttgggcttttgaagtttaaattcaaaaccacaagtgaaggtgtatggttgcttgtctttgagtgttttttttgtgacaacagtgcaattaacattgttaagaatccggttcaacattcaaggaccaagcacattgagatacggtaccactttctccgaaaatatgtttagaaatgtaccattgtgttaacgccaaaatttaccaaaatttggtaagattctttagtggatttggttaaggaaagaagtcaagcagccgatgtaattttatctagaagagatcgagtttaggaaggaatcgtgaagaccatggcataacagtttaattctatctaataattaggtagtttttagtaattttccttaagttttgtctagtgtctgatcaagacttctatctttctttttatctttaggaaacttgtaacgtgtccgattaggactcgtatcagcccgagggtataaatatgtacacttggggtcattgccatttatctctggatcaatattggcgcataacaccctcttttccgaggtttttgttacctgcagaacttggcacctaacgcggggctgcatgtctttgatcttcggtgaaggggtaacccctaagttctgccggccctggtagttgtattggttatattggtgttgttcaaggctccatcgctttgacctcttggattgctctggttcggttggtatattttacctacctgatatttgaattgtatttttaattgcattgtgtttagagacgcatcaatttagttaggactatcttggttaggtctgatcttgtcttagccgacatatctctacaatcacaatgctattttaaatagatttgttatatccatcgcattagaaagttttatcgactcattgagatcagattattaaacgcaatctcgtgctgcatcggttaggtccgacctcaattgttattaataatcaaagtcttgttaagccgataggttcgtgctaatgtttcatcggggggtttatttgatgtgttaaatttctctttgatgattttactgtcttagtcaaatttaatacatgatcactttgattggtgtcatattggcttgcttaaatctatcaggtaattatcaaccttatgctacatccagttgtgttcgccctgtagggttgtggttgtaagttagatttatttaagttagtaaacatgaatcaatgtttcattggggtttcagtcgataagttatttaaatgttgcatcggcttataaggattatatacaagttggttttagccaattgcagcaaggttttattgattgcctaatcttttggatttaaattctaatgacatcagattcccagccgatgtatgctttaaccatcagattaatatttattctatcatatcattgttggctaattggtttattggatatttatttcattatattatcatcagtcgattgtctttatatcattatttatctaagtgtcagaatctatatcggacatatagccgatgtgttcaaaatcctatcaacatcgtctggtatcgccatatcgccttattggtcgatcgactatgtgatcatcaatttatctatcctgtcagtcgcaatatcaaactgactggcacgcccgcattcgaatccaaatttttggacctgcactgaagctaagcagatctcccggcagctaagcagatctcccggcattgtgtttgtcgacatagttcgcatcaacacagatttggcaccattagctgggcgtggatttttcgtcaacacattgtgctagagtttgttaaatccgagaaacgacatgctgatatttttacaaaacctctctattgagcatgatgtgagttcttgcaaagtgagttaggggtgatccacccctgtggattgcgttgagagggagttcttttcttttgcatgcatttgtaacatttgcatcatgtttactttcttgcattgtattatacatcttttcattaaagagctttgttaacaatttactggacatctttttgatactcatctcttacttttatgcaagctagatcttttgtctaggttacacgtgcttaagtagcttgtatgttcatgctatgctcttcatgcgcattgatacttgcttaaattgaatctacacttgaacttaattaatgtgcacaacttgctctagaagtttgcttttgatgcaatatccttctcatagatatgccatgtttttatcatcttagcaatagctttcggcacatccttttgaatgctcacgcttgattgttcatgggtgcatcaattatgttctttctatgctttatgtgttttaccactgcttttgtcccaggctactgagtgtgtttacgcataagtagtgctgaagatagcactgagactacctgtaacaggagctctaactggaaaacttgtttgagatttgatgacactgtttggcgccctcatcactcgctgactgataagattaggcgtaccatcgcgattgtgctatagttttcttcaaaaatccgaaaaggaataaaatgcaaatgtgatagagctaaaagcccatgttctatgttttattaccatcttgatactctcttgaactgggcattagcatggtatcatgggttcatttttgtttttgataatgttaatcttgcatatttatgcgttggattgcttactcttnnnnnnnnnnnnnnnnnnnnnnnnnnnnnnnnnnnnnnnnnnnnnnnnnnnnnnnnnnnnnnnnnnnnn

SEQ ID NO: 11519 - DNA, 18399 bp, Oryza sativa
aattctctgaattggtcgtacccaatcctccgttggtcgtgtataagccagcagaacaatctctaaccacagcgtgtgcatcaacatcgatactaaataaactgctctgaactaagggcaattaatcacaatatgtacaacggggaaggggaaaagaatcccaaaacgggcggtggccgagcctagctgatcgcatcgtgtgtgtggacggcgaatcagattaagaaatcaaagcaaacttgaggtgaattcttgcagcatggcgtacaatttctcttggtcccaagaaaccaagtaggaggagaagacgagagggaatcttagggaaggtaggtggaggccgcgacgcgctgaagctgggtcccccacgaccaagataatctcgacctccggcaagctcgcgtagacagcttcgagtcgccgccgctgcggccaccgccgccgccgccgcgcccacgaccttgtatcgcccgcgcgtcaatcatagccgtgcctgacagatctgaggccggaagggggcgggccagcggcgctgcaaggggtggaactcgaaggggagagaagggggcaggaaggtagaaggttgtctctcgccgggatccgagggcggcggccgtcgccgttgagggggagagagatatggcgcgtggacgggagaaaggctgaatgggaaaactgctccgggcatgcggaggggcataatggtccttttgaaaataaaaaaaaagtagtgatactttttttaagaaggcactgggttccacacagaaaactaaaaatatatgaattgatataaatcagtttttctgatgaaaaaggaaatactagatagtcctggttgttgataaatttttcgtgtggtcctaaactcctaataatatgttatctaaatttttttggaacattttttttatgattttactagtttatctcattgttacgataaataataggtcatcagggggcaaacaattccacaaaatagtactccctccgtcccataaaaaataaatctattaccgaatttgacatatcctagtactacgaatctaaacatatatctatctatattcaaagtgctagaatgtgtcatattcgattctatattcgttttctatgggacggtgggagtagatccccacaccactcatcctttcttgtcatcatcaccggacgcatgtgatggcaggtgacaaatagcattcgtgttctttgcttgctctcgttgttctgttttcccttttaattattcattttgtcttcatcgatcattgttttgatggatttggcttttcttttaagatctcacattgttgtttgcttttcatttaaagtttcaccattattggttttacttgtgtcgtcagtccatcacttggttttatgcttttttttacttggttattcttatatgcaaattctgtatctctttgttcttcggggctaactctctaatggatatcaaagaaaattgaactgggtgtaatttgatatagcttgactttctatgcttgatgcaagcatcattaacaaacacggccactgaaagttggtttgcgagctgattggagcatggtagaagacctcctcagcataatttgtttctattgcttcatgactctctcctgagtgtatgtcttgtgtaatgcactctggtatgatggtttaaaattgggttggtgagacctcagattcttccttcttccttggatcttctcattttcttttgatagtatatcgttctttggggttttcttatataagagtacattggagatcgctaataagagtggtgactgggcggctctggcatacggagattttaacggctctatgaaaagcaattctttgacataatccagtatagtgttggtgatcttttgtggctatttagttgtagcctccgccgttggcctagtcacctccaaccgctcgtgttttttttttctttttaggtgtttccatgtgtggggctgtgagcactagaaggatcataggatttgttgccagagttggatacacaaccattgtgcgctcacttcgtttggctgaatgagcttaatcgaatcagccatctgatgggcttcggctgaaacgcccctagctcaatcagccatccgatggagtcctattttttttccacataatacaattaaattattgcataaatgattttttttcttagtgttcaaatgatccctccgaattttcatacacctagttaaatttcgagatattacaattttatcacatataagtggtcgacatttgctcattttttgacttgtgtccccattgggtcaggttgtcgtagctatatgatccatgtttggggagcttttgccagctgcactttctccgagaattagaagctctcataaacagtactacatttcattcagattttgagaagctatagttataaaattaaaaaataaactataagcgaaaaccctatttttctagaacaatcagctgtttctcaccgtacaaacgagcagattttgcttaaaatccacgctttcttcaattaataaaaactacgagggtgtcatcgtaaagcaccgccacaaaagccctacccttgaaccctctcccaccccgcctccacatctcctttgccgccgctgccgccgcctcgccatcccgagcgagcatgcggccgccctcctccacctcctcccctcgccgccttcccgtttgctagggctccggccgccttgccgttccttcccctcctcgtcatcactagggtttcgacctcgcgccgcgggggagtttgtagcccgactgacccgaagctgttgccgccgcccgccctcccggccgcgccatggtgaggctcaccgccgacctgatatggaagagcccgcacttcttcaacgccgtcaaggaccgcgagctcgacatccgaggtttgcgcgctctttcctccctgctcgctagatctagggtttagtgttcttggccctcttttttcattccctccgtctcggtagtttaatttgtctgttgtgtttcttttccttggcaggtaacaagatccccatcatcgagaatctgggcgccaccgaggtgagctccaccagcttccgcaagccttttcttcccttagctccattgttgtctcatttgaagtattatgatgggttcttggattggtggtggaacatgctttactcttggatgtagcgtatgggagattagtagatatgggtgtgccctaggtagtgatgcaagaaatgtagtacataatgctactaagttcgtagcgtcaattttgtgttaataaagctgcaattgaagtgttttgcaaaataattttacaaaattcggggcactgcattttgtctgtacatgctgacgataggtatgagagattactaacatatgagtgtgcccttctcttctttttggcattttgttgaggttctgccatggttgttaagttgtaaagtcgggttgagataccgtctactgggtagtagactggtcggagcatagttgaggactagtcgttgagttgactactctatcaggttgttattacatacatagattgcttctacttctagtctgttactagtaacttgctgcgcctgatggacccaatgagctctcaatctccctttcactcagcagggcctgataggccaaggcaccaggcctcccaagcattcgctcaagtctcaactccattgcgtcttctgcggccagcacatggagtcgtgccccctcaagtcgtgttccctcaaagactttaggactaactgtagcaccagtcgtcactttttgtaggacttgataactgtcggctctgcatgtttctattctatggatgtttagaggaaataagtcccacatgagtctggaagaactttttttttcttttgctgatagagctatcttatatgtacaatgtgtccatagaatttctaatcgttagcatgctaacggcatactttttgttgttatgagtgacacatttcttggttttcctttctcatgtcaatcacctatagttagataatcagtatggtcaattttatctttttcgatctctggaatggaataaaactcatattctcagttgagtatgtgttaacaacgctgcgatttgaagtgctttgcataataattttacaaaatttggggcattaaaatttgtctgtacatgctgacgctaggtagcttagcacttctcttctttttggcaattttttgaggttctgcatgtttttcttctatggaagtttagaggaaataagtcccacacattgttttttgctgatagagctgtcttttagtgttttttgctgatagagctgtcttttagttgtacaatgtgcccatgtaatttcaaagcattagtatgttaacggcatactttctgttgttatgaatgacatgtttcttggttttcctttgtcatgtcaatcacttgatagttaaataactagtatggtcattttgatctgatttgatatcccaaaaaatactcattctcatttcagtatttgacccagcttttgttttattatcttctttctccagcatgtttaacacttctttttgttactttgctctcaaataggaccaatttgacacaattgacttgtcagacaatgagattgtcaagcttgagaacttcccgtacttgaatcgtcttggcactctgttagttaacaataacagaatcacacgtatcaatcccaatcttggtggtaagattatatattttatcttgttatgatctgtttatcattttcataattttgctccagaacttaccttcagttgctcctgtttctagagttcttgccaaagttacatacattggtgcttacaaacaatcgtcttacaaatcttgcggagatcgatcccctggcatctcttccaaagcttcagtttcttagcttacttgataatactgtaaccaagcagccagactaccggttgtatgtgatccataaattgaagcatttgcggttgctggatttcaagaaagtgaaacaacaggttagcaatgctgaggttctttttcatgtaaatatgtttttgtatgaaatttgttaatcatttagtcttagttttgttctcttgaagtttctgtaaaaacttctattttgaatggtttatttttatttaaatttctcagtattttcttccatttgatctctaatggtagtttctagcactaaacagtaaacacctttcgtttagctctatgtgcaatggtgcttctgtgaactctctttatatcaatgtttcataagttaatcgcttcttatttttaaatgtttaatggagccataaaatacatattgtgatattttgcatgtattgacataacactcattaaggttgcatgttttatttatgcaagtatgtagcatacgattatttcaaaggagttcaaaattaaacagcattgcaagcctatatagtttatattattgtacatatatttttttcacaaaggcattttgaaatatgtggatctatgcagaaactgcgttgctgcttgattagtttacttattccccacaggttgttcattcatttcctttggaatgactgccaaaatgattttggaatggactgcagaagtgctggcaggaaaaagggcaaaagagcgactctttaactttgtgtcgcaatgaattaaatacatgaatgccttttagtttacgtgttatttttaatattatctagtgtgcatgtatttgtgttaatttctgaagttatgcgtgagatcttttgtttttgtaggagagaattgcagcagcacagaagtttcactcaaaggaggcagaggaagaggcaaagaaggtgccagccaaaacttttactcctggacaggtggtggatgctcaagataccacaatggaggagcagggtccaaaagtagttgctccaacacctgagcaaatcacagctatcaaggtactattgcaagctgtgcaaataactatattatttagctactgcattaaaaaaatgattgtggctatggcttctactggcttgttagtatgctcttgatttttaactttgataattctaaactctaactgtttgtagttagtgtggcatttggcattcctagatatgtgtatggctctctgttgatgtcaatatcttctatgtatggtggtatagtacaactacctgcaaaattcaaggtttaacaattattccatctgcaggctgccattgtgaattctcagacacttgaggaggttgcaaggcttgaaaaggtagcatgtcctttcgtttagctcctgcgctttgtacagtttggaacagctaactatgggctcacatttctttttcactactgtgatgattaggcactgagcactggccaaattcctgctgaatttgcaatccccaagccagatgctaatatggctgatgcttcagaggaaactgaaaagatggagacagatggtcagaaccaagaaaatggggcggatgagaagaagcaaaatgaagaaagcaccccaattgaagaggtaatgataatatttgctgtatagttttgcttttatttcatatgccatcatgatatcaattgcttctccttacaacttttgtattattttcacaggattgaaggcatatgcacacactgatataatctggcaccaagttggtgttagatttccgttttatttgtgggggcaaagccacattgcgatgcctgatctcgttgaatgctctcgctggtctctagcatagtaccggtatttctgtatcttgtgaatgctaacatttttcagaagatggaaaaactatttgctgtgtttaggaaacaagcttggggtattttataccttccagtaccgctagatttcttgatgttgtagactgtagacgctgtttcatgtggggcatgcgagatgttcactcttattttctggaaatttcccccttattgctctctattgggaggctttgagtgagttgtttgaatgcatggcaccatttcaaaaattccccgtagatcgcgaaaagaaaattttttgggtgtcacatcggatgtttgactggatgtcagaaaggtttttcggacatgaatgaaaaaactaatttcataactcgcttaaaatcgcgagatgaatttataaagcctaattaatccgtcattagtacatgtgggttactgtagcatttatagctaatcatggactaattaggctcataagattcgtcttgcaattttcatgaaaactatgcaattaattttttattttatctattttaatgctttatgcatgtgtctaaagattcgatgtgatgtttttgggaaaaaaaataggaactaaacaagtccctatttatccatttgtccattctttcaaaaatctggaatggagatatctgctcagaagttaacatcaactggctacaatgtactacatgtcacgcattacttctcatgatcattacttagaaaggagccaatcttgctatacaaatatgataaggttcttgatggagttgatgtagtcattttaactagagattagtttaatcacgctgcgcctaacttttttctacatcagtttggttggatttgacgtttctcgtaatctcgtcagcattgttgatctgaataacctacctatatatatggatcggaaaagattggggtagggtcacgtacctactggcagttcatctgttcatgtcttcaggaatcaggatgcccagagaatagtagaacatcatattattctcatgaatgccaattgcttttcttgtactttttcctaactaacctaatcaagctcaggcccataaactgaaagtctcagtccatatatagttaattgcataatggcaagggggtttcatttctctggttatcgtgtgctactctccccgtttgaaaatataatgcgttcttgtttttcaaaaagtcaatatatgaaaattttgactagtacgtcacttagcgttaaattcgtttatgaagatattttcatttgatgttacttttataattgttgataatacactatgtcgaagtgtaaggttggagactgtaaaaatctaacaccttatatttttcaaacgaattattacataccgttggatcacgatcggacggtctagaacgcaaccttcttacctcgtggaagcatctcatggctcgtgccaaccgtgaatcgctctagctagaggccgtttttgcatcttatggtccaatgccctatgggtatggtcaccattgcatgggtggacaccgtccatgatcccatccccctgttgcaaaatttgccatcatgcgtacgaaccaatccagattcagatatctcactccatctccatctcatctcatctcatcacagcgatgcatcacatgaagcatatggaaaggaaaggaaaggaagaaagaaagcaaagttccattatagctgatgcctggctaattaaacacaccagcagatcttgtgcctacctgttctgaaaggtactagtaggagttaaccagagtcatcaacttttagttaattaaaattaacaggcatgtgaaaagttggcctagcacaatgcatgcactaatgatgcagccctgcatgcacaacactgaacaccggtaaagagaaaatcctataggagcatgtttctatttgggttaccctcgaaacattagttataaagttaaatgattttagacagtagttacttcatccgtccacaaatataagcctttacgtgaaaattaaggatttaaggttgttgtgaaattgcttgatacgccccaaaacttgatattttgagaaacatcatactcaatgatataatactgtagaaatgtttatatttaaggaaaaattttaaacgctagaaatatttatatttatggatagagatagtatgctacatgcatgttttaaagaaactagcatcctcaaccttcaaagtcaggtgacattaattgtcactaatatattggccccataagagcaagtttaatagtatagccaactactagctccaattcatgtataaccaatctaatagctcattcatacaatagttatatactactctattaatacctggtctcacatgtcatacacacattgcgtcttgaagtccgtgctacagctggctacaaatctgtagcccgctacccttctctccttatttatcttcttaaaatatgtttgcagctagcttatagtctgctattgtacctgctctaaaccttggctcacatgtcaatgattaagtcaccgtggacgtgaatcctaatccgttaaaagtcccctctaaccacaatctccaactgcagaaaaggcagcatgagattctttctgctctctcactcccagccccacaaccacaaaaacacacacacatgcatgttgttcatcttggcagctagcttgccctgcaaccaagcaaacacaacagctcacctgcctcttgcctctctgcttgctgctccctgccattgtccctcacacacacacacaaactacacaccaatctgaatctttttccctcagcatgaatcatcatcatcgtcatcagctatccatatcattccatcagtctcctttgcttccttctcctcatgcattctgtctgccctgaccaggacatgctgccatgtcgacctgccattcttcaccaccatcgctcgtggacctcgtgagcctcccaccttcttctccggcgggcggcggcggcggtggcgccggcgccggcgtggtgcaggtggtgccgctggacgtcagcgaggagctcctgggcaagttccaggacaccagcgagttcggcttcgagtacgagaagagcggcctctggtcgccgctggtggtgcggccggaggccctcgtgctcgccggcggcgggaagcgccggcgccggagctggaggaggaaggtttgtggtttgcactgcactattgtgtcatgtgctcttctcacttgtgcagaaatgtgtttgacaaatttctgcttctgaattcctagcttaattagctaatgacagttcttgtttcttatgatgcaggtgttttgctgctggtgagtgacagtctgacatgcatgaagcatggggagctttgatcattaggcaaaggactcatggatatgattctgcagtttagggagtttttcatgtaattatgggaatattgattggatgtataattgcgtttcacggagtagtaatttcaccttgccttcctctttttaattttggctttgtaacgaggaaacatgtagaaaattagtactcaaatgacttgtgtgtagtagggattgtagtggtgtgttcactgattttcagtttggtagaaaacctgatgctgtgcaaaatatatgaatgcttgtgttttaactgttcatttatttctagtgatatggatgtaccttgttttcatattcatggttcattctctcttttgaggggtttcatcttcctatttcttcatcgtatattttaaattaaaaaaaggaggggtgcgttgcagtaaccaatagaggggcaaactaaaaagagacataaaaagtttgaaaaaaaaaactggaactgtaaacttctcttctctctgtatgacaatgtatttgattttacaaaatggtcgatctagattccaatgacgctatctacagcacacaattcagtgaaaataaaagcaacataatatacagaatctgctacagaaagagctccaatgctccataacctttgagctcttgatcgacatccatatgtcttctgaagatgtatgcatatcttctcatacagatacagcagattaaatataacacaaactccagaggatatactactttacataaaaaaaagaaacaactgttccttcacatacttcacaaagtacttcccatttggtattttggaaaccacatgactgcaaagattaagtgtggcacatatgctcaggtactgcaactattggtggtttatgaatcagacttgcatatttatgtaattctgttcatgttcaagaagcacctatcatgaagttaatttatgaaattcagcgttataatctcatatatcttaagtggttaagacctaaatacaatggagaattaccatgtcaagatttgtcaaagcagttgggcgttctgcatttaacatgttcttcagacctgagcaggtgttccttctagtgcctctttacctgttatgccagctttgagctctttgaaatacacatcatagtctttctctggaggaggatttgaaggatcaaccacgaaaggttcactgaatggaacagtgctcttgacctaacaaaaaaaagtacatgagttagcttaaaatgaaataaaatgccacaatttccttctgaagttttgttgtcccaagtagtgtcttgcaaatgagttgcagaattttaacctcaaaggttttctctactgcatttggacttgccagagctgcaacacaaatgaaagcaatttcttcccttgatatctttccctgaaaaaaaaaatacaggaaacttatatgaaactgatgctttatttgatcttatggaggaagaagaatggcgtggcatcttatgaaggcaacaaacaaatgctgcctctacatactgtgatattatctccctggtcaaatatgaggtcagctccagctggttcctctgttagagcacatggccgcacaatagtatatggaatgccactttcccggattaaatcctcaccctgaaaggacatgcgataagcatttagacatgatgtgaatcaataagcacaaatgcacaataataaaggaaaaatggcgcataccttcaacttgtaagttagaatggagcccagctctttgttcatgcgaacagcaggaggttgtttacttaaatccaggcctggtctctcaggtcttgtaactcctgcagaactaacatggacaaacctgcaagtagaattgtcatttattctagtgagtcttgatgacttccaaacaatcggacgattacagtgctcatttattctgatgatgtcatatagtaaaactagtacaaagaacaaaccttggagtgattggctcgtttatgtatgctctaatacttgaaaaggggagctcaaatgaaccttctgtaaatgttgggttcagctttccgtcatactcaaacttgctaaacatgagctacagaattatcacagcaatttcaggttcagttattcctaaaaaattataccaacacatgaacacattgtacctgtaaggaagtaacattgcttgcatcaaagggtgcagcatcaggcatagtgcgggcacggaatacaggattcagtgaagagaaaggtaatttaacctgttccatcaataagaagcatagctgtaagttgctgaaacaaagggacgtatttttttcaataaatcaacaaatacaacatacactttgccattcccccttagtcgtgtcaaagcttgcaatgtagccgacagtatcccattcaaagctagtgcgcacaataagtttataccgcctcccgtcacccttaacacgtagttcaataccgtcatatgctgacagatcctcaggcactgtaaaattctgcaatcagagtaacatatcacaataatagttagggacatttaactttgtaccacttttaagatgtggcaattaattatttgccactcgctgtttatgacatgtgggtcctcatttgtctatgacatgtgggtccagtggcaaattatttatcaccatctgtaagagtgacaaataattaattattcctaatagttaggacatggaaataaaatataaatcaacacacaaaacggcagcaactttgttttttttttttttgggaaaatacatgtcagtaggtacctttgtccttatactagtgaagccaccgttatttgaagtagagacagtacctagaatacattgcacagacctgcttagactagaggttttccaaagaattgccacatcgcatatacaaggagtcgagggatcattaaaaaaaaacaaaatacctttgaacaatccggttggtccatcagtttcacttcctgttggttggatttggaatgtgctttcactaacacctcccatcacaacatcatcaagtgctccccaaacaatctttccggataagttgcctaaataaaataactaacatgttgtgataaggaaaaaaaacttatatattgaaagacaactaacatacaaatgtatacacatgtagggatggaaaaataaatttatacatgattcagttgcaagcaattcactattttgttgttttgaaaaaaatcactgttatgatcaccataattactaaaaactggatttcccgcagatcttgcaccaaagtttttgggtactatggaggtcccctaatgaatatgagttgagttgagtgtagatttaaatctccgatatttctttcaaaaaacattttggtatggaatgaaagatttacctgtgcccccaaaaagcagtttcccttcagtcagacccacactgttcttgacagcattaatcaagttttgcattccaaggtattctaccatttcaggtgaaggtcccttgatctgataggcataacaaaataatataatgaactagcttttgaacgagcaaaagtgcaaactgatgcaatatttccatgttgtatgttgggaatgaggatgtcagtcatccattgttacttatattctacaagagaaggaatgtattgatgcagctacctcaggttcaaaaaacttgatgccctgcatgaagatgagattaaatgtaagtttgtagggtgtaaagtagagtacgtgaaatattggtaacatatgatagggcatttggcgtacctgtttatacttctgcctgtctggtgtatcgccttcctttggcccaactataactgacactgcatttaccactttcttaatccctttgaagtacttgggatcaagtgaattttcctttgtgacatctcctatgatctgacacaaaatagaaattttaataatataaatattcaatacttccgtctttacaggtgtggaagattcaataaccacataaaccatatgcaaactagcaatgagataggaaggttcattatatgtagtgaatcattgcatatacgtggtcacttcaaacaaaatgtcataaaaaatacacagaaattttcactatcatttaagaacaaaattccctagtttcatttcattcacaactagaaggttagcagaaatgtaacagtgagacttacctcaggcaatcatattgctggaatacattgggtattgggtaagggtaatgcatattggaatacatggggtattgaaatagacctagttggttgaaactaaaccgcacatggaacatgaatctaaatccagctaaacaagtggcttaccaagtctacatcgggccccagcatgctcctcgccttctcttcatttctagcctgaattgaaatttgaaatgttagatcaacattaagagcagcaaagatccaacaaaagagggagaagttggactatccatgtaataatgaatgaaaacagagaagccaaaagtagataagcttgacaagtattgtaccaatactcgaacgggtattcccttattccgcaggatatcaaccactcttcgtccaacgccaccggtagctccagtgaccagcaccacatcagaagattccattttctttggcacctcaccaggagcagagccagtgaaactgctaagaatggactctacaatctacagattgaacagacaaaacatgagcacaatgccaaatgtgaaataactgtaacgagaagaggtgaaaaaaaatcccaatacagtgagtaaaccttgagaggattcggtggcccgttgaagaaatacagcgtcctgacaaatctgccgatatcccaagattgctggcctgcaaaagctatcacctctctccgagacagccgtgacgacgcgcggcgtgctgggctgtatatgatcggagaaaactgccttgaaccgaggaagatcaccctgtggttccttcttgttgagcagctagcagcgaatcccccctgaaagtttaaaataaaaaatgaaaacaaagcataaattcgttgcaaagatttcatggggatttataaatttagctcaactaagcaaatggtgttttgatgcagcaacatccttgaaatgaaaacaaagcataaattcgtagcaaagatttcatggagcatatataaattcagctcgactcagcaaatggattcagctcgacgcctcgactcagcaaatggtgttttggatgtagccacatcctagcaaggatcagcgagtcagaaaaaaaatggagaaaaaataggtcccaccgagatttgaactcgggttactggattcagagtccaatgtcctaaccgctagaccatgggaccttggtgaaagataaatccagacatattataaaatcgattctcttcggaacattccctccctttcggaatcccaacgaactagcgaattcgcgccgacgattcgattccacgagcacatcgaaccgaagaatttgtgagaaaaatcggaagcgcgcgggtttgttcgcggcgggattgatcttgccctaagtccgctaagaccaatgatggcggctgaaatgaactagcggaaggggaacgcatcggattcctgcaggaatttcacgccgccgtcgatggagaggacggcggcggcgggccggcaaggcgaagacggggtagggcgtgcgtactcacccgggggttggcgagaaccggagaggaagacgaggcggcgcagcagctcatctctcctcctcctccgccctcccggacggtgctacgagccctcacctcgcggcggcggcggcgacgacgacggcggcgatgctgcgggagaagttggagagtggagtggagggaagaggataccacggccacacaaaactcttccgagtcctcgggcgcccacgtggccgccgcagcacgggccacgtgcgcctcgagattcgtgcagtgctcgagtcgcgcttagatttttattttattattttataattctttccctctctcccgcttccctcgtcgccgcgcgctggcgctcgtgagtcatgccagcctcgccggcgtcgcccgccgcgccgcgccggatgaggatgggctgcggcgtcgagtgattcctacggggtgggtgcacgagcgtgcacgcggcgcgcggcgccgacagtccgggggcggtgtccctcggcgtggcctccccgtcggcggtcgggggggcacagatggtgtcggccctccgcgtgttcgacgaaatgcgtggccgagcatggcaaggttcggatgttaccttttccctagcccttcacatgctacctttgctgttcgtcttgttacttgggaaaccatgaaatagctcgataataaaatcgttataatatttcattcattcacacattgatgaggatgttacatattacaagggacaaatttacatgagatgcacactagcacactgcacacagtactgcaactaaactgtaacaagtatcggtgttcctacttaaaaagagtttcatcgtgctgacactggtgctggggacagaggggatgaagcgtcaaaattaatatcatctttactagctgcatcgtagcctgcggatgtttccgtgtcgatcgcgccttccaggaccttcacaacctgtgacatggctggtcgtttgctgcagtcgcgctgcaagcaccagactgctagcttgatcacttctatcatttcttccccgtgtaattggatttcttcgttctgattgtccaatatatctagaacttggccgaccttgattttctcttgaagtagattgattaggttgttgctcgcttcaggctgattgttatccaggtttttccttccgctcacaatttccagcacaacaacaccaaaactgtagatatcagccttctcggtaattgttgatgacaaccattctggtgctaggtatccccttgttcctctgatttttgtcatgacatggctttcatccctatcgatcagctttgctagaccgaaatcagatatctttgcattgaacttgtcatcaaggaggatattaccaggcttgatatcaaggtgagcaatcttctgtcggcattcttcatgaagataggccaagccttttgcaatatccagtataatcttgtatcgagttgcccaactgagtgtacctcttgggttctttctgaagatccacttgtctagagacccattggtcatatgctcgtaaacaaggagcctgtgaaacttgtcagaacagtatcctatcaatctaacaagattgatgtgatggatgcttccaatggtgatgacttcggccatgaattcttcttttccatggccaatatcacgcaagcatttgacggcaattttaacatttccaagttttccctcatacactggcccaaatcctccctgtcccagctttttgctaaagttattagtcgcctctctcagctgtttgtaggagaaccgtgttggcatgccagccagtcctttaaatgggtcgtcatcatccatcttccttttcattattcttctgatgatgagaataattatgcagataactgcaactataataggagcaccaacatggtaaactaatggatttaattgtttgcttcttggtggtggaggtaacatttgcaccttgatgtatgcagataaattgtatccaactacttcaggctgataattcatgagtgagaaaagctttggcattaggtagcaagaaccattagagacattgttatacttgaaaaaggctgctttgcatgaacaggccttcaagcaagcctccttgcagctatattcgtcggtggtccaattttgtcctaaattgaagtacatgacatttgggagggggagaagctgttgatattgggtcaagtcacaagacagaggaattgctagggagcagcccatgttaggttgcccggtttgtccaattggcggaaaaattgatcttcatccccagaattccgactcgggcaactgcattgtccttcggaacagataccataatctccacatactgtgggatatgcacaatcatcaagatccacatgcagaacatcagcctgaggtttccacgaagtaccatcccatctataaactctcaagtgcccatcattctcgaggctcatgaactgtgctgaagatggcgacggcagtgatatatcgaatagattgatatcagtattgttgaagctaacaaatgctgacaggctaccttttaagaaggaaatgtaagtcgtgtagttctttgctccatcagaggatatgttcatatttggttgaactatggcatcagtgatattgaatcttctttgataatagagctgtggtggatctgcttcgatgaaagcata

SEQ ID NO: 11520 - DNA, 6684 bp, Oryza sativa
aagagaaaatcattgcaagtagcggtgcagatgaaaccacatgcgaagaatggactataccatgtaggattctgcctaacaagaatcgctctgatcgttgaaccatctgggtaggttgcactgtatgggatggtggcattgttgttcgtccaaagagaattaatgttggcaatggggctgggataatcaaaggaccaagaatgggagaagggaatgggcagcgagaacaagaggaggaggaacagcaagctttcagcccaaggcatggttggtatgtgagttcttcttggatgggagatggggacagattatgtgatcttttgtttgagacgaaaggtttcagagcctcagatgagaggctaggagtatggagcttgttttgggaggcaacatcgtacaatggcaggtgctcgtgtatcaggttaaacaattggacaattggatgagtgaagagttagtggtgctcaagtcccattatgctaatataatttgcacaggagaaacaatctgctgacggctgttgatacttgatatccactggcacctttcaatgtagttctgtgctacatgaaccagtcaatcatatagcttctcatgcctccttttgctaaaatgataggagtgtattaacccaggtaatttctgcaaaccaaggtgccgtttgatcagctgactacttactgcacaaactgggtcaggaatcagtgggcctttggtttgttagtatagacttaaacaaattgttggaaggtagtcatgtagagcactagttattagcagccaattgtagtcatgcagcgcactcatgcaaccgtgcaggttcaacttattcaccgacatcagcaacctgatgaattttgcacgcacggtcgttcttcccgttgacatatttgataatctcgatgctggtgtttgcaaatcttacattttgtacttgtatatttcaacaagaaactgggtcggtgactacttactagaagcaatgctattcaacgtcattcctttctttctctgattttcactctagaatttattttatggaaacttattgaaacttttcgagttttattttcgtgtttgatggaaaaaagacaccttgttcatacatctttgacctggaagctcatactcgtaatgactggcttgcttagttcgactgggatactatttttttcatgtgtactctctgacgtgaacaactgaaaaatacaagtctgttgctgcagttttggttggctagcatcacgactctttctaaatcgtacaatcaagatcagccgtggcattatgacttgatgaagacttcggcagggagtaccacagcttttgcgtatgaaggtaaagagtaaacacgcatctgatgttacccaggtaattgacagtattctgcctaatctttttaatcgtcttccaaagcgtcccgtcagatcatagttaatgttacttgttggtacagaatgtgaagcacacactgactgattggagtttgatccgaatcagctgcaattatattattgactgcaactttagcagttgtagctgctaagttggatcaaacttaaacggtacagattaatttgatactgtggcaaaagtgttgtaatataaaacattgcttattttactgttgttcgagtactatagcagtgaatctgaactgttgatcattaaaataaacggctgaaaatacataacagtcctatgatgctggttagagtttataactgcaccggatctcaatccgattagagttttaactgacgtgtttttattcacgcatccatgaacgtatagacagcatctgcgttcagttttgcctgattgcagtatcagcttttcttttttttttcttttcaattttttaacccttttgtatccgcacagacgttatctttattttccgttgggtttgtttactatgtttctgatccattcaaggcccattttcaatgcataattttacagggtttaagacatttcaattctcacatgagtaaataaaaatttctgcgttccaagcatgttggccagcggtaaccactgaaatgtcccagtttgatctttcgactcaactgaagtcgctactcacgccattgatatgtgtggttttcctctcatttttctacagatgaatttgatttgattggttgccgagacatccatgttagcgaccccgacctgagctcaaggcaaccacaaatccggcgccgagaaccatcctgataccgtatctccggttgccagatcgagctgcttcagcacatcaacctcacggtcatgagaatcacaggtccagctcatagcccaactgaaacgatcagccacaggccttggagaccagcatatcatccacatgatttccgatccaattcgcacgcaaggtacgccaaaactcttccgaaattcgcctaatctgttactgttaagtatgaattctgaaaagtttctgatcacggtaaaaaccggcatgtaaaatgaaaatggcccaagtgtgaaaatgtgcagattttgggcgacggtcttcttcgtcaagccgaaaagtcgagaactggacacacgttttcgtttgaaatacatggctaccgaccctggaagctgacgaaacggtgaggataattaagtacgaaaacgtgatcatggtgtgaatttgtacaggaaccttgttaggtagacatcagatgagggaagatatttcaggcacaaaatgtcaagagaggtgatgaagactgatgggctgatgatggtaggaaaattcggacgataaagaaattcagatgattgagaaggtacaggagtcagttccatactcccatataacagaaagattctctgcaccacctacacctagcaaacttcgattgttgtcttcgttcagattgtagccaacctaactaaaaaagattcacacataatttgttcgtatcctactgtaccatatgtgataaacatatagtaataattttgaaggtttggcaactttgccaagaactgtcatgcaactgcaaaagtcaccaattaagatttattcttctcaaaaggtcatcagtccaggtatcctgacttgatccaccttttattatggttgttgcaggcttgtgctccttgttcaaatggaagcagggaaatttccatcaggagcgtgatattccacacgacttctcccgaagaacacaccagctcggtgcctcggtgagtggaaactgggttccattgtgaaataaaactttctgataccaatcaggttactgccgccggcgcaccctgtttccattgagctgttgtattccagaacatcatctttactcaccgtagtgttttctggccttcagtggattgatggtccccctcctcttcagttgcatgatcaactttgtcctttcaatcttctcctcaacaaagtagagattgtcctaaagtagcacagtttctacaccactcattctctcccaacaatacccatgctggaagagttcatattgggggggtctgtgttgatagtgcaattttttttgttcatttcctatgctagaatagcttgagttactttttaagatatactacatacttaattaattttaagctggcttttgtagagtaaatgtgaaagtctatgttgtattgcaatcccattggtgaaatgaaataccatttctttccactgttgcctcagtgtaaagcttctaattaatttaaacagtttacagcatacagcatacatatttggtgcttttttataaaaaaataaaacaaaaattggacaatttccgagcttgccaaggaggaacatcaagctggaactctaattgcacatctatatgtctgcacagttatccacatttcacacacaaacataggaacatctgatatatttcgagtattaaatcctttggattaaattttgtataccttcattggagcatgaaatgaaagaattttggggacaaaactcaccaaatgtaaccatccatataatccagggtagaaacctttcacctagggcacctgcactgatatcgaaatcgggtttgacaattctccactgccaaagctcgcagcacgccttaatgtgttgttccctaccaatgaacgatcaacgactgtcaatgtgctccctagtgccattgctgatggcatttggcttctctggcacatcttgacaatcaggcttgctttcttcttggcgcgctttgttccgttgagggtgatggtctgtattactgtgttcaaccctggaatctttgctactctctgcaccaaagcagagccgccccgacgacaaatctcatataaagctgagactgcattttccttaccttttggagttccccgccgcattaacccaacaaggctagtgatcacagtttcagagctcccaacaagatgcacgatggatggttgcttcatcagcagggccaaagcaccagcagcttcctccgacacggtgtcattcctcagcgactgaattaaagctacaactgcgcatgactcgagcatccgagctgagctttctggatgtgttgagaggttgaagagtgccatcaccgcatctttcttcccccttgatgtccccttggtcagcatactagccagctcctcaacagccccaggctcattcatgatcagttttttgaaattatggaccactgatagactaaacagagtggccgcagcattctccttcgcttccgtagtccatccattctgtagaacaccgacgataagccgcaagcagccttcctgttccataatccgtcccttgtttggctcgaagattgacaaattgagcagcgctgtcactgcattctcttgtgccatccaatcattcgacaagagcaacctgcaaagcagcggaatcgcacccaagtcggcgatgaaagcccggttttgcttcccggtctttgccagcaaccgaatttccttagcagcgactgcctttacattttctgacccgtcctccagcatcctgaccaaaatcctagctgtggccttgtttgcctccattgcagcccgactactgcaagatgcagcaacacattccgccatcccctcgttgctctcgggcgaatcatactgcaagccatacaccccacaccactgtgaaatcaagctgcggagagcacggttcggcacaagccggtgatctgcaagggtttggccggagttggggcaggtggaatggccctcctcgatccactgtatgatcgacggccggtcatacgtctgcccggtggacgccaccacgggatcacgcatcaaatccagagaaattgggcatgagaactcctttggcaccgagaaggaggtgtcatcgccgccgccaatcgagagaagccgctgcctgttgcccgacaacggccaatcccggagcgccttcgcgttgctagggtcgaacacggcgaataggcagtagcggagcaaggcgaggacgctgccgacgagcggcaggtcggtgtcctcttcttggctcaagatttgctcctccaggtaatcgatttctgcgcggcaagaagccgcggtggagatgcccatgtcggcgaggagcgattggagcgaggggtggtcaggtggctggccgaggtcgaactggcggagcgcatccatgaggcgttcccggagcgccgcctcgtcggggtcatggtattgcgcgggcgcgcggcaccggcagtgggcgcggaggaggtcgagcaggccggtggcgtcgtgcgagaggcggagtgatgccgccgggaggacgtcgaggacgacggcgagctcggcgtcgaggtcgcggaaggaggcggcgaggtgcgggctccgtagcagcgcccacgcgcggccggcggaggcgacgtaggagacgagcagctcggcgcggaagagcacgacgtatagctcccggaagcagaggttggccgcgtctgagaaggcgcccgccgccgcggtgtctaggaggatggactctttgatcgcggacagcatctcgaggcggtgggcgagctcgtctacgttccgccgctgcgacggctgcctggcccccgcgaccagcgaggctgctagcgacgccaccgcccggagcagcgtggcccccgcgagccccgtgggcgcgaagaacgctcccgccagcggcagccgccgccgtcgtggggccggccgtcgcagcaggaactccacctgcgacgacgtcgacgccgccgccgtcatgccccaccacaaccaagaaccaatcaaccccaaccactccccccttggattcttgcacccctttgacgagggcgattggaggagggagggattaggtgaggggggcgttgggtgaggtcaggtcaggtggaggtgagacccagacgagcggtggcgcggatacggtcggtgccctgcgcgggcaaggggtggaggagaaaaaggagtaggaggagagggcggcgtgttctagaggaggaggggaagaggggaggaggaggagcgggtgacatgtcaaccttggcttcgctgcttcggtttcgtcttcgcctttctctatctctcgttgcgttgggatccgcggttttgccaggttttttttttttttttggttttggttttggtttttgttggcttgcggcgccgcggagtgtggggaaacgctacgcgtactggtgggggggtaaactttgctttcgggaggggtgtgacactggtgggctgggcccaccctgcagcagagct

SEQ ID NO: 11521 - DNA, 35869 bp, Oryza sativa
  unsure (1)..(35869): unsure at all n locations
cgagaaaattattagtttatgattaattgatttttaattattataaacttaaaaattaaatttatttgatatttttaagtgacttctatatagaaacaattttaaaacaaacgtaccgtttagcaatttgaaaaacatgctaataaaaactaaggtaaaatctgcatcgtaattagaaataaagaaatactccctccgtcccaaaatataagcatttttagctataaatctagacactaaccaaaagttactatattttgggacggaggtagtagcaagatataacagtagagttaactactactactgctgtatgtaaatccatctaaccataatattaggactaacatgtataattataagtacatgttaagattttatcttagtttccgttagcatgttttctaaactactaaataatgtgtttcatgctaaaactttctatatagaaattgatttaaaatattaaatatatccattgtcaaatttataataattaaaacttaattatgtgctaatggctttctcattttacgtgcatcaacttaatcttcatctttattagtttcaaacctaattggctataagtttatcttcaaatttttctcctcttccttttttttcacttatgtatttaattaatacatatatcttgaatcacttcattatctaaaaataatatcttgaagcacttgtaaagttagcttgatcgactaatttctttttttctctcttctctgctagttactatctccatcctaaaatgtaagcatttttagctatgaatctagataactgtgtgtgcagatttatagccaaaagttattatattttgaaacggggatagtactccacttctctaaggtcaagtgggaagagcttcatgtaaaaaaaatgtggggagagcttacctaaagttacaagtttaaacggtactctgtgttaattaagtccatctttttatataaatcatgaattagccaaatcagtgatccacttttaagaatactccagtgttgctaggtcttggcaattggcgttcaaaaagtactctactgtagaagtagtattgatgtactagtacgtccagtatagtattgattggtatggggaggtgtgctatggttgggacgtatgcctgccatgaaaatccaaggtcaacgcttgtgcagcgcaacggtctctgtgccaccgcagcagactggcaacaagggcaggaggcaggcagcagcagacgtggaaaacgacctacctgcgggtaggaataggataccataccaaggcatgcacagtagtggaaactcgtagagatacggaggtaggagtattttgcaagagatagagtttattatctaggcaaaaattgatacaggacactaaaaaaatatgtaattggttggaagatatcacaaaaacgtgacacggctaatggacactacaaaaaatatataattggctataggacaccggtcgcattattttattatttccgagtcaaaaagaggtgaaattgtttttaaaatgacgagattgcccttgacgtcatcttcccccacccgaaatcacagaagttttgtagctgccggcgaggtagctggcgcggaggctgacatggttggggagggacgagaggtggaggagcatgatctagcgactgctcgaagctccaccgtaggcggctccttgtcacgtgctcccgtcgtggctgttgcctgcttgcctccgcgtccagtccctgctagcgcgctgctgcgcggagcggccgcctgctcgtttgcggtgtctcccagccaattacacgttttttgtgtgtcctgtggcaaattttgcctattatctatgggtgtgtttacttatttgggtgtagagtttttaaagtatacgaatgcacatttgaattattaaacagactaataacaaaataaattacaaattctgcctataaaccgcgagacgaatttattaaccctaattaatccatcattagcaaatatttactgtagcatcacattgtcaaatcattgcataattatgcttaaaagattcgtctcgcaatttacatgcaaattgtgcaattggtttttttcccacatttaatgccccatgcatgtgtccaaacatttgatgtgacattttttgccaattttttttatctaaacaagacctatatctttttaaaaacttctactccctaaaaaaaatcctagtatgagattcgtttaattaggatatgacataacatagtacaacgaatttggatattctcgaagtctagattcattgtcacatcctaatacgaggttggttttttacagagggagtagttatggtgacagtaaatctgtcacttcattattgtttttgtagtttttgtaaattactttataatattttctaatattatgaaatagcccaacgtttgattcaaacaagtaaataccatataatgataagatatttgatacaaaatatattttttatatgacatattatatatttttcttcttctacccaaagcgaagcttgagcattttgctagtagctataaatttatattagagctaacatgtataatatagtattagttataaggttgtctataattttcttctcttctctcacatatgcatttaacgtatttactttggagtatgtaaagagctatctcttagagtggatacaatagcagactacaagccagctataaacaaattttgaggagataaaagaggagagagaagagtaacgggctacagatttgtagccagctgcagcacggactccaatatgtaatgtgtgtatgacaggtgggaccagatattaatagtgtggtatatatttataggtaactattgtatgaattgactataaatgatttggagccagtagtgggctatactattaaacttgctcttatgagagctaacattctttatttttctaattttctctcacctttacataagtttatagttggcttatagcctagtattaaacttgctataagagtttgttcgattaattcctatgaaaaaggattagagaggactagagaagagattcatgtaaaaatagaaagtggggagctccaaataccgctcatttctctagacagggattaatcgaataaggtctaagtcatgtgcacattcactcgaaagctctcttgtatcgtaggagtaccggatcactgaaaggagtaatgactgagtattactattgtatgttatctacttccttaaaaatctctagtataaatcggtagtaccctgcatgcgcaatatagagcacacgtatgtttggacaacattttctcgatatggtttagactgtttcaaaatacgtgaccaaaataacaaaaaatagttttggactgaaattttagtacttgtgcttctagcaatctagaagacaagattgaaaaagataaaaataaaaataaaaaaactcttaaataaattctagtatttaaagttgcctagggctcaaacaagcaactcatttgccctatgctaatgcgatccttaggggtatgatttgatgataaaccgagtatacatgctctcacaactcgtaccatcatctgttatttaataaaggataaaaatttatcgcgccctagttccaacattattttccttagcttgcactcgagacaggagagaaatctaaagtttattgctacatgccctgcaagtgcaatacaggttaatgactagtattactaactagcgacgaatagacattgggagctagatattgccatcgacggtaaactttccagctagttgtagattatcccatggtagctagacatttcactcggccgctcatattagcccgactccatggtcggtgtattcgatgtaatacaacgtatccaaaccaattgagtcatttcatgtgaggtaccatagtggcttagtatgtaccctcgatgggcggtcaaggtatgtgtcaacagaccttgtcactaaggcctggatcacctatatcacattgtaaaattatgagagtttaatcttttggattctaccttccttgataatgctttgttacttgagaaaaaggggtgtgcaaaatggtaagtagttctagaacctggcagccgcatctccaaatatgagtcgacaaaactagctattctgtagtcatgataaaattgatatctttttaaggcatgcaaggtagtctgatatcataatatccctccaagtagcaatggtaacggtctaattaatgataatcaaagcgccaactcccgatgctttgcatcatatcgacatgttcccacgtgagtatatatattgtgtaagcttagtggacttacaaataatataaaatcaagcaactaacaaataacaaaattctttataaaattatgacatttcttttacaaatgaaagaacataatttcttttaccaaagtgactatacaaggtgggtataggtggatcgaaaatctgaactcaaagagcacacacaccaaaagttagttaatttaatttaaaatattacatagcaacaacttagtgcatattaaatatttcaaatatttcatatatttttaggtgaagagggcatgtgcccccattcaactcccttgaagcatttaaattgttgatattattatttttttcattatagtccaacaactaagaaaattatgtgaacataaataagtataatttaaggcctatttgatttattgccaaaatcatattaccaaattttgatgcaaaattttgataaggcaacaaacaaaacatgtgccaaccatcactaccctaccaaataatcttcattctttgaagaataaccaaagtttgataagtctccaaaccaaacatttccttgacatattttgagccaagatctcaaaaagaggaggcatgaatccacataagatgaacgaataaagaacaacaacatgtcaagttcaagatttggcttcctaccacctactttgtggcccaaggtgttggctctaagaagggcgacaaacttatggtagacgctgaagaacatggcgtgcaaggatatctttttgggcagagaaaaggaacaatgagacatttctaaaaatgagttggatgccaagtagatcttgttttacagtctagagcggttcgtatttcaaggaaagtgggtgacattccagataaattttactatgcatagtttgacggttgagtgatttgaaatctatccaaattttataatctaatcatgcatatacaccacccggatgaaaggattaaggtgatcaacctcttcctagttaaacaaaaatttgcttaggttatatgtgttgataacttgactttgtgtggtttacattttaaattaggttcaagactactatcaatttagtatatatgtgataccctatacatatgtacttacctagctaggaatatgcatagccaatcatatatggaaagatatcttcaaacatgtatatttagataggacaataaagcaatcccttctattaagaagggacatgtagtcggaatcgggaatgataaggaatacatactctgccggtaccttattggatgccgagttttacttagaagagaggtcatactctgatataagtacagggcctcttaggggcaagtttgatacaaatacaaggtttcctaggagggaaggacatcaaatcttatctcaagccatggacatttgcaagccacaatctgcacactagttcaactttcagaaggagccataactaacgccaactacactgccttcacattttcgccgagattacttgtgtagaccagattatggatccacctcatgtactatactttgttgtgatactttcaatcaatacagacaacacaattaggcctaccacccatattggaggtccaaacctatatataattccatgtatgtatctcattactgtatcaatgcatatatacttataccatccatgccctacatcctcaaataccatagtcaagatcttacttgtcgacgaatgtaaatcaatgtctcctgtaatatgaacacatcccccctcccccctcccatcccccaaaaaagcaacaatatgtaaaagaagttgtacttggattccatttttatgttttcccactatatatagttttcgaaaaaccatttgcaaaaaaaaaacagcaccatcggatgttgagccatggttcatattagagcaaaggtaataacgaggtataagccaactataagtttagatggaataatggggtaaaactataagcttatgtggagaacagtgatataagaaaaatgaggagtgttggctcttatgcaagagccacatttacaaatgatacaagataaatgtattaaatagataaatgagagagaggagaaaaaaataaagaacattataactaacctactctctcattccatattgatcatcatataaccaaaaactacaaatttcaaattgatcatcatataactcttgtcccttcgtttaacgtgaagcattattgtatctatgcatttagggtagttaaggctatccccagccctccatgccatctagtgttcatagcattaaatacattgccacataagcaaaaatcctatgtggcaagagagttaatgaggagagaggtaaaaagatgaagaaattatttctcatgcaagaaaccatatctacacaagaactaagaatgaaaacaaggtgataggtggataaaaggagagagaatagaggtgattggatgagaatttaatttgaagacaccatccattggatacatagtttctacccatagtatctatatgacatggcaaatatggaaactactttatagtttctgggttggggatggtctaagcgcttgtttcttttgcatatagggagtttaagtctacatgcttcttgatttattctccatcacatattcacattaaataaaacacatactcccttcattccaaaatataataacttttagccttcaaattttgtcctaaaatataacaacttcttcatcagcattctcttctcaaccaatccaccattcgattttctcacctacattctcttctcaaccaatcacaaccttctcacttttaattctgcttacttttttaataccagtgtctaacccttaaaatctttatattctagaacggagtagtagttaagtctttcttgatcaatatggaatggagggagtataaggcaccctctttttaaggaaaatcaaactcgataacttttgactaataatcatagtaaccatatatatgctaagtattatacatgttatatcactagatttgtgttttaaagtatttcatatgatgttaatttcatatttgttggaaatataacatgtactaatatattaatggtcaaagtatgtcattgaagactgtgtagaaaaaatataggcgttataatttaggacggagggagtacatgttaactatggtataagtttatagataatacttaactctactattaaactttctctttaactcttaccctcagctttgcctaatttacaccaatattttttttaaaacacaactcactcgaccattaatgtcttactgtaatttacgagtctgtccatctattattctaagcccctgtttggaatacggaaaatttgtacgaattatatgagaattaactgaatttcttggcttaattcgtgtccacacgtgtcctgccgtcattttctttgacaaaacgtcggattacatttcagaatatatatactaccagtacttaattagttacgtggcttaataaaacatttcaatatatagcacgcagaaagtttttgtcatctgaatcaacttgcgttgttgccgttgtcaaacgtgttcaattactaattgctttccggagtgattattgccaaacattcatagctagcggttgaatttttcgaacgagattttgcaggtcgatcgaggtgacatactccccgtttcttaaaaatccaatataatactaaatatgatacattctaatactatgatttatgtctaaattcgtagtattagaatgtgtttttttttcttttaagacgggggagtacgtacagttgagggattaactggtgtggtgcgtttgtatgtggttgtaatgttcaaaggcgacctgaattaaatgatgtgtgatttgacgctatgatttgaactgttcatggtcaattatgcaggctgcagataagagggtttggtttcttgaatccaatgatctgattactgatgtgagttgaggtagagagggctagttttcatctgcatcgatcagcagccacactgattggctgatgtcgatgaacaaataatactaaaaagttgggtgtttttgttctttaagactccacacttccagataagttatgatccattcgcgagtatttgcaaattgctaaacacacatttttttctgtttgtttatagcctggcccaaacagcttaataatatgtgtatgaaaagccaatataaaaaaaccacgttgaaaatacactgcaattaaaaaattaagttcaaattttaaattttggcaacggttgatttgttgcagggctaacaaacttgattgtgttgattgaattacgactctgctgtattagaataggagagcacgcagaaaatttaacagtggatgacaagaacttgatatctatgagaagatgtaacttacccatcagaaagagctagaataattaattaggtgatcaaagcaacatcaggaagtctaattaattattgtaaactacgacggaactgacttcgccatcgtcaacagaaattttagctgctgcttgcacgaattccaaggacgatgatctgtcaaagacccaagaacgattctgcaaagctaatttatagatcctgaccaaccaagaaaaaaactaacaaaaaacgacactccatggggaaccaatttacttaccacagaaaaaaaaacctagctaattaaaactatttttagaaaaaaaaacggtttcaattttgcaaggaagatgaattactccatcctcaacctctgcatcaaggctacccaaccaaagttcctgtaaccaaataaatgagaaaaaaaacagcgtggcaaaaattccgtataaaatagattaagcgcaaaaatgaaaacgcaagctaagcacgtagcttattaatagttcaccgttcaaaatggatgaagaagctcatgatgatcaactgtaagtgtgctgcttcaataaccacagtacattggtcctcctgacgatcaaatatggagccaactgatacttataaataaatcattgcgcaaggccaaattgaccaaactaaaaaagcagttattaaaatatttctatgcacaataatcattagaatttagaataaaaatagaaaaactgtagaaatacaataggaagagttttacgtcagaaacataattaaatagtgggtttcagatccatatatcctacgtgtaggtcattcttacctgcgatctctaatgtttaacagttcttacactttatcaacgataaaattccataattttgttctccagtgagctgcatgcggtcgatggatccaaaacagcagtcgttaattctttctctggattcttcttcgtcttccactaaattctaccgtatttctacacgcaacttgttgctgatcgttttgttacacgatgatatataggagtatgtctactctttccattcaaaaaaacaaatctaaaactgaatgtaatatattctagtacaataaatctggatagagatatgtccagattcatataactaagatatgtcatattaattagttttttatgggacggagggagtatgtatcatgtgtggtgtgaaaccatcagactgatttctgctattgttttcctttcccagtctggtctaaccccaatcctggggtgcatccaggtatggctggcacatgcttaattagaagcttaattaccagttaccaccaaccacttattgacctaataaaagcacccaagaccagagagctcacagtagattctagagtccagctgataacctggtagggtcagtttaaaacacataatttcaagctttgataattgtgggatatcccgaatctgctcctctatcatataaacatgatttaatttcgttggtctgaataaacctagctaataattggtaatgtactcttggagaaaaattgcgaagactattgtactgaattatccatatgattacagatgtaaattaaatattttgttaataaacttaacaaatatcttagaaaagggatatgagcaatgcagtagaagtatttttttatgaaaaatcatattttcaagataaaaaacatattttcaagatacgtagaacaaataatccgcaacaatgatccgatgaagtggctcaagagaacttgtcacaaatattctaaaagaatttgtatatgaacttccaataatattgcatactactctaaagactcattgttaaatccatcatacatagagggagtgagagaaaaattctagcatatttatatactattaaaactgacattttttattcttttaggctaaataataataaattttaacatcataatattgaaagtacatgtaaattttccaaaaaagaaatcgtaatatttgttagttattgtgcatgatgtaatgtatccgaagtaagtgtgcatacgataagtttccatgctactatgcatgtcacatgcatttgtcatttatttgaagttgataagttcggatgattttctgggaagttaaactaattacatggaaatgttgtaaaattactgcattcagaggaagcttaatatgtactccctccatcccaatatatgtgcaccttctagattagtagttttaggatatgacacatcctgtcttagatctagctatgttgctgaccttaggttccctttgtacgaaggatcggcaaagaacttcagaacgattcaattttattttgacatttcccccctaaatccctttggtttataggaaagaaagaaaataactatggattacattcctctggctcaattttatgtgggggggggggggggggaataagaaagagtcctagcctcttagaaattttactttgttttatttcttgtgatatcctaaaacttatggagaaataaaacaaaattcagagcaagaataaagcaaagtcatatacagataagtctatggcttacctagtctaaaactcaattggtactgtcagtgatgctcttacgagcaggaggaaaaaaaaacaaatacttgcccgttgtgtcgagaagaaaaggcggctgtggttttggatagggatgttcatcaacggttttctcaacttgttcaaaaccggagacgagtaatgttagtcaagtaattagcttagccgcctgttggacacacgcacacacaactacaaaaacgactatagctaaatttggacattttgttcaaaaccgaaaacgaacaggtcatagtctgagataaaggatgagcaatatccatccaaatgtccatccatcaggttgttaaattattggatttcacatgtgaccccgggggggggggggggtcacaaccatgagctccgaagatgaagtcaacagaccacagtacagtagtaggacggtgagtgagtccccaaatcccaaggtattttctcatctcatcatgcgagtgcctttgcacctttcaggcaaagcaaaatggcagttccctcctcaattttcttccgaaaaagaggcgccggagaccacaagacgtgccgcccaacaatgtggattgctgccatgttatcacttaatctatccagatcttgttcagtcgtagtagtagtcctacatatgcagtccagttcatggccaggaccaccaccgcttcggctgctagcttcccaagagtggcagacagctacatacaattcaggcccatacaattatcttttccttcttctctttgattatatctccaacgattagattattacaggaagaaagtttgttcagattagctgctaatagatgatgcattggccatgtcgccgaaaaacggccagcttttgtttttgtttggaccccagcttcctgttgactgctgttgctgctgctcacacgtcagaatccttcaaaagaaaccacactttgtcacgcggagacgcctcgtattctccctcacatggcaggatcacatatcatcaaaagttaggccgcccatggagtcagaaaatctgaataattcagaattgacaacacgcacacagatgcaaatccttccaggactgtccagtcagcatcttggttttgcagggtaggaccagcagtgtaaagagagaagaatgagacctcactttcattgacagctcaaggagaactaggataggagctgcatttcagctggtttgacattggacttgcctgtcatgacagatggcccatgcaccacaggctgtaacataacatggcaagaccagagctcaagcatgcaacatgaaaggtattgagcagatcaaaattactaccaggctacgggttgctttctgcgcgaaattacattttggctttcccctgaaccgcatagagggattccggatgccaaattgatataggatcaccacctaactagaatgaccatctgccgcatctcatcttatgggtggttacaactggtgagaaaatgacccataagcaccggcagcagctttgtgcttttgcacaacgactaatggaagttgatatcagtacactgggggtagatagatgccgaacgatggcaggaacggggcatcagtacctgtagccgctgtcagcaccatatttgcttctgatgttgtagggatcatactttgggtcactgtagtctgcgggcttcacttccgcaggcttgggctccggatgactagtcccataaacagcttccccactcttctcccggtggcggtggcgtagccgatcttttgggacctttgagctcacttgaggtgtttcggatgaaccgtagaactccgcgtattcctgcctcttggaggacctgtgcttgcttgacagcgtagaatccctaaatttggatgatttgacactcttctgggccttcggtgctgtttcgtttactgggttaggaccatggagtgtctcgggtctcattggagtgctacttaacttctgggctactggggtctcctctgtgtcttcaggcatcacaagcctgtctttgagtggagtgaggtctgtttttctcttcccatgttgcaggcgtgatgggacgagcctgagaagctgattccccaccccttcaataacaagtttcagtagatcaccaataagagtcccaagagaaggccacccagcacttggctcctctttcaggctctccacaaccaaaggtggctttcccacggtgctgctctcctgatgctcatcttcaggtgcttcgatctgcaatggcatccacacaaactactatgtaaatagtgggttcaaattcatgaaacaaatactggggattctctgcttcagtccattgtaactgaaagcaagaacctgataatagtttaaagtgactaagaattcttcataacaaagcttcaagaatactgatactgcaaaatgcaagtgaaaaggaccaactgaaagccaaaatccagcatataaaaagacaaccgaatcccaaaatgtaacaaacagaaaacactaccttttcagcagttgatgacccaaatccatgttgcacaacagagaaaatatatccggcaacaacagcaccaatgaccaatatgatatctgtgaaaataaacaaaatcagtgatcaagtctagacatgttctttttcttttgaaaaatggtacataaactgcagcaagaagtgaactaatgataaaaactaacatgttcaacaggtaaatgaacatgaaaataattgtaaatccctacagctctggtgtcatacagtcataatttaagataagttagtgtagaaatataaatgattcagccagaaacacaaacacaacaccaactgcattattacctctagaaaaaaagagtctcttagggattatgaaaaaaaactagtcatttactcaagtaactcagctttctaaacaagatttatcatgcaaactccaaaagtctaaatagaggaagaggcccaaaatatgatataaaattacagatggctcactaagaaagctgcaaatcactggccatagcatgcccatccacaatttatttgatactattatgccagttccaggatggcatatctcgttataaatggttgagaaagtcatggtctatactacacttgtattcaatcaacaaattcatttatagcgatccgtatgttcaaaagatctgctacagactatgttttcttatggcgcgtgctagatctacattactgatatggcactaataatattacttctggttcaacttgacaaatcagtatgctaccatagaattataaatacagggatacatgaagtaaaaaacatctagcaattttaccaacttccaattcagatatcatttcacatcacaactttaaaataataataaaaaaatcagaacgcatgtattgggaccaaagcggtcgagtgagccacacttgatgtaaagaagaaaactgtgtggtgatcaattaatcatccataaaaattcaaggatagcaccaccaaacagaattagcacaaaacttaaaataaggcccggaaacccttttcttgttcaaaactgcctcaaatattcagccagctaactcctctctctctctctaacataaacaacattttcttaatgttctaaagaacatgacggataggacaacaagcaaaaacatctagatgtaaagattacaaacataaaaagtaaaaataggagaatggacctgacgatagaagagttgcatcctggtaggtacaatcttcttgcggaagggcaattttcctaagtgcagcatttccacggtcaataaccagcaaagagcacattttcttcacatataccacatcaaaatcagtagagaactttgcatcttcacttggaccatccctataacctgggatgtttgattttccaccagcaatggtggtcactcctgcacagaaagttcattcacttcattcgcctagtactaacacagaaataatgcataaaatacatatgtcatccttctgtttctaaatagctgtcacatttggctttcacagttcaaacatcgaccaataataaatttaaataattaattaggtaaaatgaaaatgaactttcatatttgcatacaaagtacaataataatactgtacatgtaggtatttacatatatattgcaaacagaggtaagagtttgtattaggtcaaaagtcacagctgctttgagaacagatgtaacattaaattgtagcacacctgattccccaatcttccgaattgctaagtttgctgtatcagcaacatagacatttcctgtatcatccacggcaacgcctgtggggcgtttgaatcgtgcatcacttggtttgccatctatatggccagaatgcccctggaaagaaccagcaaccagtcttcctctgctatctgcagaggttgtaatatcagtcccagtatctagtatctacactactagtactagatgatattcccctgagcacaaacaaatgtgaagttctctctccatctctcactacctgaaaaccgattttatgcatggattcctaaattcagtaaaaagaaggtattcctaaatcttcgaaatagatgacattattttcatggaaatatcaattatttaaaaattggtatataaattcattagagctacataagaagaaaatgaaaaaaaaatatttgcatatatgcttattagccactgatatgtttaacaaagctaattttaaagtttcatgcctttggggaaagaaggaacaaactctgatcactcctaaaaacagtccgctggatgacacaccaaaaaatgttccatgtcatatattacattcatatttaaaataaccaaggaagcgctgagctgaggatggcaagaagaaaacatacactcggacagtggcggagttattcgcacaatgttgctatgtgccgagtccactgcaaggagctctccaccctcaacaggggacaccctaatggtgtgtggcgtgacgccaagcttgtccccttccacgagcgtctccacaaagtagccgctctcaaactgcagagccacacccccatctgccgcatcagagaaacaccatcagcatacaaggacacaaaataatgataatgaaaaaacacgtgctgtccacaaacacattcactaaataaaatgatgcactctgctagatctggaagcccctaagttcactttagtgatgtgaggatgcatgaaattgaacataggcagtaaacattgttttgcttaggtcacacgcacagagtggcatttgaactcaagtaaacaaaaatgcaagcatagacaatataatacaaaacactgggtatgtttggtgagcttggtcatcttaagaatactctggttaaactcacttcctcacaagagacaccacccaacatactgatactaacacacttgctaatcagtaatcacaaggtaagtcgtccgaactgcagaaagccagaaacaagcaaaaataacctaataaatcgtcaaatcaccactccgccaactaatcgaacttgcgctgctgactactactactagtaaataaaccctggaacagtagcaactagcaaaccaagtcggcagctatggcgctcaccgtactgcgggtgcgagggctgcttgtgcccgtgcgacgacgacgacgacgacgaaggaacccgcggccatttcaccaccgacgacagctgcctcacgatgctatctgcagaaaatcccccccacaaaaacaatgtcaggatcgaatatatccccgcccattgcacgccgccgccacccccaaacaaaccgcggcgcggcgggagaagaaggtggctgggttgggcgggcacctgccggcgacgggaacgcggccgcgtcggtgtggacggcggcgagggagagcacgaggaggaggaggaggaggagggaggccatggtggggaaatggaatctctcctcgcgattcggctgcgtgagagagagagagagagagagaggggaaggggagggtggcggaaaggagtttttttctctccttttctttttttttttgtttttgcgggaaaccggcggggtggtggactgctgctggtgtaaggtcggtgattaaatgcaggcagcaggtggtagcaggcagtgatggcactggacgctgctgatcgatgctgcgctgctacacgagcgtgtcttttggcacaatgcgtcatcttgtgttcagagatgcgtcaggatgagtttttgatttgttttaagtttaactaaatctataaacaaacatagtatcacttataatatttaattagtttcatcaaatcaataattgaatatattcatagtaaatttaacttggattaaaaatgttattattttgttcaaaagcttggtcaaacttaaaaaaacagtttgactttagctaaaattaaaacgtcttctaacctaaaatagagagagtgctagattgggttctactttttcagctaatcgaacatgggattatcacgggtcacacattctaatctatagtaacattttgtaaaaagaaaaaaaaaatactcatcagtattcattggtacaagtgtttttttttaaataagaaatttaaactttcgaactaaatttctaaactaaacacaccgttatctctctttttatttagctactagttcttcctccgtcgtaaaatataattacttaacatcagattagacatattttaatattataaattttgatatgagcatgtgatatgttcaaattcatagtactgaaacgtgaaacgtatctaatttgattctatattaggctgtgtttaaatctaggggtgaaaatttttgccgtgtcacatcagatatatggacacacatttgaaatattaaacgtagtctaataacaacaaattacaaaatccgccagtaaactgcgagatgaatttattaagcctaattaatccgttattagcaaatgtttactgtagcaccacattgccaaatcatggagcaattaggcttaaaagaattgtctcgcaaattagtcgcaatctgtgcaattggttattttttagcctatatttaatacttcatgtaggtgtttaaacgttcgatatgacagggcgtaaaattttgggatgtgatctaaacacccccttacttacggatgctgtctgcgtattcactcaataataaaatctccgacttttcttttgggtttttggcagcacggtgatgatttaaaccacgtatgatcaagccctaggagcttaacataaagttggcaaggatagagtgggcctggtgcaaaatgggcctaaataatgtcataacccaaattaatttgctgaccggcccatgcattcccaactcctaaccttgctttattcgtagataaagcaaatgttgatgagtgatggccgtgctcatggactcatggtacaattcaagcgcacaaacgacaactagcccgaattagtggccggttttaacgtaagcaagctgttttcgttcttacagggaggcaaaaggcaatgtctagcttaattggactttaatttcttcaaatgttgtacctttgcaatctttacagcaaagcattaggctgtgtatgtagatgacgagtgtcgaaacaagatttcggcaataaaaaaggatggctatcaagcaggaaaaatggatgggtttgaagacaagagatttatacaggttcagggcctctcaatgagaagtaataccctactcctgtccggggattgatccgccgagtgtattattgatcgtatgatctgggagaaaaagttatgccccaagaggcatccgaacccctccttatatagggggaggagtccgtattacaagatacatcccatattcctaacggaatagacggataaagataaattacaatcgtaaccgactaagattctcggatatttccttgatacacaagttaggaaattaatgcaagtcgtgggatattccatcgccaagtcgtacnnntatacccagtcagatatacatgtcatgtgggtatggggtatccataatcttcacaacgagtttaaagagcaccgactaatttacttctcttcacgtgcgttgaatattgtacatgttacagtagcagagaagcaaggttaatttgttcgaattatcactatttccatttagggggaaaaagggtctcgttcgaatttctccccatgcacacacacggggaaaacaaacatatgcctttgtaccactgggacaacaactaaatccacagaattgttaccttgacagaaattcaattgctaaaatcgtgcaattttttagtcgtcggatgttgtctaaggttcactctggccatgctatccacgctaagattcgtgcatggcaaggaaagataaatttattcttttggatattttgcacatttaatttgttcattgccaaataaatgctaccactctcacgaataaattacttgttcttctggggaagcaccagtggtgtggtggtagagtcgtgggtgcgtaactctacccactatggttcaaatcctggtgctcacaaaaattacgcatatgcaagttggttttcaacagaactttagtgagatcagtatgtgccgctggtttccatcgcttagagcatgtgctaggggacgcattcgcgagggtgtgaaaatggtgttgcacgtgtagtggcgtgtgtgcatgtaagtctgtcgtgtaattaaaaaaaacttgttcttttgataccaattgtatgaagatcaacaaagagtcattcgctatttcttttttcttaattgcgcggtgcacaaatcggctctatttccaatttttttccaattattttctcgctagctagagaacagtatcaaatcaaaagtggcttcctccacatagagaaggaattaaacaagctaacataattccaagatacgatgcgaaagagacgaaatgatcgatcgaccggccggatcgatctatgtcatatatatgcatgcatgcgtatgttttatatgtatgtacatgccaacttgcaagaaactcatcgctttattgaccgaaagcaaggaaccacgtgtaaccactcctctctctttaatttcttcttcccttgattcaccagcaatttaattattaccttctaactaccagcacacacacatattagctctgccttcacgtaccaattaaacatctctctctctctcctaattgcatttttattgctctcttcttttgtgtgtcagtgtgtgtgtgtatatatatatgcccccatttctcgatcaatgcaatctatcgccacatttgaaaacctctagggtcaaatataaacttaagatcgatcatatttcatatagttaactagctatagttagtagtgtgaatatatttattgcctatattaatatatactactccaatatgcaagcgatgatgagctcgaagaagctcttagctctcattctggccatggcgggcatggccgccgccggcctagcctttctgcaagcgagcgcacaggaaggagcagcaaatgatcagcgccggcatgccatggcgtcggcggcggcggaggtgccgtggcgccgcgtgcttcgccatcggccggggaggaaggagcacgtcggcggcggcggcggcggggatgacggcgacgacgacctcgactggcggtcatggcgcatcccgccgtccgggccgagcagccgggggcacgtcgccgtagacgcggacgcgccggagaaggagaagaagacggagacggtgggcggcggcgcgccgtagctggcctagatcatcatcatctgttcatcttccgtgagcagggtaagcttgcaataatgggcaatggacgcttggtatgaattaagaattaattaatcgattaattacatgtcttaatcagtatatatccgtgtgtcctgtgtacgtgtactcgtataaatatacgtttggttgcatgatgtcaagtacgtatactattcaagtgtttatgtaaaagatctaaaaaagagatcaatggagtacgtgctcacatgtatatattttgtggtttttttttcttgcttttcttcttttgcgtggatgtactttatatacacgtatatatgtgttgtgtgtttctgtactgtaccgtctctagattaagagaaattaaatgttatcaaaattaaatatatttatcagaaaaagtaaaagcgctgttcagttgcttagagtgaaagaagattagatttgctgacgaacttaggataggtaagaagaaagggaaagcaagcattgagccggaggttgaggagcaaaggcaagttatgtctatgcaattgcatgctggcaaccatggcacaataaccatgcatgatagatagctttggtgccacgacgcggctagatttctccatacacgaaaacgaaacatgcctgttgaacagtaccaaaagatgttgacaagttattggctaggagactaggaatgtttgtcatatattggtcatatgttcatgagtttcactctatctattttattcatatctttgagttttgtctcgttggtatctatctattatatactaaaagaccattaaacttcctacaaacactctcaaaccgccacgtggcatcctaaaaatactcccgagtcgccgcgtggcattctaataaaatagagaaatctgaccatcgattttcacttaaatagatgggctcattattttggatcattagattatctttaacggaaaaaaaaactcctgccgtccctacctccgtgcaggatgcgtattgtacgctccctatcttcccttcttttttttttatctttgtttctttcttctttttctatccttatgaaaaaaatccctacaaatagacatcgtacgagtaagtccattaaactttttaaaaacactcttaagccaccatgtggctcctacaaacgcttctgagccgccacgtgacgctctgataaattagagaaatctaagaaattccagaaaaaaaaagaaaacatcgtaccatttattttctctttacacaccattagatctatatatgtaaaaaaacaaatgtcacgtacgtccacacctctccctaggtccctcatctcctaacatgtacctacatccaaagtacgtatgtctccccgcccctctcttcttcattccatttatggtagcaaaattttatatataaaaaacacaacaactaaataattagaatatcttataatatattcgattttaatttgaactatgtttaccatattttggtatgtacatatataagaaacatatcatttgacataaacccctttatcgcaactaaatagtaacatatatcatgccatcgtaaatgatctcctattatctctcctgctcactttcttatccatattttctagtgagcagttcagtacataaagaaccaaaaaatgctatattaactatctattatatactaaaaaatcattaaactccctacagatcctcttaaactgtcacatggttttctaaaaccactcataagacaccatatagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctaggatccaattctcatatcctatttttaatataacttatcctattttctacctaacacataatatatagaaaaataataatagctaaatgatcatgactctcaagttacatgtacttttcacagtttatttgactttttgtattatttataattaaattcaagatccatattgcccatatttactatatagaagttagataatgctgctattctgactacaaatatttgagcaaaatagcacttcgaaaatgatgaatgaattcaaatgtgtgggtctaaatccaagttcaatcaccaccaagaagcttggaaccagaatgcaaactctgggcatgaacccgatgaaggcggagctacaagacattattagcgaggtggatactgacggtagcggcatcatcgacttctacaagttcctggacctaataacgcactaaatgattagatgaagggcaaggactaagaggaggggggggggaggggcagagggagacgttccatgtcttcgacaaggactagaaaatagcttcatctttgccaccgagccccgccacgtcctgtctaatgtatcaagagaggctcactgatgaggaggtcaacaatgatccgcgaggctgatggtgacaggcggatcaccacaaggagtttgtaattaaattcagaacaaaaatataaaacaaacaatttgattaaaatacacaaacaaaaattaaaaaaacactaaaactataaaaaaatataacaagattccatgtagaatataaaatatcaagagtcactataaaagtataagttataaatatctaaaatttggaataataaaataagtattaaaagaagagatcaaatacagcacgatacggggaaatttaactatttgccactcttgtgacatggcaattaacgatttgccataccctgtcaatgacatgtgggccctcatgtgtctatgacatgtgggcctaatggcaaatcgttaagcaccactcgtaagaatggcaaatagttaaaagcccccacgatacgagattaagtgcaatttaaaatccctaaaaagacaatttagaataaagtaatttgatttgaatacaaagtcgaattaagaatccctcaatcactaaattcaaaatacaataaatattttttaaaagaaattttctatctttattgattcacatgcataaaaattgcatgtatatgaagcaattaaagagagggctagcagaatggtaaaaaaatatatttcaaaccaatgaaagtttgtcgagatttcttcacgaaaaagagatataataaataatcaattaacagtagaaaatacattactttaattttttattttttagaactattttcggaacaaactaatgcacatgcccgcgcgaatgcgcgggctatcttcctagttaaaaataaagttttgtccggtggctatatgcctttgaatttctttccatcagttgttgactgctacaaaattttaaaataactatattgttcttctcctattctgaatttcttatgcgctacctacttaagaatacaccccatccgttttatattaatgtaagatgtttatctttttataagtcaaacttctttaattttggtcaaacttataaaaaacatatcattatttttagagaaataatattcaatgtataaaaattaatttgatattatatatattattatgttttctataaatatggttaaactcaatgaagtttgctataaaaaagtcaaaacattatataatatgaaacggtggagtatatctgaatgtgaaatttttagttataataaaatcaaaggaaaatattatttgaccacaaatttgaaaagaaaaaaatattttaacaaattttaaaaattgataaaattcatacaaaagtttcactgagaattttaaaactaaaattatttttacctgttctcgaattttggtgaaaatgttgtatgaattcaaaaaaatgatttgaaatttttttaaaattttagtttttatttttttccaaatgattctatttagttttttatgaatgaatttttcacatgagaactgtgtttctcaataagttggcacataaatatgaaaggggcattctagttttagaaaaatataatccaaaaatatggatttggtaaaacatttatagacagaaaacctgtaattagagggcttgaacgtgtataaaaatcacgatcttccgtagtctcttttaccacaatctcgtccataccttaccaccaactatccccatactcgacggtatagcctgtcaagagtactcctaaatttatataccaaaagtttatgctctaaaaatttatatgcccaatttaaatttgaattctgattcggattcaaatgttatatattcagaatggagctatatcagaagattctgcatatatattttttatatgggtaaaatttatacgaataatgtatatttttagaaagaattaattttcccttatttgtagttttttttaaaaaaatatattcccaactttattttcaaaatcaatctacccacatagccggggcccgggggacacggagatgcgatgcgatcacccgcgcgttagccccacccaccctctcatgctcaatcgatcaacaactcgccatgatattaatacgagatatttaactatttgtcacttttagatgtggtaattaacgatttgccattggacccacatgtcatagatacatgtagacccacatgtcattgagataggggtggcaaatagttaaatgccaaatagttcaatgaccccatggaatacggactccgactccgactccgacacgaggaagaagcccatatggcgcacctatatatttgaatttctgtcgtcccacctcctccaacctctcgcccctgcatccacctgcgcgcaggtgctcgatcaacaactcgcgccgcgccatggatccaggcatccagttccgccgtccttgcgtgacctcaacgccgatccccccgccgaagacgacgaccacatcgtccatctccacggcgagcctctgcttaagccaccctacttcccagaaccgaagccgccgccgacctcgacggtggtcgaggccgttgcagttgccgtcgtcgtcgccgccgccgccgcctagccggccacatgccactacatctggagattaattcaagcaatcaagcccctgctcacaatagggcaacgcaacaataggcaaggtaagacctctacctccactgtgctctcaagtctcaaattctttaagattaatttgatttgctgtaagtaaacttttatatttgaaagatatgttcaggttacttcattacttggctgattgcccgattcttcgtattatattggttaaatggttagggtttggtcatttggtgatttggagtaaaattaaagttatatattataatttctagtgctatgaatgataggtgaactttattatggagaattaccttaaaagaaaagtgcctgatagcagcaacaatgcaaggacttcctgtccagaagtaaatgatctcaattggaaagaggagatcaaatatgatcctggattgaggaaaccgattgatgcttatcatcctaacctgagagatagggtaagaagaaagtacctagagaatggtccttgccaacctcgtacactcaattttccaactacaaagatatcagacagaaatagaagctttatcccggaatggtttgatgagtttggtggctggcttgaatatagtgaggccaaagacaaagcatattgttcttttttttcttatttagagactgcaataaaaggaagaatgaatcaaaggctttggttccaaaaggttgaaaggttggcaaaaaaaaaaccaggttaaaaaaccagttcggggaattggtaattttccatatccagccaatgaaaaatggtaaggtttggtaccaacctttccaccaaataatgtgccttttagaattcaaagtaaaaaggttaaaaaggcttatttaactcgtttaaatggttcaattagtgttgctagaaggttattgaagcaaggattacctttccgaggctatgatgagtccaaggattcctacaacaaagggaacttcttggagtttcatgatatgctattagagcatgatcatgctttagggaaggcagtgggtaaatatggagcagggaatagtcttatgacatcttctgatattcagaaggacattgttgagtgttttgcgaaggaaatattacattctatcatggaagaacttgggcatgatgtgttttgtttgctagttgatgagtctagagatgtgtcctacaaggaacaaatggcagtggtgttgagatatgttgataagtgtggatttgtgaaagagagatttattgaggttgttcatgtgaaggaaacaacttcttcctatctcaaggctgcgattgattctctatttgcaggctttaagctcagtttgaagcaagttagaggccaaggatatgacggtgctagcaatatgcgaggtgagttcaatggattaaaatcattgatcatgagggaaagtagttcagcttattatgttcactgttttgctcaccaacttcaattagttgttgtagccattgtgagaaaaacataaaggcattagtaatttctttactatgatatctactttgttgaatgtggtgggtggatcatctaagagaagagacatgattagagaaataaattatgaacaaatatgcaaggcattaggttgtgggatgcttcaaactggaactgggttaaatcaagagcaatgccttcaaagaccaggagatactcgttggagttctcactacaaaactctcaaaagtttgcttgacatgttcccaacaatagtcaaagtgctagaatttgtggaaaaagatgacaaagatagaacaaatagagatcaagcaaatggtcttctagtgtatttccaatcttttgagtttgtcttctatttgcatcttatgtcaactatattaattatcactaacaccctgtcattagcgttgcaaaggaaagatcaagatattgtgaatgctgttaagtgtgtcaaatcaactaggtgccatttggatgatttgagaagagatgggtgggaaaatttacttggtgatgtgtatgctttttgtgacaaatatgatatcatcaagcttgagatgggagaagcatatgtcaatccaaagaaacagaggcaaaagacaggaattacaaaccaacaccattatgaagtggattgttttaatgatgttattgattggctacttcaagagcttgatagtcgtttcaatgagacatcatctgaattgcttctttgctcagctgcctttagcccaagagaatcattccatgattttaatgttgagaacttgatgagactagcaaaactttatcctaatgattttaattctggggaattaagagatcttaggcatcatctttgtctctacaccgctgatgtgcgagaagatgatagattctccaacatacaaactattggtgagctttcacaaaagttggtagagacaaggaaacatctttgctatcctttagtttattgacttttgaagctagttctagtattgcctgttgccactgcgacggttgagaggtgtttttcagctatgaagattgtgaaaagttctttgcgtaatcgcatcggtgatgactacttgagtcatagccttatttgctatatagaaaaagaagaaatgaagaaagtcaccaacgaagctgtggttcatcgttttatgaacatgacagagcccaaatataatttatgatttatgaaaaggtaatttgtttgttttcacatggtttttctatagtttacaatggaaacttaatatgtttatattatcctttgttgcaagatattgaggacaggtggtgtatttccaaatattagtggttttattcatctcggtatggtacgttctttttgtcagtgttcctttgtcggtgtaccatcgccacttatgctatgctaatgagactattgaaaaatatattaactagtataatattgcttgaaaattctgtacattgtcatttatatgtgatgatgtagtgcacccccttatttctctctagcttcgccactggatccagctccgccgtccttgcgcgacctcaacgccgatccccccgccgaagacgacgaccacatcgtccatctccacggcgagcctctgcctcagccaccctacttcccagaaccgaacgccgccgccgacctcgacggtggtctggatggcgatgcagaggcatccttccctggatcgaaccccgaggccgacggccgcgaactcgacggtgatctggagcaagatcactcgttgttcatgttcttggaccccggcgaggtgcgatgccggaagcgcctccgtgcttccgaagaggacgacgtcgacgtcggcgacgctcgcggcgcgccggggcgatgctacgacgacgatgtcgcggaggacgggaggagcacgcagagtcgatactcatggcgaccgaggagtacgcaggcaaggacgacgcggactctgcggcggcggaagaaggtggcgccggacgaggacgaccggttttgttggagctctttccccggcacttctccggcgaggcagatgcagatgatcagagctacacgcacgacgacgacacgccggcggcgcaagagatctccggagagcagattgctgcggatgacacgtactacgacagctactattacatggacggcgagtacggcggcgcatacgacgaggaggagcaccaacaagatgacatggcggcagcggacttccacgacggcaaccagctttcaccggagcatcagcgcgtgttgtaccgcttgttcggcgaggcagacggcagcacgcgccaggaagagcaagaagcggcggcgcagggctccggaggagagcacgtgccaccggaggaggactcgtacgaggccgccgccgtgctcgccggcgacgacgtagacgaggagcaactgcaacggcaagaacaggtggacatgactgacggcacggacgaaaccttctgaaatttatgaagaatcttgagtacatacatgcatgtagattgtttaatgggattattcgattgacctcacgatggctgaatggctgattgatcgagtagctttgctcgatgaatgtaaaatatatactccctccgttcctaaatagttgatactgttaatctttttaaatatactagcaaaagtgcccgtgcgttgcaccgggtgattacggagtgtgtatattgaccaaaagtgttgtttggtttagcaaaagcacctgtgcgttgcaacgggaagcgtacagcagaagaatatgcaattaattaaaatataaattcactaaaatatttggtatttttaagtaggtatgtatataattaaataaaatgatatggttaaatttaattttattaaattctccatgattagtttcgctctttgaaattttattggaattttcagagcttaattgctaattttaataatacaaacattatttaacaattatttaattggaaatctaatttaagtttttgttgggtcggccgacctaagtgcggcccatgaagtgcgtgcagcccatcactgatgcagcccgatgatggaggccggtccgacgcgggagcgatctaagccgttcgttttgatggacggctcagatcgactccaaatctatcaaaacccctaacccaaataaaccttaaccctaatttcattctttcccttcctcccctccacgcaggccgcctctctccccgccggcggccgcaccacacccccaccggcgcacctctctacgctcctccccaaccggcgacgcctcttgcccccctccccaccgccggcggccttccccactgagcagcggcgacgacggcggcagcggcgccctgccctcctgcgagcagcggtggcagcggcggcacactccctcgcggcggacggctgcggcggcgcggcgatggtggcgccgctccctctccccaccgccggctccttctctcctcgttgagcggtggccgccgcaccactctctcggcagatcccgaggtggtggcggcagcggctgtggtagccgccggtggatccggaggtggtggcggtcgctggccggcggcggctcccttctcccctttcgcctccctcctgcccctgatccggcggcgatggcggtgtcggcggcgttggcgggtgggtccgtggccgacggcgaggtggcgagcagcaacgcgctgcagcctccggtccggctcgcccctccctctcctagtcatctcgtgttaatatgatgttttctaatgatttcgatttatatttggactgggatttagcttttgatttggatttggattgtgatgatttgagattggagagaaggtgtgctcaatgtgggattctacttgtgtgatgatgaaattccggctaggtttttttttttgggggggagggacgaaaaatcaccgtatggatgaggtgacgaccggaaaaatccgaatatttatattagttatagatttgaccgttcgtcttattaaaaacttttgtaaaatatataaaactctatgtataaataaaagtatatttaacaatgcattaaatgatatgaaaagaattaataattacttaaatttttaaataagacgaacggttaaacatatttaaaaaaatcaacggcgttaaatatttaaggtcaaagagagtatttgcttgcatatgtactctatccgtctcaaaaaaaaagtctaatcctaattaataacctagacacgtattttcagattcgtagctagagtttgtatttttttatgacggagtagtagatggttgatttgaaaattttggattatattcggcctgaaacgctgggttgaattcttaaatttctggcatgattgatgatcgatcggactgtttactttgagtagcactgcttcgttgcatccaggggtgggaattcggtccaatcgaaaatttcgatctcggtctttggtcttttcggtctttgaaaagtgaagaccgaatttcagcgaaaaatgtcaggatcaacaaattcggtctcggtctcggtcctgaccgaaattcaacaacgttttcatatatgcaaagaaataatggaatttttcaacacaaaaatcacaaaaaaaattcgtaagcactcatgagtaaagactcctattaggttgcatgccaagaagaagtagggatgtgaaaattagagtttaatcctattaaacatactggattataggttgcatttagacatttttgataattcggtctattcggttacccgaggagactaaccgaattgaccgaacaaaattcggtctttcactacctaagaccgaattgatgaccgaatttctcggtatcggttttttcggttttggtctcgatattttcagttcggtctttcggttcggtatttttgtgcccacccctacttgcatcggcttgttctccggccgatctgtttcgtgagtcgtgtagaaggtacagaaaaacaacgtgaatatattttttttcgagggagaaaattttagtgcggtacagttctaaaactagttgtccaatgcaccaggagcaacgtgaatttccgccggctgggccttgagagagctggggaaagagcaaacagaatgtttgagagataaaaagattactctctctctccctaaatataaagaattttggttagatttaatacatgttagattaatacatgttagatatgacacatgtactagaatgtgtcacatccaaccaaaatcccttatatttacggacggtagtactttctccgtttcacaaggtaagttattctagcattttccaatctaaatagatatatatgtctaaattcattaacatcaatatgaatatgggaaatgctagaatgacttacattgtgaaacggagggagtatatccaaattcgttgtattatgatatgtcatatccaatcaaaatcttatatttagggatggagagagtaggtggttaagattaggggtgggcagaataagaccgagaccgagaaattcagttagtaattcggtctcagcctgtcaaagaccgaaatttgttcgggtaattcggttattgggatcagttaaccgaattaaccgagaaaccgaattgtgtcccaataggtctaggaggcccaataagcccaatacatcactaaaccctagaggccacccgcaggccgcatccccatccatcccatcgcgctaccctccggctccgcatccccatcgcgctgccctcgtttccatcccgcgcggccgcaccgcctccgcctccgccaccgcctccatcgcgccacgcttccgctgccaccgccctcagccctccgcatccccatccatcccacgccgccgccgccgcctccgcctccgccctccgcctccacatcgccggtgccgtctccaccctccgcctccgcgccgcctctccggtcgcaccgggccagcggctgccggatccatcgcgccgcgccgccacctccgcctccacatcgccggcgccgtctccgccctccgcctccacgctgcctcgccggccgccggatccatcctccgcctccaccacgaccgtactcccaccgaccaccaccgtatcggcgtcgacagcgtgtgccacctacagctggccctgccttggcttgtcggagcccgaaactaaaaacttggatctgactagaattaatgtatcaatccctagatcagtaaatattgatatatacagtataactggttcttcattgcatacgttaaagttttacaatactaagggttttataataataggtactcacctaactaattaatacacagcagaagtttctatacattctgactagggagatatgacctttagggattctctaagttatcagggtcatcatagtaatagtcataagggtccttctcttgacccagatctgaaaaaggggttataagagcaaggatgagtattcgcaacactcagtaagttatcatggaaatatgttatgcattagtatatagtagggttctttgcaaaaagcagtaataaacaatctaggaaagttatagttagaatttataaaacatatagactttagatttctaaccagggtaccatatgagtcccggtactcaactccatgagtacggctattcgaatagtttcaaagatattctactgcagcagatgtacgctttacccgcagtccacgacttgctgataatcatcggctttagtcatggcccaatattaagtcattaacaattgtggcacctgttccatgaactcatatcctcatatgctctaaatgtgttgttaacagcagcaagaggagttctggcattcccgaggtatttaaggggaactgatcatatgacaccacgtcatctcgatcagggtttagaaatataccatatagtttatagtcgactatcacaaaccatttacctgtacatggtaatggttaaagttgcccttcgcggctatagttgcctcctgtgtgaggacttaaaaataagaaccactatacagaggtgccatattgctaattaacataataactaggtatgtccctattctagaaactgcggtcgtacccgttcgttcgacataagtacctggtaaaacttatatcgatcgagacagtactagccacccggaaatcaaccaaatcttacttactctcccaatctaagtataaggtattttaaccagattgtaagcaaagtaagcaatactaaattatctgggtttctatgattgatttatgcatagaaaatagaatattggatataaggctataaataaataatttgtaaaatataggcttaaatgatcaaaaggtatatggtaacttcccttgctcgttgtcctgagattgattgatattatctattgagtcagaagaatcctcaagacctagggttagacatataaaattcaaattcaaaagaaattcaaattaaatccaaaaataagaaaaatagagaaaataaaataaaatgtaaaaatagcaaaaaggggctcaaaagatagagaatgattttagaagaatattggtccaagtttcactggaattggatatatattttaaaagatatgggcttctaaagtttgaaaatcaactaaaagtgaaatgttactatgtgcgggtcccacctgttagtctctctctcttctcttcttctacctccggccgttccccaaatcgggccggcggcgctagggttagcgattacggcggcgatggagggggaaaggggttgcagccaaggaggggagggagctggggttctccggcgatggcgagcggcggcggaggggttaatttgatgtatggataggctagcgactagggcggcggtggtacagttaggccgtaatagtgatcgaggtgatatgagttagacatggctaggggaggggttctagagcatctacgaggtacctagatagattctgatagcttgtcaatctttggcaaggcgcggagaatacttgccgacgagcgcctccataggccttggccgtgctcacgtcggcagcccagagggtggcatggtagtgcaaagggattgctaaaatggaatctagggagtacatagatggttgaaacggaagaactcaccgagatatgccgagatgaaggattacggtcggaaaaacttctcggcggcgaagaatagagcagcgcgggggcggcggtgctcggcttggtgcggcgaggtaaaactcgatgcagggcttcggttagggtctaatatactagaacatagttgatataaggtgttctaagaggtatttagggcggaggatggatggaggggtgtggagtcgatcgcgcacaaggtgttcaaccgacgggcgatggtggttaatgagatggattggtgaagcacagcttcggggttgtggggttatgg

SEQ ID NO: 11522 - DNA, 14339 bp, Oryza sativa
agtcatccgggagagtggcatttgagaacacgccattcgggagagtggcaaatagtccaaaaccctgtcagagaaaaaataatttgtgtgacgatcctttaaaaccgtcggaacaattggaattttccttgacgtggatgagataccgtcagtaatatgagttttcctgacgtgaacgtacccgttagtgtaaaaatttggggtcataggaaaggttctgtaaaataaaattgtaatggtgtgcgaagaaatgagacagagcaccaatattttttggcatttcgcgcgcgttgaatttcggtgacttgttgggaccattagggaatttgcaagggcattaaagaaatagaaacacaccactctccacctaccacaccaatgcgccactatatctgttcagactagggtgccaaatagatgagtaaattgcatccacggtgcatcaacttggtaggtgggtgtaatttggtataagaactacttgagaaatgagagttctagtataacaacttaataggtaggtgcaatttagtataagaactttataaatgattatataaatgtaaaaacttttaagataggtacgattttgatacagtaaactaagaaattatgcgacaacttaattatttggagaaattttttatatagattcatttttaagtaattattttgacaatatactagcatggatttgtataagcatatttatatttttatcctaataacccataactgaaagtcaattaaactggatgtaaaaattattatatttcagttaatatttgagaagatgaagaaaacaaaaaaaaatcttaaagataattggatgtaaactatatatgtaatataattcttaaagattaaattcaatatttaaggtaatatctgtaggattactgtctaatagcatattgacatcgtgaaacaactcatctagcatatgcttagccaagttgatgcaccaaaatatcgaactatcaggttcttatatactagatcgcacccaattgtcaagttactgtactcgaacgttcaaatcttaagttcttgttctatatcgcatccacctaccaagttgttgtactgtgggttcaatttactccaaatagattaaagaacttcaaaagccacaagctacacaatccaatgtggcctcaaaccagattacacatttggctactcagacagcccacagtgggcgtcaccgaagcccacggagccgagctctccagccaacgtgaaattacgtgcatgccctcaaaatggaataagttcaccggaggtccctccacttaacaacgagattttttgaggtcccttaatcacaaaaccagaaatatggaccccctaaactctcaaaaccattcaccggaggtccctcggcagtatttttgtccgattttgctgacgtggcatcttagttagaaaataaaattaaaaaagtgggacccacatgtcagctgcacatctttttttcttctcttttcttcaccttctcttctctttactctcttctctccggcggagggcggagtgacgatggcgagcgtgaatgtgggaggctggcggcgagcgagcgcggcaacggtctacgagtggtgggcagagcggcggaggacgagcacggcagcagccggccacctttcccctcccccatctagtcatctcccgtcgaccacctctccctctcccatcctctccacgtgtcacgccggcggaagaggggggagcagcgatggaggaggaggggctgaggggataggcgcctcctccaaatcgtcttctacgacaatgagtatgtcgcctaccacacgacattggagggggcgtaggttaggatggacatgccgaagccgcggtacaggccgtcggcggccacgatcttgcggaagacgtcgaggccgccgcggtagtgggaggccgggcacgggttcccctgcaccatgaggctctggctgatgacgtcgacgggtgttcacaccacatgcgccgccatagcggtggcgatccctgccgcggcgcccgctgccgtggaatccacgtgctctggcgcgccgagggcaagcgctggacggttcccgcgagggaggcagcggtggaggaggcgcccgtcctctcaaccaccaccgccgatgcggcgctccaccccctctcccgccggcctcatctccgccctctccggccggcaccagctgctgccgcgccaccgctgccgcccctccgcctgttcctcccgagcccgaagccgctgctcgcccgctaccaccgctccaccgccgcttcgctgccgtgctcatcacagtcgcactcgcgaaccgccacctcgcccgccgaaccgccgcgtccctgctccgcctgccttcggatgcgtgtcgctgttgctccccctgtgcgccaaagaaaaaagcgatttagaatatcagtgctgactaggattgttgacctaacatttttatgtcacttacatgtggtccccacatatttattcttatttttttgctaactagaatgccacgtcagaaaaaccggacaaaaatagtaccgagggacctccagtgaacggtttgtgagagtttaggagtaaatatttggtttttttggttaagatactttaaaaaatctccggtgaacttattctccctcaaaatcgtcatcttctctgccctttgacgcggtctcgctcgcgaccgaacgcgtctctcgctcccgttctcgacaacgccgccgcctcccgctccaagccaccgccgccgccgccgcctcccgctccgagctggcgcctcctcctcagccgccgccacccgcccgcgcgcctcccctcccctcctcctcctcctcccccgccggtcgcgccgccagcggggccctctccctctccgccctggccggcggagcttgagcttgagcgtcgatttggagttggccggtgcggcttgacgcgtacgaggatgatggcggcggcgacgggaagaagaaagcggcggcggtggcgagtgctcgtccgtcgtcgtcggcgccgatccggccgtccgactacacgcacagctcggcgcaccactgcgtcgcgctgagggacgccgccgggctggcggtcccgccgctcgcccaccggagccgcatcctcaccgcctccgacgccgcccgcgaggcccgcctcgcggcgcttgaccgccgcgacgtccccggggtagcgacggagagaagccactcgccactgacccacaggtacgttttgcaactggagagttgggtccagcccaacaagttctcggcccaactatccacgtacggaacagaaggcgcgattctagaccatcgaaactgtcaaccacaggctacttcgcatcgcatcgcctcaccccgccgccgccgccgccgccgtcgccgtcgcggtagctccgccttgagactgacagaggccccgtggcgccgctgcccgccggtcatgccgctgcggcgcggagccctccctccccgcgcccctcttcggccggcacccggcggtctctgcggccgcgcgctcctccgccggacctgcagcctctcgtggccggcgacgacgggcggagcggcgctcaggttagcccccgacgccgctgctcgctgtcttctcttctcttctccagcgtattgaatttctctacctagtatttctgtaaaaaaaaaaatcccaaaaatcaattgggaattgggttccattggactcgtccagaactttgggtcagttttctgtcaacaggaattttggaggagctggtttacgaaagttttaaatctatgaacagcatttccccctactacaattaatttgcatacacatttctactcggtggcaccattgataagtagatctagctttcagtacatctttttatgtttatgatgagttcaatcatttatacaatgcatctttgctgactatcagtcagattatattgaagaatcatatatttgttgatataagctggacacttgaagaaatacatttcagttgacataggttggattattgactgtttaaaaggaattcaataagggctcacccaaacaaaagaatggaatagacaatgaagtgtaattaggtttcaccgcacgttgttaggaaatgcatgggttcaagttgtgctctccaaggtgacatggatgcaaaatgtagcctacctagatctcgtttagcatcttcaaacagaaatgttattatgccgcaaggcatacaaaatacaagaatttggcaggtaatcattatataataagaacttgtggacagtcaatcttgttactgatagtacccatttttcaatttatatggtatctacctattatatgcataaactattttcaataaaaaaatagaaacaataaaagtaatccatctgttaaaaaaatatacgacacttcggacatgatatggtatcaagtgcataaattggaccatcaatttgtatagtaatgtcatatgtgttggcaaaataactgtaaatgtattgcggtgccaaaatatttcttgagccagtttagttatacttttttcacatgataaatataaataggttttctatgtagtggcggtcaaacttaggaagatttgactagtcaggttaccaattttatattcttttggggatgggagtagatgaattgctgatgtgtccatcctttgtggaattatttactagttagcttcatgactgaaggtttgtagagattgagaaaagataaaagattgatgcaatcaatttcttcagatctctactatgcagaagatttggtagttgacttgatatctgcactctatagttaccagatgaaaaattctagatggaagccagtatttgccttggaaacaggtggaccatctaatgctgatagccaagacttcgaagatgatggtggctttcttggtagaacaaggctgggaaggctcatccaagctgctgggagggaactacttgaaaagctgaactctgccagaagcaactcccccacgaagatattccttgtgctgtttggcttctataccgccaacgcattggcaacaatcctagggcagactggtgactgggatgttcttgtggctggtgttgtagtggctgccatagagggaattggcatgcttatgtacagaaaaccgatgagtagacctcctggacgattccagtcattgattgcaatggtgaactactggaaagccggcgtatgtctgggcctttttgtggatgccttcaaactgggaagctgagttcccttcccactatcaacttcttgtatcaacttactaatgttattgattcattgagctcacaatgacacgtggaatgaactcccaaggctccaaactgctaccgtgttgttgtatgcagataaatttgctgcgaagcgtaaacattacttctcggctataaaatgtacatatgttgatgtagtcttctatgaaattcttgtagtattacactagtctgatgtccatatgtgtctatagataaataatggtgtctgttgtaagatgactattgttggctatttccacaccaggcaaaccatttaataagctgcttctctcattgattattacccaaattgttctgtatttctgtctggctagtctctcctgtctaaaataattgttttgaaagtaacattttcacttattggttgtactacctccatttcacaatgtcattttagcatttttcatattcatattgatgttaatgaatctagatatatatgtgtgcctggattcattaacatctatatgaatgtgggtaatgctagaatgacttacattgtgaaaaggaggaagtaataattttctcagatgaagtttggtgttaaacagagcttctatacatcactcccatgtgacgactgcacgaatcctgaagcacatcaaacgggtatccatcagaactcacatactcaatgccttcttactttccccacgattgctatgagcaggtaaaccagtgaattgagaatttttggcctgagttgagaagattaactatatttcaatcttgttttgcctgaattcaaaagattccctttatcttaatctttttaattttgccttgtgaaatccatgtgttctagatatgccaaaacaaagaaattttatggcattgatgtacctgtttgaattaaatgaccatcttgactagctgatgaccactgcaaatgccttccattctccgccatcctaaagtgttgatgcacgacccacgatgggtgtgggatgaaactagtctataacaattatttaagggcgcaaataaataaataaataaataaaatattggaaagctgaaaattttatataaaaatgttctttcggagggctgatggagaaattttttagagaaattattgtttaggagcttaaaaagtaaaatatgcctatgatttttaagtaaaataatatgcctgtgatataattcataatccgtaagccgaaaaatagtactggggcaaaaaaagttatatcttctgcaagcaaaattattaaactaacgtgagataattttctgccgatgtcgaggaaccaatagcaaaatagccacaagattagaatgacatgataaatgaccgatggttatcctgacaggggaattatcttctagtagtattggtttagcaaaaaggtagtaattcatttagcaaattttgctagacaacatcatgaattcacggttttacctgtaggatatcagacaaagttaattttgagggaagacaccatatagacataaaaattagctcgtggacactacaccattagaatattaatttttggttgagtaggagaaaaaaccgtgtgaaagttctgaattacccatgggcccacatgctaggcttgccatctctctatccttctctctctcgtacatggaatccgcatataagcctctactatctttttccccatctacttcctctattcctctcactctcgcaggaggcaaaggtgagagagtgtctcggtgaccggcgacggcgaggcgagctagatgctggttgggaatggtggatcgtggaaggagatgagctcctactcgacatcatctgtcatagtccactcggcatcggcgcgctcctatgggtgtggcgcatccacacggttcacgctgcagcatgtaagcagcgagggagggggggcccaaaccatgcaccgacatgggagtaagcagagtcatggagaggatgggctccattccccccgggtgtgcgactgtgatgaagatagtcagagggtgacgatccagctcccgacaatgggtcttgaaagcagggacgccacaagtggtggagacctaagatcgcgtgcgaaggacgactcttaccacaacccacaggcgccatgcaaggaggagcttggggcggtgaccggccagaggcgcaggtggtggtagacgagcagaacgggaccaaagtggagctgcacctactcagatagtcagatccaatggttcaccaattccaactagttgccgatgaaggtaggcttgttattgtgtgcttggcgatgcaatgaactaggcgtgcaagagctcctctccttccacagcaggcagcatgtgggttcatgtgcgagagagagatagggatagagagatggcaaacctaacatgtgggcccagtggtaatttcataattttcacatgatttctctcttattcaatcaaaaattaatattctaatggttgcggttcccatgagctaatttccacgcttccaaagtgtcttcccctaaaaatcacttcgtgtggtgttctacaactaaaaacgcgaagtcacaataccctctagcaaaattttccaattccttttcgtcacgagtgagaatctccttatttgacataacttatcaaattaataagtatcacaaaatataaaatgtcctaggatttttgaagaggtttaggtaaacaagaaaaaatatactataatatctctcgttaaatacttaaatgaggaatatgtaacgagtgaaggtggttggagataaggatggatgaaaattaattaaataagatgtgattatatgaaagaagtaattaaccctattttcttatattatatgacaaattcatgataagatctattttaaggctgtgttcggaataatttgttcccaacatgcaatttgattttttaagcaactttcctatagatttttttttgcaaaaaaagtaccgtttagcagtttgaaaagcacgcgcgcggaatacgattgggaggggttgggaacccagggttccaaacacagcctaatttgtgatgagtgatatctcggttcaattaggatgtggcctatgttacccatgagcgttgtgtgcccttgatttatatgagcaagagtagaatctcttataagccctccaaccataccacttcctttttttaaggaaatcatgccattttcggattaaccattttatacgaagcgagaatgaaagtgtaaatgaggtgctatacggatggttggtttgcggttctggaggatgggttgtccatccaaccatatcgcttttgggttaaccatttacacgaaatgatgatgaaagtgtaagtgaacatgtctgtcgaatgaaagtataagtgggtctacctgttggatgggctcaatactacttccaagttaatcattttactcgaagtgagaataaaagtgtagggggtgctatgtgtcagtgttggaattaatagatgggctaaggcccattcgaagattaattctttgggaaatcacaaaagcccacctcatgggatggcatgcatgtggagtttagtaccaccttgcttattctagaagagggaggcctcctgaaaagggaggatgccctcctagccacttgaagtatgtgtggtggagagaagagggggaacacacgcgcgcgctcgctcgcctcgcctgggcagggcaggcggcgcgcacgacgtacgcgtcgaatggtccgcaaagttggctcctcacccttgcgcagatgcagcctcctttttgcagttttgttttgctgcaggaaaattcggatttgttttattgttggaaacattccgaaaaatccggtgcgtgaaaacggcgtggagtccggataagttacgcgcgacttatccggctcggttatgcagagtggagatcgtgcgggcgccctgatcaagcgacctatctctatataaactgtgccgccaccttcacgcaacacacacgaaatcaatctagggtttgcctcctcctctgtgttgcgccatcgctcgtagactactccatcccactcgccagcgtgcaccggcgattgggagagcaggtcttcggaacctctgccttcgacgtcctgcatcgggagaaggcggcaataaggtttttgggaagcgcttcgcacgactgcttccttcctgttcgtccgcgacggcttgccttcatctccgctcgcgtgctgcgcgccttcgttgatgctcgcaaccgcgagtaattcctgccgagcaaccggtctttccgccacctcggtacgtgttcgacatgttacgcatatttgatctgttcatgttttactgattagtttacatgtgtagatctaatgatgcgttaatgctagtatacatctgtaatgtcatgatttatttatggaatatattaaatcattatatgcctatattctcaacaatccaaaaaccttatgataggcactgtgagtttactatggctggttttgccaatgcactgaggccggataaatttaccggtgtgcactttaagagatggcagatcagggtcactctatggttgacagctatgaaatgcttctaggtgagtactggcaagcctatgggcgttcttaatgctgatcagcagaaagaattcgatgaggccactactctctttgtgggatgcattcctagcgtgcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgcattattgcgaaactacctccatcttggagaggtttcggtactgcactcaaacacaagagacaggaatactccgttgaggggttgatagcgtctcttgatgttgaggagaaagctcgggaaaaagatgtcgcgtctaagggcgatggtgggcagtccactgccaatgttgtgcacaaggcccagaacaagagcaaggggaaatacaaagctcagcagaccaccaacttcaagaagaagaacaacaacaacaatcctaatcaggataagaggacttgctttgtgtgtggtcaacctggccatctggccaggaagtgtccacaatgcaaggggatgaaggcacctgcagggcagacctctaagtctgccaatgtgaccattggcaacactggagatggaagcgggtatggtaatttacctactgttttttcagttaattagtctactaattggtgggttgatacaggggccaatgtacatgtttgtgctgacatctcattgttttcttcttatcaggtcgcatggggttccaccgtcctaatagggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatagatattttattggtaaaggttatgagtgcggaggcctgttctgcttttccttttctgatttctgcaataagtctgtgaaccatatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctaaagagagaaacttggcacctctagaactcttacactcagatctctgtaaaatgaatggggtgttgacgaagggtggaaaacgatatttcatgacgttgattgatgatgctactagattttgctatgtgtacttgttgaaaacgaaagacgaggctctagactattttaaaatttataaggcaaaagttgaaaatcaacttgacagaaagataaaaagacttaggtctgatcgtggtggagagtttttctcaaacgagtttgacttattctgtgaggaacatggcattatacatgagaggacgcctccctattctcctgagtctaataagattgctgaaaggaagaaccgcacactgaccgacttggtgaatgccatgttggacaccgcaggactacctaaggcatggtggggggagacattgttgacctcgaatcatgtgttaaacagagttcctaacagaaataaggacaaaacaccatatgagatatggattgggagaaaaccatcactttcttacttgcgcacatgggggtgcttggcgaaagtcaacgtatcaataacgaataagcgcaaacttggacctaagactgtggactgtgtctttctgggatatgctcactacagcattgcctatagatttttaatagttaaatctgaggtacctgacatgcatgttggtacaattatggagtctcgtgatgctaccttctttgagagctttttcccaatgaaggatacacatagtagttctagccaaccctctgaaataattctcagttcaatcacaccaccagaacaaactgaacatacacatgaacatgtcactgaggaggatgacagtgaagctcctcgaaggagcaaaagacaaaggacggttaagtcttttggtgacgatttcactgtgtacctcgtggatgacactcctaagtcaatttcagaagcatacgcatctcctgatgcagactactggaaggaggttgtccgtagtgaaatggattccattatcgctaacgggacttgggaggtgacagagcggcctatgggtgtaaacatgtggggtgcaagtgggtgttcaagaagaagctcaggcctgatggtactattgaaaagtacaaggctcggcttgttgctaagggctatactaaaaaagaaggcgaagatttctttgacacttactcacctgttgctagattgaccacaattcgtgtgctactttccctagcagcttcatatggtcttctcgttcatcaaatggacgttaagacagcttttcttaatggagagctagatgaggagatctatatggatcaacctgatgggtttgtagttgaaggtcaagaaggcaaagtgtgcaaattgttgaagtctttgtatggtctgaaacaagctcctaagcaatgacatgagaaatttgacaaaacattgacatctgcaggctttgcagtcaatgaggcagataaatgtgtgtactatcgccatggtgggggtgagggagttattctgtgcttgtatgttgatgacatactgatatttgggacaaaccttgaggtgataaatgaggttaaatcattctgatatgaaggatttgggagtagttgatgttatcttaaacattaagctaattagaggtgagaatgagattacacttttgcagtcccattatgtggagaagatcttgaattgctttggctacattgatagtaagccttctccaacaccttataatcctagcttgttgcttcgcaagaacaagagaattgctaggaatcaactggaatactcccaaatcattggctcgccgatgtacctggctagtgcaactaggcctgatatctcctttgctgtgagcaagttgagctggtttacctctaatccgggagatgatcactggcgtgcgcttgagcgagtaatgcgctatctgaaaggtactatggaattgggacttcactattctgggtatcctgcggtactagagggatatagtgattctaagtggatctctgatgtggatgagatcaaagccactagtggatatgtcttcacattgggtggtggtgctgtttcgtggaggtcttgcaaacagactattttgacgaggtcaaccatggaagcagaactgacggcactggatactgctactgttgaggcagaatggctgcatgatctattaatggatctgcctattgttgaaaaaccggtgctggctatccttatgaactgtgacaatcaaacggtaattgtcaaagtgaatagttctaaggataatatgaaatcgtctagacatgtgaaaagacgattgaagtctgttaggaaattgagaaactccggagttataacgttggattacatccaaacagcttgaaacctggcagatcccttcacgaagggactatcacgaaatgtgatagataatgcatcgaaggagatgggtttgagacccatgtgagttatactatggtggtaatccagtctatgtgatcggagatctcgtgaattagaacctgggaagaacaaaccattagtaaactagaggagagtaccaatctataccctctctaagtgaagatacatgtactctcgtgagctgcaaggcaggttggctatgccttaatgagttctgttggctttaattagcgaagatgttgtcctgcagagcattcttgaaagaactcacctttgtaagcttgactgttggccgcagtctattaagattttgggtgaatcttctaggaagcttactaaaaacctaggagtatgacttatacgctccacccgaggggtagtctacagacggtctagtaccagataagactctgagtgaaacttgcttgcacaagacttgcaattcaaggcgtagtccattgttcaagttgtgagttagtgtagcttggagttctaggtggatgttcaaccttaatcggtctccatcgaaccgctggtatataaacagtacattggaaaaggcaaatctcagtgggattttgagatttggtgggggattgttggaattaatagatgggctaaggcccattcgaagattaattctttgggaaatcacaaaagcccacctcatgggatggcatgcatgtggagtttagtaccaccttgcttattctagaagagggagacctccttaaaagggaggatgccctcctagccacttgaagcatgtgtggtggagagaaaagggggaa

SEQ ID NO: 11523 - DNA, 5308 bp, Oryza sativa
cgtgcgggcgtcctgatcaagccacctatctctatataaaccgtgtcgccgccttcacgcaacacacgcgaaatcaatctagggtttgcctcctcctctgtgttgcgccgtcgctcgtagactactccatcccgctcgccagtgtgcaccggcgatcaggagagcaggtcaccggaacctctgccttcgacgtcctgcaccgggagaaggcggcaataaggtttttgggaagcgcttcgcgcgactgcttcctgttcgttcgcgacggctcgccttcctatccgctcgcgtgctgcgcgccttcgtcgacgctcgcaaccgcgagtagttcctgccgagcaaccggtctttccgctacctcggtacgtgttcgacatgttgcgcgtatttgatctgttcatgttttactgtttaatttacatgtgtagatttaatgatgcgttaatgctagtatacatatgtaatgtcatgatttatttatggaatatattaaatcattatatgcctatattctcaacagtcagtgtgtttgcctgtcggatagactgggctgcacggttctggtagagcatgagtaacaatcttccaaataatcagtcaatcgtgtgaaatttgattagagataaataagtaaattttacagagtttctttttagattatataaaagatgcacgctcaccgacctgggatgcatatgtaaaaatccttgtataatgcaatagtcaatttggcatgcaagcactgacagagtgacacaagaaggtttctttttcccctgatccaaggagcaaagtgacaaaaatggcattgcatgcgccacatatagctggcttagccattgctccctctttggtctctttcccccaggtcacccggtcaccccttcctacgtatttggcatcatcctcctcgtgatgctatcttttgccatctcaattctttctcatcctaggcatcgatattcgtatttgtattgatcgtttcgaatatcggttcactttcaaaaatataagcgtattttcggttacgaaactaaataagatatctgatttctatttatgaaattggatgaaggatatatcctaatagatttagaataatactccctccgtttcgtattaatgaatcgctttgatttttctattagttaaaatttataagtttaatcaaatttataaaaaaaaatataataacattttcaacctgaaacaaatataatattaaaatatattcaatattacatttaacaaaattgggcctgttcggctgccgttcagcagcgctgctgctgctgcaggctgcagcggtaatttgtgttgtgtggctgcagccgtgctgcttgttgctgtgcagctggcagccatgtagctgtaaaaaataccagtcgaacaggtccattaatttagcgttgtaaatgttgctaaatttttctataaacttaataaaattttaaatttttatttagagaaaaatataaataatttataatataaaacgaatatgttattacaatttagaagcggtgggaatagctagctgccctgcagtgctactcctgcagatcgatatgcagtgtttctggccgccggcagcatgcgtgcctgacgacgacgtggcgatcgacaggactagctagctatcctgacctgtgggccctgcttgacaggaagagatatatcctcctatttttaatactagatgtcgttggtttttgatcatttattttattaaaaaaatatgtaattattatttattttattgtgttatgatttatcattaaatatttttcaagcatgacataaatacttttatatttgtataaaattttcaaataaaattaatagttaaagattgattataaaaaaaatcaacagtttcgtacattgaaacacggatatagtatgaaacgatgatggagcatatgcatgcatgtacgtgcatgcatgagcagaagagaggagggagaggcgcatatggaccagcagccggcctgtacgttgccgttggatgaggcaagaaaacgacgtgtcatgctgcatgcttggcccttcttccacgatatgcaatctgccactgcttgaaaatgcggcatgcatgcttgctttgcttgctctggcattttcgttctgtcggtcatgaactttggtttaatttggtttgtttggagaagaaatcatattccgcggtaattctttcacacgccaattgatggataaattaataaggaaaatgctacaacatggtatacttttggacaggatgatacttttttaaggtatcggctagttgatatccgtttagacggggtgatatatttgagatatcgattgattcatttttttttcaatatatatgacgttgttggcttttgttataatatttggccatttgtcttattaaaaattttatgcaaatcttaaaaatataagtagtgcttaaagtttattagtgataaatcaagccacatcaaaacaaaatatatttatttaatttttgaataagacgaatgattaaacatgatgtaaaaagttaacggcgtcatatattaaaaaacaaatgtagtagtattatttatcgatcatcttgcttttttatttaaatttcatttacttttgaatatggcctggattactttaatgttgtgccatcctcatcgcttatccatcgctgtttgatgggtgctagctggagcttagttaaagacaattatcaggccattacaagcacgtgattgtccacgtcataacaactagttacgagcggacctacaatgggacatgggacatgggtacatttctatcccaaatttttgtaaaaaataagtgattttataggtataatatgtctatataccattacttgtgtcaaaacaagcacacttaatcccaaaatcattctttctaagggtattaaacgtattttctagcttagttacgttgttttgtaaattttcctgtataattggtctctattaatttgcattgggatcaaaattatcacttgactttcacttatagcaagtctttttttattttttttggagtatttaactatgcttaagtgatgttgtatctttatcttagaaatcttgcatccgccactgaactagttgatatttcgtgtgttgatacgtgggtataagaattcttttaggaagaaacattgatcggtctaatgttcaatgtgtattagacatttcaatctaatggctgacccaatttgatgacgtagttaaatgtgagagtatttttttaagctattaatatagctgtgtatataaataaatgataatactcgactgagatttggagatctattgagtagtaaatcttttacttttaaccatgagataaacctatatacttatgcaggtatctattaactgtgcttttatcatcttgactcaaaatggcatcgatcttatcgatggataacctaaaaagtgcttaatttgtgtgagccccatattattaaccatctaaattaagcatcaagaggaagattgtgtgagacatgcatctcagtggacaaacacaaattattcactaagaaaaaaaaattctccacaaagtaagcagcggttcatgagttggccggtatcccgggttcgtactaactgaaacccacacatccaaccgcggttaaccgcgctcacgccgtgtgctagctagctcatgcatgatgctgatctcatgagtcatgagccactgcacggcacggcctatctcctgctgctgatctctagtccacttcacgtacgtgccagctgccagcaactgttggtacggtaccttgcttgcatagagatggattgtattctctggtgaacttccatgatccaagttactaaataattatgaataaaattcaaaaatattgataagatatattaatatataatactcctatatcattgaaaaaaaatacaatttcaaatttaatttctacaagttataataaaaataataaattaaactctaattagtatacgtattccctgtcaaatttaacatggccagagagactaagggggtgtttagatggggctaaaactttttagcccatgtcacatcggatgtttggacgctaatttagagtattaaatatggaataataaaaaaactaatttcataaatgagagctaatccgcgagacggattttttaagcctaattaatccataattatcaaaagtttactgtagcatcacattgtcaaaatcatggcgtaattagactcaaaagattcgtctcgcgaattagtccaagcttatggaatgggttttgtaattagtgtatgtttaatactctaaattaatatccaaacatccgatgtgacagggacttagaataagtccctgaaaaccaaacagcccctaataactgactgcacctagcccttttaggctaggtaagcctagcagtagttcctctcaggaaatggtagttattagatttatagtgttatattgatttcatacggttgcactttcatagttaatgaccgagtcaaaccgatttgattaatgcggtacatcttatcacaaccatgtttgtctaatcaatatcacacataaattaattagtaacaaataatatgtgttacctgtacatataattgtgtctgcagttatgttgattaacgattatttttatagcaatttttatcaactcctatatgcactgtaaatggtaatcctagagttatacaatcgtgctatggaactaactggacgctttacaatccatagctctatctagtgcgttacgttgtagatagattactagagatattaatgttttatttacaccttgaatgcatgtacagttgtagttccatggttacgtaaccatgtgctagacccaattgaaccgtttgaaatcttttgttttgactgtgcagatcaattattatagataacaatgctctattaatgcgtagcacgtccaattttacgttctatgttactagacaaaccattactgttgtcacggtaaagattaacataatctaattgtctaatcaatgtcacgcgtaaatcgacaaagaaggaatcacatgtttaatttaaactatccaatactacatgtagtcattatgaggataaaattgcattccatggccgttacacaaccagattaaccgttacggtggttattgtggcaaatttaatatcgtccccttcgtctaatcaatgtcacgtgtaaatcgtcaaaggagatatcacgagatacgtttaaactatccaatcgtgcagacagtaactacgataggcagttaatcaatgacaacaattctcgttattgac

SEQ ID NO: 11524 - DNA, 2484 bp, Oryza sativa
gttatcattgacacattgaacagtgacagcaaccacactagcgatatccatcttctcccccaacctcatcaaaccaaatcatacacatcataccaaaacccaagtcatcaagggcacccccaagaacatatccaaaacccaagccggccggtcgtttgaccaccactggtccagtagcacaccaaccccccacagtcactgacaccctggccccaccacgcgtcacctgaccacccacgccgctcacgcttggtttgcatggattagcttagcttagctagctgctgctaaaaatggccactgttcactaaggcgataggctagttaagccactgcgaatgcattccattctcggccacccccgccttaactgcggcggaatcattaccggccacccccgcgcgaaatgccgcatttaccctcccccgcgcaagaccacccaggggtagaatggtcattgcgcgtcctccggccgttactgcttctccggcgtatttatacgccgcgcctgcgaggctgacactgcagagcgcgcggcgagcttgcagcggcggcgacggcgagcgcgcaccgccgttggcttcctcgtaggtcgcggcggtgaggtgaggtgagagggatgatgaacggaggagggggagggagggtgccgacgtggagggagcgggagaacaaccggcggcgggagcggcggcggcgggcgatcgcggcgaagatctacgcggggctgcgggcgtacggaaactacacgctcccgaagcactgcgacaacaacgaggtgctcaaggcgctctgcaacgaggccggctggaccgtcgagcccgacggcaccacctaccgcaaggtccctcttcctcttcctcttcttcttcttgcaaattaattaagcgatttctcgtcgaatttcatttaatcttttgctcttatatggaatggatttcttgcttaatttgcgtcggctgtagaggagggtaccgaatttttctcgttatccatgattgcctttttggctttttttttttattcctcgttcctgcaacgcggcgcgcgtgctctctcctctcctctcctttctctcctctgcttcgtcttcctccttttactccgataatggcgggggaaattctctcctctcatctcctcttttctttgcgtgcgtgggacaagccacgcactaggagctcaggattacgcgtgccgccgcgacattccgtggccgtttcctggataaaaagcgttcgttttctttctcttttttttttttggttttgtttctttgttgtttttggtattaaaaagatcttccgttatctgaacaaaaatggttttagattgttgttgatttcatcttcttcatctgtggggtggagagatgatgctgtggcgctgggtctttttagcaagatttagtgtctttttaggcagggaaaagaggtcgtagtagtagtggtgctgtacttaaagctcatcactttgttttctttcttttttttgttcttattttatttttgtcttggcagaagagcagtactagcatctttttggttgtagtactagctctgaagtctgaacattgctatcaggatcttgtttgcagaatacaatgtatcaaatctatctgttttcaagcatttctttttgttatctatggtgctttttagatgcctgctcttcttttaaaaaaaaattaaggattagatcatctcttcttttctgaagtctttggatgacaagttggctgacaagtgaaaaccgaaaaaaactgaagtgctacttgttttcgattgaaaagaaatgcaaaataggatgtggcttgcacgcgttagtaactgcatggttagactgccaaaccaatcgcttttgaattaaggtgtagattaatacaagaatcaaagattgttagtttttggtcaaagctagtacctttacagaatccatctgccctgttttgtcaaagtaagtctaagttggctgcaagctctgcctctagataccttgagtaaattctctttttaagattagcattatctctatggatgcatctatatgtagtactggagcctggacagaattgaagctgctcatgtgaaaaaaggactggtgaaagaggcaattatggagacaaaagttagtggcatggtcataggcagatagatatgggcatgaccgaatattacatcaaagaaagctaaggctgtcacagaagcctttgatttcagaaaatcaactttgcattacaaaatgacaaattctacccaagtatcttctttcttttattgcaatcggctttttagagcagtagttgtttttttttttgtgtgcgtttcactgaggattttaattacctttcagttaagtttgcattgccactatttggtattatcatggttatagtttgaattgatgaaaactcctgtgccagcaatgttaatatttctggccataatttgtgaagttttaattctgaggcagcgaatttcagta

SEQ ID NO: 11525 - DNA, 393 bp, Oryza sativa
  unsure (1)..(393): unsure at all n locations
ggcggcggcaacgacgcggcggcgtggcttgccgggttccagatatcctccgccgggccgtcgtccccgacgtacagcctcgtggctcctcctcccaacccgttcggcgccgccgccgccgccgcggggtcctcctcgagggtgatgagcggagcgtgctcgccggtcgccggcggcgacgtccagatggccgacgcggcgcgccgcgagttcgcgttcggcggcgagggcggcaagatgaccgggctggtgaaggcgtgggaaggggagcgcatccatgaggagtgcggctccgacgatctcgagctcaccctcgggagctccatgactcgcggcgatcgctnnnnnnnnnnnnnnnnnnnnnnnnnnnnnnnnnnnnnnnnnnnnnnnnnn

SEQ ID NO: 11526 - DNA, 1468 bp, Oryza sativa
ataagtatggcatataatccacatgagagggagaatttaagaattttctatccaattaacattatgcagctgcacatgcttagctaatctctctccccattggcaacatgtttgcataattctgaacagccatacacacacctgactggctgattactctgccagaagtgcacagtttcctgcttgctagctagctggatcatctgcagataataaaccctgcaatgctgaggcagaatgtgtatcatccaatggccacaatccacagagaatcctgaaagaatggcaatgcacatctgcaaaacatacatgtatgagtgagtagtgagtacctaactctgatgggcaactgataaattcaagattttttttctgtttggttgtcaatttgtgagaagtattaataacagatgctgttggcaacatcccttgctgcttactgtcagaatggtcctgagctaccagaatacatatacagttgtgcaggtatcaagaaaatcccttctggtccgggtacagtgacagccgggctaccggccgccggaacaggccgccgccggtggccggtggccggcggccggccaagaaggtgaggtgtttggtcaaagaaaagtttcagaaggtggtgttttcctttgttaatttgttcgtgctgcatgccgtgtcattgatcagaaagttggcaagacaggcatagaaatttggagaggttggtatatatttgtttggaggaacaggaaagttcagatgcttgttcacgtcttcatgcataagctgctggagttgttggtggcacacttcattggcatggatgctgcctgacagtgatgataaaactgtgacctcacacatcttaactaacttgcaacctaacaatagtattagcaatagagaagtatatacaagatacaagatccaatggactggacatccgatgggctggacatgggccaactatacagtacattagcttgtatatatatttaacaccccccttcaaactcaaggtggatctaccacattgagtttgagaagatgtaaccgatgatgctctcgagtttgggccttggtgaagaaatcagcgacttgtagctcggagggcacatagtggagagcaattgttgactgctgacaatgagaacgtgtgaaagatgcatcaacgccaatatgcttcgtcaattcatgcttgattggatcattggcgatttgtatagctccggtgttgtcacataaaagaggtgtcgggacatcacaagagacaccaaaatcagctagtagccaacgcaaccacacaatctctgaagtggttgtggcaagagcccgaagttcagcctcagtactagatcgagataccgctgtttgtttcttggacttccaagtgaggagagaagtgccaagaaaaatacaatagccagtgacagagcgacgatcaataggatcacttgcccaagtcgagtccgagaaagcg

SEQ ID NO: 11527 - DNA, 2373 bp, Oryza sativa
taggagaaaacccagttgcaagtaccactgagctgaagcgtgcaaaccaagcacgaggggcctgcttgagaccataaagtgcacgccgaaggcgaaatacatgtcctggtggagcttccacacctggtggtggatgcatatatacctcctcatgaagatcaccatgaagaaaagcattcttgacatccatttgtgagatagtccaagaacgggtagctgccacggcaattaaagtacgcaccgtagtcatatgagcaacaggagcaaatgtctcatcatagtctcgaccatgagcttgctggaaacctcgcgcaacaaggcgagccttgtatctctcaacttgaccatctgatttggtcttaactttataaacccacttacaggtgattggaacagcatgagatggcaacgggacaacatcccacgtgttggtacgctctagtgcagcaagctcctctgacatagccaatttccaatgaggtaaaacaattgcctcctgataagtagatggctcaaacacaaccccaacaacaaaatcatctctattaggtgcacgaagagcatcacgagcacgcaagttgtacctcggagcaggagatgaatcatcaacggaacatgttggatcctcaagggtaggttgggagggttgtgattcgttaggaattttgggtctacgactgtagtggaaaggaaaagtgtctaatgttatagtggaaggaacatgtggaggtgatgaggaagctgggatgtgtgatggtggaggcgatacaggtgagggtgaaggggaaggtggtggaggtggtacatatgttggtgaaggtacagaaggaggtataggcgatggtgatggggttattggtgatgaaggtaaagactctggtgaaggaataggtggaaggtaaaggaaggagatggaattttctggagaagaaggctgattagtagaagaatagaagaagggtttgttctcatcaaaagtaacatctcgggagatacgaattcgacgtgcagaaggatcataacagcgatagcctttatgctcaagactatatccaagaaaaacacactcaactgattgggctgtcaacttggtgcgctcacgtggggctagtaaaacatagcaagtacaaccaaaaactcgaaggtgatcatagtggggaggagagccaaacaacacttctccaggggacctgccttgcaaagaagaagatggttgcatgttgatgagatatacagctgtagaaatagcctctgcccagaaatgagctggaacaaatgatgcaatgagaagagttctagcagtctcaatgatgtggcgatgtttacgctcagcaacccattttgagcatgagcaccaggacaagaaagttgaggaagagtgccctgagataccaaaaattcacgaaaagcatttgacatatactctcctccgcagtccgagcggaaaatacgaattgcactagagaactgagtatgaatcatctgggcaaaagactgatatatagaaattagctagacagatgcttcatgtgatagagccatggatatcgataataatcatcgactttaacatcatagtaggggtggcatacattatgaaggaaagggcgactttcccataacaggagagtgaaccaaatcaaaaggtagactcgacctggaggtactggaaggatatggaagctgtacttgcttaccaagtttacaacctttgcaaacaaaggtagtgtcaacagggacggaaccaagaacgccttgattgataagagttgctaggcgagagccacacaagtgacccaaacgatggtgccactgtgggaaggatttacaagctgtagagcacataggagaatagacagaaggtgtgttagtggaggatgaaggcaaactcaagctatcaaggatataaagcccacaggatcttttctgacgatgtccggtgccaatgacagctcctgtgtggcgatcttgcacaaagcatgaagtatcatcaaatccaacgaaacaatttgtatctgtgagttgacctacagaaatgaggttcatggatagttttggaacaagtgacacattaggtactgtaaactgaggagaagagatagacccctgatgagtaaccttacacaatgttccattagctgtatgaacggtggcaccatttttaaccagacggcatgatgtgagccatgaatcatcaaatgacatatgaaaggaggctcctgagtccaaaatccatggttgggaggcaattggggtaacagttgatatagatgaacatgaggcaataccagcacatggatagggaccaagaattccatctgacaccatgatatatcaaaacaattgtataaaccaaagatcactagcaactca

SEQ ID NO: 11528 - DNA, 4045 bp, Oryza sativa
  unsure (1)..(4045): unsure at all n locations
catactgagatttctcaaatatcaaattgtgctatcatcagatcttctgtcaaaacattgattggaagtgtacttgaggctgtagtcttatgatttattgattaatagctgcttaattcatttttggtatagtagtacaatgactctgattatgtccaatatatgtatcatctactccgactttaataagtcaactactacgttgccactggattcagctgatgaggttacgcataactgatcgtgcatatccatgacatgatttgaaatgtaggtttaagaaagtgatctgtcgaatatctaatacttgaattttagttttatgttacatttttggggtcaaaaacagatgtcattttttggactaaagaaaacaccagttttagccttttttttagtttcagatacttgtcatttcagctttctaagactatgtttttgaccatcttgtccactttagttgccaattgtcttcttttgcctacgtttaactagtcaaaacatctaaatgtaaatagaggattgaacttttctagatttcctttgttataaacagggaattttttagataatagagataacttccagtctctgcatcaactatggatacgcacggccatgtatttaagggatgtggggtaggaagaatgtgtggatgagttctaggaaggtgcatgagagtaatttcatttgccataaaaaagggcacagtgacattcatgtgtaactattttttatgcttctatgatgctttgagcaaagaaccacttgcagtaagtaagagactgagatagtgagatgtgcgaatggtatcaagcttgcttcctggcatggactgtctacttaattagccactaattttatactgtcaaaacaaaaccagcaaatggagctttccacacaggtgatgacacatactgaagtggttgcaaatcaaagtaggaggagctcatgtaatccagaaggattgcatggttcaactgcaaagtggatttcttgcaatggcatgaaagtacccctgatggtccatgttaccccatgttcctcttatctttattatatccttacctcaactaccttttgttttccctcatccaagtgcttgcttctcttgcaagttctttaagtagaaacatattgtagttgcaagcaatttgatgcatcagttgtgggcaatctagaggatcacagagatatgctagtaaaaacgatacgaaagcgaaaagagaagaagatcatcattatagggtttccaaaaggcattgaagaacaatatatgtccttagtcagaggtatcaacaaacttcagttacaaaaacatatgaaggtatgagtacaaatgctcacccttttggaggctagatcattgatgcataactgcattagagttcacaagtcatgagttctctatctgcatagagcttggaatcagagctcacacctggaaaacccaacagtgatattattttagtaggggctaaatcttggatagtgccaagctcacatcttaggcttagttggaccaagactcaatgtagactactctggtagagacagaacagtttctcatggaatttttttgtggatattgctgccacattttttgctgtaatcactcctgtcattttaatacttgcatctctttattcctcaactgaattgtccctatgatctggtcttttctttctatgggcaattcctaagtggacctccagaaagggcaggcaaatcgagctccaatttgatcaagaaagatagtggggtgatgaaagcaatgcattgctaccctttattcttcacccatttcttgtttaaaacaaggtgatggcagtatggcactatttgcttggcctgtttgggatttggtgaatgtgaatattgccacagtgtcccatgctattgggtggcaacaatcactagcttttcatttgtttcagttacccgtgaaacctcatggtaaattaataaatagcatctggtactagttgtcaagcagaagaatgattaaggaaactgtcaagtagtatgagtgctgaataattaggggactgatgatgctggtgagggacccaaacctgaaattaagcaggtggcaaccctagtcccaacatgcatataatactaattccaaccttttttctttatgtgagttgtgcagaggagaggacagcagaattggacagttccattgaagctagctgcttgtttcttctttttgtttggaggtgaagcagcctcaatcatcccaatgtagaggcactgctccaaccaagtgttgttcaaagaatgtggtatatcagcagttcaagcacattggtagcagggtttgtatgtgcaaatctgtacaaacaaagagaattattctagaacatgtgtgtggggaaatttctggccactgtagttttcagcttgtgaaatgtagacctgcctcctcttcggagataaatggttgatttcattgggggagaaaactccctcctcttttgatagggcatattttgttttgtcaggataagattctgagcgacaattactctattaatatttcattttttatgtggtccaaaattatgaccagaagaaagtttttttttgtaatacaaatttaataacatcaattttatgtcacaaacattatgtattaatggagtaattattagtcaaaaccttgtcctaacaaaataaaatatgccctataaaaagaggagggagtataggtggctaatccaaagacacccaataagtggaatgtactaccttcacacataaaaatcaacagggcagtttgcttcctctagagtgtctcatcagatgcttagattttcttacccatcataatctttaagtgacataatttccagaacataaagttcttaagaagacctctctaatccttagaacttgaatttttgactccatgaaaaggagtctaaatccttgactaatagttcctataaatgttatattcatattcggtgcgctctttccatgtatccgaaagttttgtaagtttgacacattcatagtgctgaaaaaggctacctagcatgggtcggggggatacaattccaccttcttttttttccccgaacacgcgaaagatgtgcgcgtcactataggaatacaattccacttgccattgcaacatattttggcaccattttatgcagacatgagtgctgcacctgtttagcttgtgactgaatgcaaggtgtgccactgtaaatcatcatcttatgataggtaaacttacacattgaaattgatattaagccacggttattttcaattaattcttttagatgatggaggctttcagaattcaaccatttacaccaagttgacacaaaagcaccgagcacattctaattaattttatgctcattcaatttagagcagcaaatttgtgtaaaatttagtattaaaccttacattttattacctcaatcccatgtacaaatctcaggcaggaggagaaaccttttgaggcttggtttagttatcaactttttcttcaaactttcaacttttccatcacatcaagactttcctacacacacaaactttcaacttttctatcacatcgttccaatttcaatcaaacttctaattttagtgtgaactaaacacaccctctgagtatgataccgacgaccaggaaacagtccagatcagaggggcaaatgcaaaccaatcagaaatattcgtttggaaancccccccagccaagcggcttcaaagggttcacacatgctttagctaaggagatgagatgaatcgcagcagcagagggaggaggaaaggggggagtactaagcaagcagcattgatgcctccattactcccctgtttaatactctctcttgggaggttggaggagatcacaggacagcctgtgcctgtgcctgtgctgctgtggcatttcttcagagaagactgtgagatatcaccacaaataaaattcccactactgtagtatgaaaactttgggacacattcagatacattccgatgaaaccagaagtagttttgatggactacttgc

SEQ ID NO: 11529 - DNA, 18094 bp, Oryza sativa
attttttaatttatctatatttaagactctatgcatgtgtccaaagattccatgtgatgtttttgggaaaaagtttgtggaaactaaacggggcccaagtaagatggcaacaaaaacaggaataaaagaaatggtgaccaaggcagtgtggaacaccccggggcttttaactatttgccactcttacgagtggtgcttaacgatttgccactagactcatatgtcaaaaacacatgagggcccacatgtcattgacagggtgtggcaaatcattaattgccatgtcataagagtggcaaatagttaaatttcccggaacaccccaaccccacttccctcaccattccattcaccaaagcacagcagcacacaccaaggaaggcctagaaaagagaaaggcaaagaggaccaaaagaaaagaaaagaaagaaagaaaaaacttgaaaaaaaaaagctcaaaagaaagcaagagagaaagcaaccaggcaggcagaggcagaggcagaggcagaggcagtagccctcccttttttttttctctcttctcttctcttctcccaattcacacaagattcactcaccagctgtgccctcccattcccctctgatccaagcctttcactcaaagcttccagcttttccaattgcttggccacttcaagaatcaaggaatatgttcttgttcttggggttcctctgatccgactctccatcttccagcttccaggcttctctctcgttctgtgccatttttgctctgcctgagctctgtgcttgttgcattggtcactccaagaaaaggattttgaaggctggttttattgttcttctgttcctgggatccgaattgcaggcgagctcgctgttcgtgtggaggtttctttctttcattcattcgcttgaagaattcggcaaagccatgcgagcaattcgggatgatttctcggggcctttggaacgcgtgatgattctttgacccaccattgcttcggttttttttttctgggagaattctgcaatttcgcgagtttggtcgttgagctcgagccgtggtggtgttcttgatccggtccatgggtctctgtcatggcaagccgagccaaatcccggagcccgaggcggaggaggcggcggcggcggccggtgtagccgtcgccggcgccgcctcgccgggtccggctgcggcggcggcggcggcggcggcggcgaaaccgggcacgccgaagcagccgaagttcccgttctacctgccgagcccgctgccggcgtcgagctacaagagctcgccggcgaactcgagcgtggcgtctacgccggcgcgcggcgggttgaaacggccgttccccccgccgtcgccggcgaagcacatccgcgcgctcctggcgcggcggcacgggtcggtgaagcccaacgaggcgcccatcccggagggcggcgagaccgaggtcggcctcgacaagggcttcggcttctccaagcacttcttcgccaagtacgagctcggcgacgaggtcggccgcggccacttcggctacacctgctccgccaaggccaagaagggcgaccacaagggccacgacgtcgccgtcaaggtcatccccaaagccaaggtcggattcccgccattgccacgcctcaatcgcttctttcttcttcttgaaatggaacacatgcctctgcatttgaccaaaataattttccctgcgtgaattaatcaactgcttctgctcagttttgtcgttaagatccaatcatttctgacgtgcagatttaacttatggcattcggattctccattattttctttttaatcgagttttctttttttttttgttgcggggttcttttaatcaagttcactttgatgcaactctgattttgcatcttagctccatttggtagtatttggtagaacgttggttgattcaagcacgaggatattggaaaaaaggagccacctttagccggcacttcgttttcgttttagctcccggggtgctcgtgattattgttgggaggtaacctcgccgctttgagaccattcgtgccaagatatgtcattgccaatgccatgtccatccatctggacgtggactgcctcctgcagcattgattggcttcatgccatgctcatggtttcaacgcttgtcgagttcttggtgccaccaccatcttttgtcctcacgcttccatcatcggggtcggggagggtaaatggagcagatgaccctctttggatagatctgcaggtcaaaaaggggagcagagtttgctgctgaagctgcacagcttgatgcttcaattctgtggaaagagtttgctcataatgcgcctcctctgcaattgtatgaaagggtcattcaatttaaggccctgtagatgcggccagtccagtgcttttatgagcaaagctggcaatccttctgttgccaatgcaagggggtaatgcccccaccctcctcttggcttctcacattccatgtgctcgtgttcttcctcggtcaattgcagtcaattgttagaatgtcagcaatgctgcgtttcttggttttattctttccagaaaaataagattgagctcaaagacagttgcaagagtgttgttcttgttggatttctaatggagcactccacttgtcactttgatactggagtatatgttcatttcattatagaatggtggtgtagctttggttgaatcttctagtgttattcgtgtcctgagggcattaattccagcaataggcatttcatttcttttcacccataattgatcacttattgtctgtctagtgcactgttgtacaacattgaaccgaacagtagttggttgttggcttgctcgcataggtgtcataattcgcgcttcgagatctacatatgttgcccattaccatgataaatggaagttgagctggcattgttgtagttgcatgcttttatttacttactagtaagtaatataattgattgatcttatagatatagttcattatgtaaaagaattatcatattttgcttgtgggttgtttactcatttgcaaatttcattactcttttacacttggtagctgtttactgcaatgccagttcatgctgctttctactcttaccaaattaagtctctgggcagatgacgactgctattgccattgaagatgtcagaagagaagtcagaatattgagttcgctgacaggacacagtaacctagtgcagttctatgatgctttcgaggatgaagataatgtgtatatagttatggagtaagtgtgcacttattccatacagtgctctcctttaacttctttttttgccgggtcgtctcctttaacttctgtcttcatttgttgctgtcatgcatgcgattcttgtcttgtatacattagaaggttcagagatgaaaaaaaaatgttatttcatcttggtggaatgtttggctttgttcctgtcattaatgtttgtgaaactaccctgatacatgagaatccaagcattgatatataaatagatcattttctgtcagcaaggatttgtactttcaatctcaataacatattcccatcatgccgttgttactataaaaaatataaaatttcgtgcatgatgttgatcagagctcctctatgatcagttgtttataattcaagataacatatcccagtcaaattaaaaatccaagatactcataaaaaatggtgctttcctgcaacttgcatcacttgattacatttaacttaatgtgattgccttttctgtttcaggctatgtaaaggaggtgaactactggataggattttggcaaggtagagtcatgatatttattttgtaaacaatgcttgtaactaattctgctagatttgagttataacttactttctttcttcacagaggtggaaaatactctgaggaagatgcaaaggttgttatggtgcaaattttgagtgttgtgtcattttgccatctccaaggtgttgtccatcgtgatctgaaaccagaggtaggcttgctgccaaacaattaatagccaatgttaagaagttcatgttacaacctaaaaattgttaatgttgaatatgggctctaactgacataagacattttctcttctattgttatttctgtaaattttctgaattttttttacccaaagtctactattgagtctagcagtcagcagaccaaatgcattattttgtaaataaccatatttgttgttcccctttccagaattttcttttcacctcaaaggatgaaaactctgccttgaaggtcatagactttggcttgtctgactttgtgaagccaggttagatttacagagtccagttttgattcttctttagtatttatccttgccaaaccaaatttaaatgtgttgagatatcatatcattgctatattctgcagatgaaagacttaatgacattgtcggaagtgcatattatgttgctcctgaggtgcttcatcgatcttatggcactgaggcagatatgtggagcattggagtgattgcctacattttgctttgtgggagccgtcctttctgggcacgcaccgaatcaggaatatttcgagctgtgctgaaggcagaaccaagttttgatgaggctccatggcctactctcactgccgaagcaaaagactttgtaaaacgactgcttaataaggattaccgcaagaggatgactgctgcacaagctctcagtaagcatcagatttgtttgtcagtgtaatattgtggcactcgctttttatcgaatgatggttaattgctcacttgcatcatgatatctgcaggtcatccgtggatccgaaattctcaacaagtgaaaatacctttagatatgataatctacaagcttatgcgagcttatatcagttcgtcttccttgcggaagtccgctttgagggtatgcataaacctttgtgttgttcttatctggtctgtaaatgactattcttgctgcttatattttttttcattttttacatgtgtcaagttatccatgtacgagcaatatattgcttttggttgtgcagtttaagtaggcttataccgatatgtcttgactctgatgacatcaccaactagccattttagcaatgtccatacattttgcaggccctagctaagacattgacggcaaatcaactgttctatctaagagagcaatttgaattgttgggtccaaacaagaatggttatatctccttgcaaaatttgaaaacggtaggtattctcacctttgttacttgatctaatttatagcatgcaattgctgaataagtaaatgttcacacaggccttggtaaagaattctacagatgcaatgaaggattctagggttattgactttgttaacacggtaagactctttcatagaacattctcttgtgttagtatatcggactgagataaacactgacctgctcaagccatggtactaggtgtgcactcttcagtacagaaaattggattttgaagagttcgctgcttctgccgtcagcgtttatcagatggaagctttggaaacatgggagcagcacgcacggcgtgcatacgagctattcgataaggagggcaaccgacctattgtaattgaggagcttgcatcggtatgatttgagctgaagtaactttttcgcatgattattaaacatttctaactgttatatttttcatctcttaggaacttggacttggtccatcagtccctcttcatgttgtactccaagattggatcagacacgccgatgggaagcttagtttccttggattcattaaacttttgcacggagtttcttcgcgatcgatcccgaaagcctaagataaaatcattcttgcatcaaccaatgaggtcaaattgatggctaagccaaattctctggatggtgttcgttgtgttgcgcggtttgaggtggttggagaggatgtcttgaaaatcagacaaaaaaaagaaagtgacagtttgtgtaagaggtgaaaatgttcttgctgctactacttctacccctccccttcgccacgtcggattgatgttgtactgaagctgtgtagacgatgtacagatgatgaggataggaaaaagaatatggaagggttgaaaagatttgagactggtgtttgtcaaagtcttgcattgtagtagtgcatcttttgtctcaaataagacatttaacgtctcaccccttggtctctcattgtgttattatgccagtatgcgacagccctgaggttacagattcaactgtgtgctgttcatttctctgtacttgttgttgcaattgcttctactgcagccttctggtaccaatgcaacaatctctgctcctcactgtccattgatgatgggagaatctgcatttttactgcaaggctgcatctacccaagcatatgcatatattcatggcgatatgcatatatcaccaatgaccttggccgatccgcagaagccggggatctaaaccatttccattctctaaaattcagagtatcaccagaattctgaagaagtgatctctccaaatgtaataagatgccctggaagagggctattcaggatcaagacaaccacttccttttttcagggtctcaccccttgttcagcaatcagtagtatcactgtctgttcaagtgttcatagcaaaagaaaaggcatcacacagtgacattgctgatattggtgtgtgcaatgcaatgctgttaatgccgcgttgtcgctgtctgtgcaagaatgcaaaagcactggatctggggtgcccgtacggcaaagcaaatccggtcaaattctgatgaaggagtccggcaagatgggacccactgacagtcaggaagggacccaacatggttgaaataattgaaatgctattgaagttctaaatttgaccaccgataaattttaaattatagtgtttaaacgaataaaaactgcgtgctcatatttaacatgcaatgcactttcataacatgtaagaggtaaaattttggatacgaacaatatccggtgacaattatttagggatagagggagtaatcatattatgatattatggtattgcatgttcttagatggataatatatttgtgagcaattttatatgtcgaaagatgtttgatgatcgtgaaaggaatgcaaaatgtgtgaagatttttggcatggtgtgccacgtgacatgccaaagttcaggtttttcaggctgtatggtcctcggtttggacctgtttggctgcatttggatggatagtgtaaaaccatgagcacaggttcagtttagtagagtgactttatgtgcttgtttttactgtcacaaggttcctcgagcaacacacagtaaagtaatggtaaaaatttactacttattgtacttgcttctgctgtgatatgaacaaagaaggttattaaaaaaatgggaaagaaaaaggaggcctcttctcaaaggtcgcaaagaagcagaagaaatggctcaagcttctgaactctgaagtctcctgcactttgtatgcagttaagtataacactgaaagtttcttaaaagacttgagagttgcaccaaaagctcgaatcatggcaaatgatgtgagctttgtttaaagtctgaagaaatcttttgtgatgtttaatgttaaaattcgaacactggagggtcataaaagacagacaacagttagagtttcgaagcaagatcagatatgttattaacacctcaaaagatgcatgatttttgtgagtggactcaaaagctgcatgatggcatgcatacattgttcagtctacttcagaaagaaaaataaattacgttcattggaagttcaaatcgaagtccattcaaaccaaacatgccggacataataataatgtctgaatcgttgaatgttaaacacaatagattagagaaaaaaagcaacattcgttactgtaaaaactactactaggaataaaatattttaacatggatactcactaaaaatttacaattaatgtggagatgcggggtatcgatccccgtacctctcgcatgctaagcgagcgctctaccatctgagctacatccccaatttgacatttttctatcatatattttacttatcagttaaaacatgaaatggcatcgtttcatatgaatttgacacccttagcgtatattgcgggtcttattcgagcagaaatttctttagaaatcattcaacttgggaaatcctccttgatgtcaggttcagttctaccggtaacacagacagtagacacctaattttcccgtgtgattatctagttcaagactaatcctccgttcctccttgatgggatgaagctcctgcttcgccaaataatagtaataaaaagatctgcatatcttaatgtggccttaggctgagtttgaaggagcatttgggctgaaagtttctttaatttaccatgttcacgctttcaaaactgttaaacggtatatttcgtataaaaaaattttatatagaagtttcttaaaaaaatattaatttattattaagtttaaaataattaatactcaaattaccatgtgctaatggtttatctcgttttacatgccgctaagttgctaagcccaaatgctcttccaaactcagcctacgccaagcaaaatttaaggcccgttagccagtaaaagagcgagattacagtcctattgggcccaactcactcgcatgggccgaaatccagcctatccatagtctggatttcactcaatggaggcccaacaaaacaaggcctcgcaaacaattaacagcccaataaggcccatataatcagatcccttacttaaccttctcctctaatctcaagaaaaaccagaataaacatttcccccaccaccttcgcctcctcctctcccatggcgatcccctaccggatcaccgccggcggcggcggcggcaggcagcggatggcgctgccgctgccgccgaagggcgccctgctggccgccgtgacgacggcgtcggtgctgtccatcctgtgcgtgctgtccttcaccgactcgctgtcctacctcgggttccaggtcaggggcgtcgacaagagggagagcagccgcagctacctctactggggcgccgccatcgactgccccggcaagcactgcgcctcctgcgccggcctcggccaccaggagtccagcctccgctgcgccctcgaggaggccctgtttcttgacaggtaaccatggtttggcacgtgtatagattttgattcgtacctgcattgatctgtctgggctgttaatccgtaatattcccacttaggaggatggaaattgttgcaaagagccaaagaatgtaatgtgggatgatgtgatataataatgtggatatgtatgaattagtttttgttgttgtggcagaatatttgtgatgccttcaaggttgtgccttaattcagtgcacaatacaagggggattattaatcaaagcgatgcgacttccaataaaaggtttggcttcttgttaaccacctacttctatgtgattatatatcttcctgtatcattctgttttcctgaaatcgtgctagaattgaaactcaccaactcaatgttttggcagtggcaggtgggaaacaagttcatgtgcgatggaatctttgtatgacatagacctcatatcaagaactgttcctgttgttttggacaatccacaatcatggtatgctatagtatcaagaagtacgaagctaggagaggaaggagatgtagcacatgcacaaggagttagcagacaagaactcaaagaaaacacactttactcaaaggcattcctcataaaccgcaccgcaagtcctcttgcttggtaagaatgctagctcttaaagaatagccttaagccttcaagatcacaccgaattgaacctatacaccatgactagaattctggtatagaccttaatcatcattacagttcaggtttatggagtgcaaggatcggaccaagcgtagctctgtgatgttaccatacaattttctgccatctatgccagcaagaaaactgagggatgcagcaaacaaggtatatttccataagtttgcctccttgctcaatttaattgaaattggttgctccaatcggctgaaaatgatatcttgttttgcaccagattgcttagcaccaagttaataatattgttcatttctgtttatatcgaattgctcatggaaatttgccgagtagaactatataacataaaattcaaaatcctaagaatgtggctttagtgtgcctaatgttagttccccacttaaaaggactaacattgatgtcccactgtaaataaatctcgtagctgtcatttttgtcagcattgcgtgcgacataagatgtgtagcactgtagcagcgggcatctgcttgttgaaagttaaaattcaccggcaaatggtgaattattgcctcatgctgccatgggattatgttttattactccactccttcattgagaatttcatgtttgtcatggttgttctggaataccgtgggccatggtaccactctatttaccctatgtgcctatgtaattgttcatatgctagctttgcatctaaaaaagagctttgggacctattgaggttattggattactttccgaaaagattttttggtaggacaaaattgcaaagcttttgtctttctaggtttggtcaggcagaacatcataatatatcctgtatataaatcatttgtactgtactactgtttgtttatgttaagtgacatccacgtattagtacagcatagtatgttactctgctttctcccatctaaatcagtgtgctttctttagattaaagtgatacttggtgactacgatgctattcatgtaagacggggtgatctactgaagaataggaaagatcgatttggtgttgagcgaagccttcatcctcatctggacagagatacccatcctgagaacatcaaaagaagaattgcaaagtggattccgcgaggccgtactcttttcattgcttcaaatgaaaggacaccaggcttcttttcacctctatcagacaggtaatcaacacattgtgtcagctgctcttcttgactcaccagcattaggatctcaggcacgatttacatttgcatttggtttctgcaatcaatttagatgtgactttagcgattcgtgttctcatggatttaccacggcacatggtttgtcttcttctgttatcaattacttcctccgtttcacaatgtaagtcattctagcatttcccacattcatattgatgttaataaacctagatagatatatatgtttagattcattaacatcaatatgaatgtggaaaatgctagaataacttacattgtgaaacggagggaatacttcaaaaacatcccattcttaagaaactcgactagttgctgcagtactaatgcactttgtcattctggaatatttattttgtttggtatattcattttttttatttatcacaccatggcttaccaatagaaaaaaacaaataatatgtacatgaccagcagtgcaatgtcataccattgaatgcttataatttcatgacacaagctggctaagatttctattcgttttctttggcgtggatacagatacaagttagcatactcatcaaacttcagcagcatattggagccagtaatcgataacaactatcagctgttcatggtcgaaaggttaatcatgcaaggagcaaggaagtttgtgaagaccatgaaagaattcgataatgacctttctctttgcgatgaccctaaaaagaacaccaaagtctgggaagaagcagtttatacagatggctgatggttcgtatttgaccgtatttgaccttccattgcatatgaagtacagctcgcaaactatcactaatggttttgcatagataatagtataatactgtcatatgaatatatatgattaaaaagttttacttctgatctgaagttacactcaagctaggacactcaagtcaaccgacagaacaaggggaagcatgcatgtttcctttcttcagacaagagatgttcaatttgttcctctctcttttttctttgatacacctgggaagagactatatatgctggtgtgtgatgtaacttcatcgtggttttgatttaaaccaaattgtagtgtatatgtaataggcaattacctatcagctaatggtgaatacatctgtaattaatttgtcaatctggaaattgattcctttttggagaaaatctggaagttggattatgtttaacctcttgcagatgaaaaggcaaatatacataccatctacagtgcacgcttgttgcagatgtactgcatgtcagtacagcagaaatatgcaaggtacagcagaaatgtgcaaccgtaggtgtatatttgcatgcaaaagttttttttttttgccaaatgcaatgcacatacatgtgataattaaacaggtgcatgattaaggtgcaaaaacttagatgccttggacttcattagtaccatttaacatccacttagctagctaattaagctagttcctcatctgatcatcactcttcaccagcatgaaaggtgatcagtactctctcacatgatgcatggcatgcatgatgcatggcaagatcaaaataagcaagaacaaaacaagagctacctaagtgcaattaagcactagcagtagcagctagctactaattgatttgattgatcctaattacctcctagctagctactcctaccttaacgctaatcaactcttgtcatctcatctcaaagactaattaacaaactaattaacacctgcacccttgcgcaaatcaatcgtcgtcgtcgtcgtcatcctcctcaagaaatcaagcagcagcatgagctgagctgatcgatcgagctagctcatcatcatcctctcttctctatatgtacacgagatcgagcaagcatggcggctgcaaagctcgctcacacctcgcttccctggtcatggacgccgtcgtcgtcgtcccggtgcgcccgcttcttcctgccgtgcagcgacacgccgaacagcttcaccgtgtcgccgccgtcggttgctggagtcttgggcggcggcggcggcggcgagtgatcgggggagtcgagctccatcagcctgcaggaggcggcggctggaaggtggtgttgcgccgccgccatggccgtcgacgagggggtggtggtggtggtggtgaccggcgcgacgtggttctggaggaagtagatgatgtcgttgtagagcttcttcatgtgcgccagctccgacagcagcagcgagttgcgccgccgcagctgccggttgtcctccgacagcgccgccaggaagtccccgccttcgccgccgtctccggcgacagtacagtgcgccgtcgtggcgggctcttcttggattagatggtggtggtggtacgccggcggcggcggcggcagcgagaagggattgaggtggtggtggtggtggtagggttggtgcggcatcggcggcggcggcggctgcgacgacttccgccggtgaatctcggcgaggaggtgcttggctcccttcctgaagaactcgttggcgaactcccacctgtcagctactatcttcctgaaaccctgcaattaacatcatcataagttcataacaccaattaattaatgcccaaagttaaacatacatacttagtattagctattagggaaaggattatgaacactcgagaggatatctcctaatcgtttgcatgtcatctaaatggttataaaattttagaaaaaaaatcaacaagatgattaatatgtgattgtattagtagctaataactaaaaaaactaagcaatcacacaaccaatggagctagcaatcacaaaaaaaagagagagagagagagaaaagaagaattggcaaatggcaaaatatactactacctccataaaaaaaagataggcagagatgaaatctttgtaaaatgaaggcagtactatgtaggagtatatggtaactgatgttcaatattgttgctagtcatgtcaagtggtgctaatatgaatggtggagtatatacttggcacagaataccaaggtacatatatgcatctctgtttattgtgtcaaacttttcccaatgattgggagtggatagtgcactgctaattctctaaagatgaggaggatagaacaaactataaatacatgtaaatggattattcatggagctagaattaactactactacggcgactacgtactaataaatactaatccactgcttactgtgcttgcacatttaatttgtgcactttgattttggtcaagactcaagaggcaaagggaagattagaggaagtactagcgaagtacattaattagggaaggtagaacagtggtgctggagcaagtagggtaagaagtgaatgtacaacacagtcatcaacttatagtggttcagaagaagaaagagaagatcagcaaacagtcagcacgtactctcatgctgctcctcacttcaccattgagagaaactaattaatgtgcatcagataatgttcagtaaaagaggcacaaaaaaaatttaaatctccctcatgttaaccaggctaaacagacaagaaaaacagtagatgagattaatcatcagcacgaattaatatacccccagctctactctatcttttcatcagaagcaagaaatatatttttgaaaaaaacaagcaaaagagattaatcagctcgttggaaggtcgcactcaaacagcaatgcctttccagcgtgcaacaaaaatctggtacaaaacaaaagatcgatgaacaaaaacttttccaaaaccctgtcacattctaggaaacaagcttgctaaccaccacatacacaccaaatcacccatcaaaacaacaagaacattaaaccatagtccatgcatgccagcatcccccatgcactgactgaccaaacctctacatcaaattaaaaccaaagcaagaaactatagcagctagaaaaccaactgatatatgtatgtatagctagctatagatcgattcaagaacaagcaaagaaatcaagacactacaagaacccgcaattttcttggcggccaaaaaaaacagccgccaagttcatatatattattggcggttctaaccagctaccaagcatatacatgtttttttggcggctatgcacaaccaccgtcatgtttttgaccgacatgaaaattacggattcttatagagcaacaatatatatgtggcaaaaatgtgcaatggtagcagcagcttacataggtgttgagctgcctgacgaagctggagaagttgttgtgcttgaagtagttggggaggaggtcgcgggcgaactccggcggccgccacacgacgaaggtggtgtcgtcctcgccccacgacacgatgtggtcggtgcaggggtcgtccaccagctggtacgtcttcgtcaggaacggcgccggcaccggcttccccgccgccgcgccgccgccgccgtgcggccccatctccatcgacaccaccatctccccgcacctctccaccaagaaagccatagctagaagaggaggaagaagaaggggagaggagaaaggctgcagtgtctcactgtctcgcactcacacagagagtgagacagagagagacgcacacgcacacaccacgaaccccgcgcttcaaatattctcgtgtgggctcacgtactctctctcagctcagctgcctggacctctctctcatgagctctagggggagtgtagtagagaagagagtggtggtggtgtgtgtctgttgcatctctctctctctctctctcatgattatagatgcatgtgcatggaaatctgtgcaaggagcagtgggtgcagggtgtgtgagggcggttcaaagtgctatggtggtatagcttagcttattagggcctgtttagttcgcgaaatggaaatttttgggtgtcatatcggatgtttgaccgaatgtcagaaggggttttcggacacgaatgaaaaaactaatttcaaaactcgtatggaaaccgcgagatgaatcttgtgagcctaattaatccgtcattagcacatgtgggttactgtagcacttatggctaatcatggactaattagactcaaaagattcgtctcgcgatttccctcctaactgtgcaattagattttcttttaatttatatttaattttccatgcgtacgttcaaagatttgacgtgatgtttctgggaaaaatttttggggaactaaacggggccttagcttaggtgttggggagaaggacgcagctggagtaggagcgaggagcttcttttggcacttagcattgtggtaatcccatgcttaattggccgtttagggcatggtcatggggttgagttagtacgtgttgagttaagagggggagagagagattgagtgttaaaagaaaaacaatatttgaagggagagacattcctctaaatattgagttactacctctgtccaaaaatatagtaacttttgagtatgaatctggacatactccaaatatatagtaactctggagtaatatttaaagggagagacattcctccaaatatttaagaagaaattataagcgtgttggggattgaacacatgtcctcgagattgaaaccatacatcccttgccactgcactatcaagtgcatctctgagaaattgagtgttgtttggagaagagagacctcgattaaaccatgtgatttctaactaatgaacatcatggatcaatttgtagtgtgctttcgttagttcaaaggtgaagaaggagagcataatttgggtcttagcaggagcaaagcggttaacggagtttctaccttaagcaccctaacctaacattatatttactttcacacttgtaattaaataaactttttttctactgtattcaatgaaattagcacgtctggtgtccgttcatgaaaaaaaatagttcgatggaggtaatctttgggcagctgttttttttcctttttttaaaaaaaacaaaccatataccatatgtcatatgaaatatgaagtatacggatttgctaaatgatatttgataaaacaataatttgtggccaattcctgcaacttcttgactgtcggatctgattcatgattcgagttccaatgacattcctgctcgatccatctccggtgaacttccgcgagctcataaatctagtggattgcggagttagggttcaatgttgggctagggatgttgtacactcaaaatgcaaccatttggtatctgttaaaagtatgaagatggggcatgttgatccctaccaaaggagcccatatattgcaccttttgatccattggtgtgatcttcttccccctccagttacaccgtctctttggtccctaccatttcgatcctaattatatttccaccgcaattgtacattactttttctacatacgcaggggcagagctatgtatagctaggagggtgcccacgaacccggttaaaaaaatagctatagtttatatattttcaccatatatataccccgtcagtttaaacttagtcacccatatcaagctaaattcgattcaaaccagagtaaattaagcaagtggaacccctttattatgttgtagctccgccaacatacacactatatatactgttatctcttacccgataatattttatttatgagtgattttacggtcctcgctaagatacatattataggtataaagcactgaaaggtactacttccgtttcaggttataagactttttagcattgcccacattcatataggtgttaatgaatctagacaagaaatatatatctcgccacggtatatcatcatacaattaatttctccttgctcatattggccaactcagtgttgtgtacgtgacaactgacaacctctcatttggtgtgtttaacttgcttttgttcatactagctatttttttccaaatattgagaatatagtacttcttagttattgctacccttttacagtgaaactccaccacagatatatagctaatattgttctcttcaatcatgatcgaattagcatatatagtattggtgacacaagcag

SEQ ID NO: 11530 - DNA, 2049 bp, Oryza sativa
ctgtttctttttaatgaaagaaagcatgaaaggaatatcctgtgtatatactgatgataattaatatacatatataccataacaaagggtaactaatcaattacaaagttattactattgattacaagtgggaggtaagttaagctagtgatacatttctttataaatcgattgcaaattttcaatacaacaaagcctgcatctggctagatatagctcaagctagctttgaacatcagaataggtccaaaattgaagtcaccgtgggtgtacatgcacgaatacgtacggcgacgatttgacaggaaggagcagagatagaatcatagaaagaacaagagaccaactcgatcgcacgggcatacactcctgcatgcagatcacaaagctatcaccataaacaaaagaaatggaaaaggaaaggagagaaaaagcagagatgcagatgcagagcacgcaacacatgcaaagaaagaagaagagatcgaggcctatccgatccggccgtgcaggtgatgcagtggattcactgcagagaaaggaagagaagagagagagagagagagagagaggcagctagcacatgtaattgtgctaggctgcacggccggtatcctcatggtatttagtgaccaaattgttctctctatccctagctggtagtagtggcatgcaggggaagtgcatgcacacatccatgtacagatgtctagttgtaaacaaccaaagatacttttgtgcctgcctgccttgcccctgcctcctgctggtgacttgcaagtttcaaggcaggcccgtgacttccatggagcagcgaaagcacagaaagtaaatactctactcactccatcactctttttaccgttcaaaattggtcccataataacttcttcatctttgactaattataattattcttttattaaacttctctacttacttactcgtttctaaccaatcataacttaataataactatattttgagacgataaaaatgctacagaaatacttgtattttaagacggagagagtgcttatagttattctttactcgtttctaaccaatcataacttaacaataactatattttaagacaataaaattactacagtttgagacggagagtacttacggttattcttcacttggtggtgagtggtgggtgcagccatgcagagccactggtagctagggatccacttttgatgcaacatcattttctattgccctttcctctgccattggcctgctgcatgggtgtgatgcaaggctgctgcttccattaatatcatatcaatgtgcaagaaaacaaacattcccccccaacttttcaaccagcattgaaagaaacaaaacaaagttttttttttcactccttcctctttggtcccagctgtgtgtagcaccatgtacacactatactgaatactgatgcagtagctatagtcactagtcagcatgcagatgcagtagctaggatcaagtacttcaagttcaaatgcacttgtaacttgtgtaaagattacatataggagtatacaaacttagctagttcctccaccaccactctccattttccttttgcctttccatgttcctagcaataaagcaggagtaatagcttaatttggctcagtcaaactaggctttgtgacccatccttttcccagggctgcccctgcaggtgatagatggatatgtgcaggaagatagcttagggttttggcatgcaagtactccctccgtcccataaaggtgacgtttttgactttttatttgcaacgtttgaccattcgttttatttgaaaaattagtgcaaatataaaaaaagataagtcatatgtaaagtacttttgataataaagcaaatgacaaacaaaataaataataattccaattttttttgaataagacgaatgatcaaacattgacaaacaaaaactcaaaaagacaagtaatatgggacggaggtagtcccaaaaaagatgccacaacctgcaagcaacatttgcatatgcatcaatgcaggtgggcagctatatatgt

SEQ ID NO: 11531 - DNA, 14741 bp, Oryza sativa
tatatgtggcttagtgtagtacacactgctggtattgtccctaggtgtgtgcatatatgcaacagctacagtttacatagcttgtggactaaaatgcaacaagaaaagaaaaaaagacaagggaagaaaaataaatcatagcatataaaactagcaagaagccagttatcttacaagctataggactgaggcctatagatgtgcaaaattgaagcttgcatacatatatacatgtgtgcaaaagtcttttgcttcattgtgcagtgtggattggctggggagtttgaatattatggaagattctgttccacatatgacaagttgctttaatatgatatgttttgtagtagacattttatgagtacatcacatgacctttctccatctccacatgtggcccactgcatttgtggccaggtctagatctatctttgactgccaaaaatatgcataaaataatgagagaaattaaaaaaatgatggagatcatcaaatatcatatgatatatatgtacgtgatatggaagtgtggctagtgaaagacatgaagcaagaaaagaatgtcatgttcttctctagatcaggcccacattatctgatgatgatgacacgatgcatgcatgctagatgccgttaaaaaccagttctctagacatgttgtgtgctccacacagtgtgcctctcatttcgagattcctctgaaatcactactaattctttatcatatcatgcattgcatgcaagagctagatactgtggcgcttatatacatgtatctatgtgcatacaatttgctgcatgcgacaccactgttgtttgcatgtcgaagaacacctctgttttcgtgcaatgaactgattgatactcaggagtagtttgctaattagctaggggagatgcagaggtgactagaataaggaagatatactcactagaagatggcatactgtgcaaaagatgtagctgtttgtttgtctacgagtagtagatcaggtaggacaatgcagcatgcatagaggtcatgtgaagagaggagaccaccaccaattaccaaaacgtgtatatgcctgatcacttctctcagctccatagctaggctccatagaaaacagctgcatcttggactttaccatggttgccactcacatacctgcaaataaccttgtggaggattagacaattaattagagatgcacttgattaaagagagatctagatgtttatgttgtcctggctagctaccttagttctttacattattaaacttgaaggccactacatatgtgcagtacagtgatggtacatagatcttagccaatgcatgtagctagctaggtccacagctagtacacatttccaggtttcttattaggcatgtatgtatgtatgtttgtccctttggatgtaccctagtactacactactgaatatctagaactagagcttagctggggagatggatggagagaaagacacaagatcttttgctgtggttgcattataaaaagaggcttgattcttcttttaccacctctatgcttaagagctttttgtgttaggaaaaagtaaaagggagaaaaagaccactccaaagaggggagttgctagacaaaggaagcttttcagagaacatttccttcttttttttccccttcagataaaaagtgagagaggaggagagaaggggtcagaagtctcagagcattaagggaaaaactgattaaagtctgtgcacatataaaggagctgtaaagatgtgaatttaccacagctagctcctctacagcctcctgctggcttttgtcagactcttacacatgtgcatatgcacatctctttccccctcatgtccctgccatgggtggtgcaggagtatgtggtgcctctgagcactagatttagatgtttctaccttgacaaactaagccttgatcttgtgtccatgcatatcatgtagaagagccttctagatgaaacaactagctagttctacacccttcatgcatcatctaaatacatgcacattgaaagacagcttatatacttgaaaagagaaacaaatgtagatatggaatcaaattaatcatcaatgcaatcaagaatcaagagagcattcataagccctaacatacaaccccatcattttgtttatacataaatacttattcatacaacttattaatgataataattattataaataaaacttttatatgcgtgttcttaactattcaaaagcaaatgctgtaaaataaaatacgacgacaaaaccatggagacaactccaaaattaggttttaaaatttatattcaagcgaaacgacaaggctcatttggtttgcacaaaagtttagtaaggttgatttcggcaacaaaccaaacaaactctaaaagtccttttggcctatgaggttttcattcaatcccctccatatataccaagttttgcctgatcctctgaacatgtcatttaattttaagctctacatgcatggttgccaacccagtacccagaaattttgcttctgtctatctctcagcttgaccttctgacctgttgctcagctgcgatggaggagcgctagctagctagcaagctggcagcatggaaacatcatttcgggatggtgtcagctaccaggtcatacggctttgacgacgcacgcatgcaggcttgcagttgcacggctgcacgggccaaggtgcatatggctgctgatacatcagcgcagcaagcagcgctagaacaatcaagctagctatccagagccagccatcgatcgatcgcccccctgccgctgcctctgcagccggcccgtgcatgcatgcgtgctagctatagctgcgcgacaagcaacctaaacgacctagcgaagctaagcagcatgcagcctcagtaaatgttcttgccttactactagtaaatgttcttgcctctgcctgggcgttgcaatatctatagctagccaccagcattgcaggacggccggccggctggctggccggcatgcacgcgtccgtccaacctcgtgcactgcacacgtgactggatcggacgactcacatccgtgaagcttccaatatatctctcctcctctctttctctctctctctcacacacacatttaaacttgagcttgtgcaacctagctaccaatctgcagcatttcatggcctgtgtgtggctggggtgcagtactgcagtgtctattgccatcctctttctctctctctatctctctctgaagtctgaacatactatgacctcttctttctgagagggtcacaagctagttgccactgcctggtcttctgttgcttcacatggtgtcacatgcaccgatgcctcctctattcttccatttctcttctctttctttgattgacagataacagtttcatatgtttgcttgtgtgttatatatgtgtgtgtctactattttggccgatctgggtctgcatccattgcaaaaactacacaacagtgtctcttttttttactgcacctatggcgacatgcgttgcaaatttgcaatgtactacagcattagagagctaggggtagccatatgcatatatggatctttccctgcctctttgaacagaatctaatcatgctattgccttggcattggctactttctaaccttttcccctagaggaatcacagtctgctggtcaaaaaagttacaagagccagagagtaaactatatatataatagtattagtttctagttgcaagcaggacatgcatcaaacacagtactactgatagctcctatgcaagctcggctttaaggacgcctaccagtcactgccagtcaaacaaacatggacttaactctatggtttgagaaaaataatcatctgataataattgagtttcattagcttatagttaatgacatgataaaatatatacctggctagcttcatgtgtatatgcttcagttctagcaaaatggcaagtgatatcctatctgaaacagggtcattcagatgatggcagaaataattttcaagcactcctactaatttgttcatgacatcatgtgttacacatcacaaaagggaagtcaataaaaatgctgcacttgctatgagatgtgagtatgtgactttgtggtggaggttctgtgacataaatgagggcctgaacagctctcagatgttccaggctttcctgcttatgcaagtagtactaaggaaatttaaaatcgcaacatcttctgctggtcccaaaggatgcaacagaatttactgcaagctgaattccagcctgattcgtcagctcatagctgcacatgtgtgtgtacctcacaatgtcaatgcatgtgtctgtctcctttaagcatacagttccaggttcatgtcatcttgatgcatgtttatgcatgcagaatgtagtgccggacatatgcttgatttgctagactattttgattttgcgattaagttattctaagcatgtaaagtccaaatcatatccgtgagcagcaatgcgcaagtgcaaccatatacatatttgctgatagcctgatactactcctaatgatgatttgaggttatcatagataggcctggtgcatttccaactgatcaatttgtatagcaaaagcaatgccaactaatagatcatatggcttgatcgactcgatctgcatatgtggagcacgtgatagccaatactcctatatatacgcaaggtcaatggatgagatcaagaactgaaatgataacccagaaaaaggcccaaaagagtggttttgtgttgctaagaacaaagctacatgagttcttgtacttctttagtaatccatggcgtacttcctatcaatttcttcaactcctaattaattgatatgatgcttcaatgtctacattttccctcccagccatagaaattgtttccaagaattaacaacaatagaaacagtcctgatttattatctgaaaaggcacccaaagggcaatactggaaatatgccaatatttggcagcaggaacactaacatgggatgctagcttctgtagagcaaaaaagagaagtggctcaggccagtagagaagtgcatagctgcatatgcagggaattaaccaagtgatggaggaatgttgcaagcaatgattgtcctagcaagctcctttggcacacatgtctcgctagattctgatgcaaagatttagatctccaacagataaaagcaggcagtagtagtgaaagagggcagggggggaaaaggaagaaaagctaaatgggaatcattaaaagttgccagctttcagaaccctgtgggtccagtttggatcaaggagaatcacaaggcccaaagagccctccctccaaagatgaggagttttctaaaagcctgtgtgagctccatattgtaacttatctaccaaaagaatgttgtgttaagacatgcatggtagagaaagatgaaggctgtctttatagggaaaaggagtactgccggtactgtattgctacacacttttttaccatggacagcaggaatcctaagtagaaggatcgaatttacttgtagctacacagtgaaacaaccggctactgattgcctactcaaaattcgctttaggtcaaacagataggacagacaatgaagaacaactagaaaaccttcagaaagcaggctgctaagcattccacatttcctccctacacgtgtattaattagtgtgtatgctcgtgtatgatatgaacaagatttctgctgtatcaagacaacaatggacatcttctggtcactctacgttgtacatacatgcatagaggatgcagatttgtactgtagagaattcagatacgtacatacctggcacagtgcagtcagtcgtcgatccagggagatggaagaagccaaggacataagatccaagcagaactggtagattcctctagctcggacgtcctctcctcgtcttggcctgaaccatcatcagcaagcaagattagacgaccggctctgaagcctgaacgtgaagctagtggtaaacaaaacaaacaacaggatagcctggccggcactgcaaccgtctcgtcaagccgaccggtggacagggcgcctgcaaccggtcatgtgcgccgcgcaagacatctggccatgcattccatcgtcgatgcctccgaccgacgatcgagccgttgcaacgaagagttgacggtgtacggcgaaattagcttgagcccggccggcctcaaactgaagtggagccttcagaaatgaaggagagaaaccaatcatcacaggcatgcagcaacgtacgattcgtcgtcgtcaatggaggttcaggcgtgtcgccggagctgggagggacaagatggcaaggccggcaggtacagccacagccacacccacaggcaggctagccgggatgccggccggcaagatcgatcggctccagctagtttagctcccaggccagtcaaggtagaggcagctcaaagtgtagtcatctcttgatcgttgattgctccagtcctatcccatgctcctccttgagctcccaatcattgagctctcggatcctctctgctcttctctgatctggtgtcgttccagtttccaaacatgttgcagaatgaagaacactgaacaacaagattataaggtaggtaagtagttgatcatttcaggtttccagagatgataaagcaatcagggatgcatgcacactgatgctgattgtacaaactccaagcaagtcaggcccaggtccaggtccaggtccattaggtttctgttcatttgaagttggtctcaatcagtttcagacaatgttgctgtaaagataatctctcgaactccaaggctatatcattgctggccatactgatagaggttgtgttacctgaaaggttgtcagaggacacaaaccaactgtcacgccgaccatctttcgtcctgggaatgcgaggctaccattaactccccaatgatgtcatttctctgagcaaataaatggtacctcatgtatctccaggaggaccagaatagcagcaagaactgcaggaaagaatgaaacaaagccaagaggatgagccaatctcaaattattacatgatactttcagcaagataagcatactaaacttcaagttaattgatgaatattattacaggattctactggttctcacaaagaccattgaatagtaagatctatagcttcggtcacttcttagaacaggaaaaacaacagtactagctaacgttcagcaaactaactgtacatttgtttgatggaggacgcatgacaaatgcaagtgcgatcataatgaaaggaaatgatatgtgaacagaagtagaccatcatatttggcatcctcattgtgttctctagttcttaagactcagtgtccgttgccgttctgtatgaatcactctgagaacgatgttttctcttactctttctcttgcttcttttttcaggatttttccttcaaagtttctttcatcagcttccttcctccctttctttttccagatcaggattttcaaaatgatagggaactggcatagcttgcttcttcagcttggtgctcttatgctgctgcatccttgagggccgggatacgtagaccccgtcattcttgcactagtatgtccaatgaccaggctggaagcacttctgacattgggtatgtgcagcaagagatgaagttgctgaaacttttggtttcacatccaatattgcagctttctctgtactaatcaggtacatctctcacttagccttcttcctctcctgccagcggcttggtccctcttccttctgcccataggtacattacgggcagcagatgtggcagcatgtttagcttgagacctgttcaaccctttagctgctgataatgcggctgtctttatacggtctactgcagctcgggatttatcatcgtttctggacatcttgattcacccaaattagggcagataatattgcgaggaacctcaccatcctgaaaggaagaaaaaaactatattggttagttatgagcaagggataatttcatctatagtaaacaaaacctaaaacatctggctaggtaattcactaacatggtcacatgaatgcagacataaacttttctgtttactcaggcttaacaccattaagccctgtaaagcacttacaaatggtactgctcataaacaacaaatcaaccatatgtattttacagttaagccttcgtgtatttagaacttgttgttgtacaattaaatcgatgaagattctatcatggcgtatacatttcaatcatatagaaccttaaagatatattttaagccaaagtaaggcagcggaaatgcaaaattgtatcaaatgctacacttctacataaatgtccgttccacgaacaaaacctctaatagaagaacatgccagttgcatactctcacagtactacacaatcagcatccaacgtaaccatcataagattgtgagaatacataggaaaccacctcttgagaatggttgtcagaatctagcaacatatacagctgctattcatagatataaatatacaaatcacaaatgattgatctgaatgacgtttaccgaaactacaacagcacaactcgaccacaagaagcatgcgaaattctcttgcagcaaggatgattagtactaattagtaacttggtgtgcatagcactagcaaggaagattagtactaatcagtaacttggtgtgcatagcatggcgtaaaggtgaacattctaaatttgcagggacctcgttaatttaaactagaggtttccactacatccatctcgtgttgcttaaaatctataaaaatactccctcctttcatattataagtagctttgacttttttttcttagtttaaagtttgatcaagtttatagaaaaaaattacttcctccgtttcacaatgtaagtcattctaacattttccacattcatattaatgttaatgaatctagatatatatatatgtctatattcattaacatcaatatgaatgtgggaaatgctagaatgacttacattgtgaaacggagcgagtagcaacaactataacaccaaattattttcatcaaatctaacattgaatatattttgataatttatttattttgtgttgaaaatgctattgtattttcctataaacttaatcaaatttaaacaagtttgactagtaaaaaagtcaaagcgacttataatatggatcagaggaagtaactcataaactcaattggacccatactttgtactgctagagaatactacccccaaaatcaactagattgcgccaaaacaatacagcaacgaaatgagcaagccaccccccgccacaaccaacccattctcttccattgcctcgacaccaaatcgcccctccaactgaccgctccaagccccccacgaaacccctcagaccaacccacctcgtcgactacctacagcaaatgcgactcctcccccacaacgactactcgccggatcccggaggcatcctcccaggaaggaagcgacgatacaggaaggggggggagtgggaggaggaagatcgattaccagttggatcggagcctcggagccggaggagatcgccggtgaaggagagcttcgcgcgcgctaggtttggcggtgggggagagcgcgtggggggaggcgagaggagaggccgtggacttcggccgcataacatgggaaatgatgggccatagactaggcctgtttgattggaccaaatttcggcccattgacgcatacccgatgtttccaactttgtgatatttacgcatactctgtttattttggaaaaaaaaaagtcatataccctccctatgtttccaactttgtgatatttgccctctttttgttggaaaaagaagtccatacactcctaacacctttagataagagtccgtctaagaacatccccagcagatatgccatccgaacatccatccagaaaatagcggttgagaggagaaaaacgacctcctgcagaaactccatcccaccctccaacattagcgcatcatctatccgggagagaaaaatgccagatttggcgttcctctctcctcacgccatcccgcaactgctagcatccagacccagttcccgtcccccatctggatcaatgccccatccaccgccgtcgtcgcaaagtcgtggagtcgtggaaagaggatggagaaggagaagcataccagatctggaaggagagcaccgccagcgacagccgtttgcgcccgctgccgtcgccttgcgcccacccgcggaccgtcgcctgccgcctccgcccctcgcccgtctgcccctgtcctatctgcgcctgccgcctgcctcctcaccgcccatccgtgccccccgcagacgcctccgcccatccgaacccaccggacgccgccgcccctcgctagccccccggctgccgcctaccgcctccgcccctgtcccatccgcgcccgccgcctgcctcctccccgcccatccgtgccccccgtggacgcctccgcccatccgaacccccccccccggacgccgtcgcccctctctcgccccccggccaccgcctaccgcttcgcccttgttccaatcggggccgccgccttacttcttcccagccaatccggggcccacggcggtggcttcttccaatcggcgtccccggttggcggccggccaagttgccattcttggcttgcccccggccggcggcggcaaaacagagtttgccagctgccccatccaccctgccacaaaagagaaggaaaggagtagagaagagcagagagaaaagaataagaaaagtgtgaaaatgaggaaggtagcagttgaacacatcacattgaaaaaaaactcactcaatataaatatatcaattaagaaattaccaattaaaattatatccattaaaatttacttatttcgaaagattattgtgataaataacatcattatcattaaaattttagtgatccaaaatatagcccttaaaaaataatacaaatgtaaggtatgttagaaaatattactaaaatacagttaggtgtgatatggatgatctgttggagtaagaatggatatggaggaggaatcttcatatggaggaggaatcttttttggatggtcatccatatgggtatatggaggatcaaatttggatgagctgttgaggatgctctaataccataacttcgaaccgggatatccaacccttcaaacgtatacaatcctccaaactttgcaataattgaatggttttggatggtgattttgcgtaagcttaaaaaagcggttttgaaaagctagtatcacatatttacatatcatcaatcattggtcatcaatttatactctctagtgacgtcgtactaatattatatcgatattcatttgcgagagctaaaaaaaggttaaaaaaagaagatttaaatagagattttaacatatcccttcttcctataaagttatcccccactaagtgcaattaagatcctaaagctcaaacctcaatgatccacgtcatcattaatttacagcccttggattggtatattagattgcatctgcaccgttggatgcaatctgcctcaatctgcctcggggtcgaacacacctcaatgaacccaggaggcccaagtcgtgaggcccaggatgcccaagtaagtccaatgagggattttagggttcagtatgtctcatctcctcctgacttcctgagcggagcagcggcggcgtagtacggcggaccctagcgctcgcccaccacgtcgcgatcacgcgcaggtggtggtggggacagggcgctcggttgcaggaggcggcgatggcgcgcaggtggtggtagggaccgcgggaggtagcgatggggagccgtgtagcgatgcggcgatgggggagaagcgtctggactcggcaaccagcgatgcggtgatggggagaagcgtctggactcggaaaccctagcgccatccatccgatgggaagaagcatcaggaaccctggcgccatccatggtgaaatcaaccgccccctccccatcctcttggctagcagaaacggtaatcaccatgcttcttcccattccccgcccttaatgatgtgcatttacattagaaacggccaaaatcattatggtactggaggcacgatggttaatacgatttacgtgcctcttgcaatttcacttcgtaagcctcttccaaaccttttgataatcctcttgcaatccccagtcctaccagacgtctcctcaaacatgtgcctctccatcagacatcatccatccatccgcaagcctcagtccatacctccctcgacatcatcacttcatcctgcaagcatattctccaattcggacatgattgcgatcccggcatgataggttagttgtggatcaactttgtcagatcattgtatgtaggcttcgttactaattttgtatgtctgaattgagttggttctttgccctaagtactgattttagttttggaaaaaagatatgtactgaattgagttggttctttgccctgagtactgattttaatatctgaaaaaaaaatgtgtgaatttattctatttgataagcctgaatttgacatcaattttgtccatattctatttgagcaaacattatgatttcaaccaggcaagatcactatgaaagctttgtaaattggattctctacacctaaagaaataatccctatcctatgcactgattgttgttcgagttatttaagaaaaataaactgatatttgcagtggatacttatatgtcctatgtgattttagtttctgaaaaaaaaagtgtgagaatttattctatttgataagcctgaatttgacatcaattttgtccatattctatttgagcaaacattatgatttcaacactgatttttgttccagttttttaagaaaaaataaactgatatttgcagtggatacttatatgtcctatcactttaatgcatttgagcagttggtgaggagccagaggattgctacatagatgtcctgacatagcgagaagctactaacctgctcggtatgtcttctgttgagctcaccccatgctattcatgtttcctgttaaaatgtgaaaaaaaatcatttaaaaaacatatgttaaatgttatcaaaatttttgaaactgtgcacatccatagttcatgttatgatgcgtttttgtcacgaaaaaggtgttaaaatgaaagcttttggatgctttagtgagtcagttcagtatgtgtaaatttcacatgatttttctcagaataatatttgagcatacattgtggattttgcacatgcaggagacctatgcactgggtactgttttagtttcttaaaaaaatagaacctgcagcttatactgtttttcaaactatgcacattcatagttcatgttatgatgcatttttgtcgcaaaaagtgtgataaaatgaaagcttttggttggtttagtgattcagttcagtatgtgtgaatttcacatgaattttgccaggttatattatatttgagcatacattgtggtttttgcacatgttggagacctatgcattgagtactgttttagtttcttaaaaaaaatggtgcctgcagcttatacttctttcacctaccctttattaatagatacaagaacatttgtttcaccacttgaggagaagcctgacaattgtcataaaagcagataaacttgctcggtatgtgtgctgttcaactcatcctatatttttcatattattttgtacatctcttttctgatttcatattccagttacatcttatgcgtatactcctacatttagcaaatataataaagttacatccgatatttgtaaatatatgatcagatgctttgttcattaaaactaaaaaacaaaaggttcagcccatggatgctgggcaaagtacttcatgttttccagtaggacgtcgccggtcaagacgtccactggcacatattttggtccctcaccctgatcatgctactgctgctgaatcacgacgaaaacgtaaactcatattggatgcccatagaggtagaggttggttccccaatttaccccttcaaattttttagtaatgtaaaatttatcgttgcctacctaccttagttacccggttatagcctatctaattttgtacccacattcccttcacaacatatagcatcatcttcagaacaacggtccttgcatcgagagttgaacagaactgaaataggctcttcatctgcatctactcctccattggctaatgaacaacgaattattggaatatcctctcattcccagtcagctgagagtaataattcttcatctgtgtctacatcaaaccaagtatttcgccatcgccgtatgttatcatatcctttatacgtaaaatttgacatatgccaaccttacatcttatatataacagtatctgccatcttccattgatatactttgttaggaacaatctatgctccacttaatcttggcagcccccagcattcttgcatccattgtggtgctttattttggtatgaagaacgagcacgaaaagaaaggcacacgaggaacccaacatataatttatgttgcaggggggaaggatatcactgccatcttataatccacctccagaacccatattgaatttgttaacttctgcgagctccctttcaaatcatttcttgcagcatattcgtcgatacaattccatgtttgctatga

SEQ ID NO: 11532 - DNA, 690 bp, Oryza sativa
ataatgcatgatagagcgggccaattcaacactccattacgttgtgggaggttaacccaatcttatttggttgatggctattgttgtgttgaaggtgagcacatacaacactataggttgcctagttttcaacacaaatatagattggcaccattcaattctttagccagctctgtgtctagaggcattacagctggttcttcggctggccaacgggttatcttaccagcctctcataatggaagccctcggtatctatatcaaaactaccaagactgcattgctatttgtaggaagtatggttgcccagatctttttgtcacattcacatcaaatgcatcttggccagaaatcctacaagctctagcacctggacaacaacctttagatcgtccagatatcgttgaccgtgtgttcaaaatgaagctgaatatgttaatggatgacattaaaaaaaataatttttttggtcccatacatgcaggtaatttccaaaacaactttcaatcaaaattcttagatacatatattattcatcaaatccatataatagttaacccttttgtacagttgtctacacggtagaatttcaaaagcgtggactaccacatgtccatataatcatttggctttcaaaagaagaacctctagatgctgaaaaggttgacctacgtatttcagctcaattac

SEQ ID NO: 11533 - DNA, 260 bp, Oryza sativa
agtttagttagtacagttgctctttttccccggatgagtgagtgatgactagcaagtaacaaggcctgtttagttcgcgaaaagaaaatttttgggtatcacatcgaacgtttgaccggatgttagagggggttttcggacacgaataaaaaaactaatttcataactcgcttggaaaccgcgagacgaatcttttgagcctaattaatccgtcgttagcacatgtaggttactgtaacacttatagctatcatggatta

SEQ ID NO: 11534 - DNA, 323 bp, Oryza sativa
tgcaagttacctaagatggtataaagcaatggtctgaaccctagctgccaattccccatcgccggccggcgcggcggcgtgcctccggcgtttcactgctaaacaacctcctccaattcatatctatccactgctccactgtccttacaccggtcgcctatgggctatcggaccccaacgcaatctgtcggtgaccaccgaccacgtctccggagccgctactatgcccttacccacagggacctgcaattgcgcatcactcacctacgacatcatacaacactccttacgacaatgactgaccacttgaccatctacatata

SEQ ID NO: 11535 - DNA, 1095 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagt

SEQ ID NO: 11536 - DNA, 1261 bp, Oryza sativa
acaagtttatggctgttgctcattttcttacttgcggtacgtagcatatagacttttagtggattcaagattgagagcatcaagctcatgctaaaacaaagtaacccaaaagaattttacacatgcataccttagaattcccgtgccacaaccaacatcgagcacagttgcaccattcatgaggctaggattgcctaaaagggcatctctgtaagcttctgttcttacctgaaaaggtcagtcagaaatttattagccgttgggcattttggaaaacaaagagatagtatatgtttagaaaaacagtgtcagggtttaacctactttgtcaccaagcatctctctatggatgccaaatgaactatacgacccgaagtagctctcatccacacttttaattcccctagcagcagcactagcacgtgcaatttttaactgcttgtcacttggctcctgagcaagagacccactgcactccccatctgtactctcaatagtacatgttctctcaaatctatcaatgacatcagaaccatcattgataatagatttcagattgctctcacatgtttcagctaaactcccattgcctgctgaacaccctcccttttccattggcattccacagtcgtcctcgtcatcatcatcaaagacggacaaactgtgcaaaagagaatcatcctccaagaatggttttaagtatacatcatcaccccatggaacctttccctctagttggggaatctctaatgcatgcaaatggccgcatagttcgctgttgctagagaaaacttgcccacagctccaacatttattctccgccacctacaaatcaatcttaataagttcataaggttcataataatccatgaaatggagcaaaaaggcacagaaactaacgaaattgcaatcgaaatcaagtgaggtctagttcatgaccacgcaaacaattagcacaacaattaaattaactatatacggagtatacagctcgatttcaagctgctgaagctgaaaccctgacgcaccttggaccgaacgaagttgatgagcttgatgcacccgtagaaatccatccccgtctccttcacgaccctgtagaaatcaaaccggtgctcggaggcgcagtgcgagaagagcgagctctcggagtcgaaccgcgcgctgcagaacaggcagaggagcccgccgccgccgccgccgccgcccgcgtcgtcgccgtccgactcccagtcatcccacccctcctccccctcctcct

SEQ ID NO: 11537 - DNA, 20317 bp, Oryza sativa
gcagctatctcgtgcttttccagggtattaggtttgggggggaggagagtaagtaggataaccaggttgtgcatgactgcattagcttgcctcgccgggaaagcaatttcttggagcaggtgagacgattcccccgaagtttttggtaggctagatgatgcaagtgtggttggtctctgtttgggcttactgtgcgtgtaatcttctgctttgcagtggtgtcaaagcagcggctgggtgtggtctcggcttgcttccgcagtggcgcggcgtgttccggagcgtgagaatggagagtgggagctctcagggtggccgtggtgccctcatagtcctggaagggctggataggagtgggaaatcttcgcagtgtgctcggctgctgtcctttctgcaaggtaaaggttgccaggccgaagggtggcggtttcctgatagaggtactagtgttgggcagatgatatccgcgtaccttgcgaacgagtcggaacttgacgataggacaatccatttgctcttcagtgcgaatcgctgggagaaaaggtttgttcttttcaacttgtaagataaacgatatgtcgaacagcttatgttataggtggaaaattttcttcagtgatacactatgtgcagtgatgcaaggtctttgtggttctaagttgtaactgtggaggtgttgctttggtctgccattttcagagctttgatggaaagaaagctacttggtggaactactctcattgttgatcgttattcttattctggagtggcattttcagctgccaagggacttgacattgagtggtgcaaggtgagtagggtaccatgtggccatattatgaatttttcttttctagccataaattgtttatagcagtaatccctcctttttccttttgtaggctcctgaaaatggacttatagccccagatcttgtagtatatttggatgtacaaccagaggtatgctatttgttctcattcttcctatggctatgttctagaatatagattccttttgttagtattgaaaggcaggatttcctcagtttcatgcctttgactcatttgcatattgtagtgatgatagccccattaggtccctaatctaatcacataagcatataaatagagaacccattggccatcgagttttacttttacccctaaggttcgtgtctgtctagtatgcattgaaactctaaaaaatcaagtcaacctcaattcttcatcatgttgtcggttgtggaaaacatgaaaactgttccgcagattctttgctaaccccacttgccttgttatcgctcacccaaagggattgaacaggatttggaggtaataattccacagctattgaggtgtggaattaatcccctccactccctttctcatggggattaatcaaacaagcccttatgatgtgatgttgcatgacataaatatgtatttgccatttcagaaagcagctgaaagaggaggctatgggggtgagagatatgaaaaaattgaattccaaaagaaagttggtgagcattaccattcacttcgtgattcaacatggaaggtaatcaaccagcatagtacttaatttaagttggatgtgcaagtgcagtgatctgcctgtcattcattttcatttttctgtattcatgatctataccatgacttgtaagattgtgtagaaaccagtagaatgcaatagtatctcaagaatttggttgtttcgttaaagtatggtcataataattagttctatagtcaaccaattagtaataaataaatctgattaacttgttgcattggttgtgtcacgtaggttgttgatggctcccttcccatggaagttgtggaagaacagctgaaggaactagccatgagttgcattctggaatgccaaagcaagcaacttgccagtctggcctggtagtgtatcgatagcaccatcccttggtgccaatgccacatcattatcgatggcctgctagagttatgctttaaggagagcttgctgatttctgtattctatgtgcacttctatagagtgatgttttgcgagaacttgttcgctgatgttctgatagccttttcgtaatgtgaattatgtgaggttctgctgttcttgtaagcttctcatatactctgtttgccaaatttgagttcataaaatggttttgcagtaactaatgagaaaagtcgttttgaacctgaagaacaccttgcaggaacgtaaatgtcgcatattagccaaaatttttgctgtgttgctcaatcaataaatcttaagctgcaaaatatattgtaggcttcaaggagacaaaggtaaaagataagtctgtaattcagaagacagaaattcaccaccaggacggtatgtttctgctactgattacacgagtacagtttgtgtcgattttagcacagttaatactcccacaaccacacattcactaactttggtcttttacacataactgtcgatcaaagacttcctcatgtcatcaacaatcgcggcaggctgcccttctctcagcttgaagacgctctcaatgaccgatagctcagtagccgtagtgtctgagccacagaaagcagtccagtcattcactgtcatgcccgcagcaatgacctcgctgcctcggttcacggttccagcaacaagagggacttgcaggagcgtggacagctcatcaagatcttcaatggatgtatgaggatggacctgtttcgcaattgttgtacaataagaaaaagaacatttgtaacaaacacagatcgaatggaacagaaatgaagtagaaaaaacatactaggccacccctgtttgtaatcgcacagtagcttcccacaaggatgtttcctgcaattgtctgccggaacacctcaaccccaagcacatctgcaataagttcctcagtggcctggagaattgagcagcaggcatatttagttcgagacaatagggaaaagcattaagtcaagaaacatcactagagagatatacgaagataggcttaccttgtcgaggtcagggtgtgtaagcgcgacatggtcattgcaagctacacaattgccaagcgcagatagcctttcatcaatacgctgaacaaccacttgatcaggcaagcagttcctcagatgctgaagctctagaacaattcaaacacacagggaacatagaattactacaaattcatggtgaaacttttgtccatgacaaaatatcataacacagcatcataaaccaatcaagctgctaaggaaaatcaattcgacaacacaagcatggaatgtatatccaactggcatgattgattgtatctgtctagcagatagtcacaatatccagaaggccttggatattacatgaaaacaagttccaaatatactacaacactatcaagccatgtgcctgtgctcgtacaaaagaaaaataataatgcggcagacagtgtaagtccataattgccttaacaactttgccctctgtgcaatacccaagtaactgtaactctgataataattatagagtaatttcaatgataattatagtacctataatcatcaggtagataaaattttctttcagtacatgtacacattatttagcttagaaaagattttctgttttcctataagtccataaaaacggagtgtggctaaagaacatacactgaaaaactatatccatgtgaaaagttactaatttattgacacatatagccaacatgtggatgacatcaatagcacagagctagcagaaacgatgtagccatggcagcaaagatttataggagaaaagatacaaaaatagagtaccttgatcggtggtagtgtgaggcaagagaagtccattcttgtttcttggacatcaaagattcaaattggtaaacgaaaaacaagaaggcaagtgcattaatccacttagtatatccaagctcaagtactaaccgacacagagacgaccaattattctagtaccacctatggaggtcttgacaacaggaataacatctgcgagctcagattcaaaggcactgcaaaataacaaataatgcagcagttatgagttaggcattcccacgcttccacaaataatttcccaacatcttaaactgacaaaatatgcacctgtagaagttctctgatcctccaattgcaacaagacaataggcatttgtcaactggagaaaacaccaacttcacaattgttctcaaactgaatacctacagatcgtgtattcaagaaaaagcagattagatacggaagatgtgtaaaaggcatttgaatcaaacatcacccaccagttcagaacccagtatgagcaatgaaacctaaccaaccaaattagaggtgcgctacatcacatgattaagtgtagaaatttcagcatagaacaacaaatgagatgctaagaaaaagatcttttactaaaagctaccgtaacaagctaccacttttgtcctcaaaaacattacattctaaacactgatcattcagaaaaatctcaacaaacattaaacccacttgactagccccgaaatccattctgtgatgctgcttcagtcacaaaactactcatctaggcatctggccacaagactaatcacccaacagtactaatcgcccaatccgtcgttgccaatccccaacgctacaaaatatctcatcgaagtaactaacagaaatgaatatagagctacctaatcacaaaaaccacgagccgcaaaacctcaaacatgctgaaacttacgggtcgccatggtcgattccgcctcgtcgcagccgccgcttctcttctactaatcaacacacacctgcagatcaaacaccgaagatgatttaccccccaccaaaaaaaaaggagagagattacggagtaatcgggtagcatagacgcatccactattcggttccacgccgctgccaattacctggaacgaaaaggcggcgaatcgggaggtggaggcgcggctagggtttgggggtgcgcgcgacttccgaggccgagacgggggggaatggtctctctctcgcggcggtatatgagccgccaccgcttgggcggagacggacgcggccgcgggtgggctcgtgggcccacttgaaaagatacagtgaatgggccgaattggattgtgacctatcgtgggcctctcgtgaccattagatcgcactttggaggcccagatccactgcggatggatggccaggccatgccgtgcggcccattttgccaccacgcgatgcatcgacgagggaaaaaaaaagtaaattttataaaaccacatcaacgaggaaaaaaaaaagtaaattttataaaaccacatctgttatgatccaagttacacaaaattataaggattttggcaatgtggcacataatcatgtactatctactatggcatatgtcaaaatggttaacggtacggttttgtgaaactttaggactataatatccgatgttacgtgtcacgtgtcaaatttttcgtggttttatgcaattttggacccataatacgtgggattatgaaatttacttaaataaactagttctagaaccttctagaacgaaatcacccgctacatctgtagagattttctcgcttgcagcgtcttctcagtgcttgattccgtgagaatttaagctcgaaggagaaagaaaacaccgatcgatctgttcgtgggtctttccaacctaacggaggattcgagattaggagtatttttaatgccatgatttggtgaaacagatggaggacggaatgagtgtgtagggagaaatgggcggttgggcatcatcacaaggtgcccagatttccttctttttcttttcggatatgaaagggaccagctagattaggttcgtctaaaattaatctgagcaaaaaggagttgtgattctagtggattagtttatcggaaatttctgtgtggttttgcattccgattattattcattcagtagcttgatcactagttggtccctgataatgttaattccaattttgtggtgtcataatcatattatggactgacactctttttttttttagcaaacttatggttgtgtgtcttaagctgaagatgtaatccattttcattatcttaaaaatggattgactctctaacttgtctgtctcggttaatcttgcaagttgctagtagtctacggaatcattcatcaaacttatcttctgaattttgcacactttcttgggaaaaatatatgtgtggttttcagtaattgaggatggatctctgaacctgaaactgaactttcgacaaacacgagaagctatctctgttggaaagatcaactgatcagaactgagaagcatgagctgaattagtcctttcggattcaatcttgatgacaagcctgtttatttgcagagtaaaaaaaaagacagacattgttgccagatttcgctatcacggttggatggatgaaatgtgcatcatgccgtatgccattgccaggataagataagaacaccaaaacaaaggcatctgataggcaaaaaaaataataataataaaggctgcaattgttctctgcctcctgtttaaattcctgctgggtttccaagaaggatgtggctccaacgcagctatattccaggtgaaagcgatgatgaacccattaattatatgatagctcttttaaatattactagtgtgcatagttttcattccagattctagaagacggaaatccaatttatgcatgatttttcttgcctgcttcttttttcacgaacgtgtaaaagaattgcatgtcaatatattagattctttttgcttgcttcatgtgcaaagaataaaacagatgcttgcgtccctatcaattatcaattgcaatccggtatacgatttggcacttttacctacctcttttccagccttttgcacatataatatatgtgattagtcactaatgtcagtggtgtgacctaaaaaaagtgaatattaaggaaggaactactatcaaataaatagaaaggatgagggttcgaacttaggtcggctagcccaccaccttgtgaagctagccgaaaaacccctgagcatttctctgaccttaaaaggacgtttatggattatttagcgggttgcatggtgtttacttattaatttattccatctggtgaattattctaggcttttagctgccgatactttgcctggtatgtgatttattgccaacccattcatagtattggaaggacataaaccaccagtggttgaacatatgaagcaagatgaatggttggtattataagggacaactaaaatgattttgtgcactactgcagtgaatttcttggagtgttcaatcaattcattactgatgacacccactagtagggattaaacattgaccagtcaaaaaccataagcattcagtatacctgagtctgtattccaagaattactagtgtttaatgaactgtaattatttccatttctgctcatagagtttagataaatggttcaagcaagtgacggtgaatctagcctgataaacaattccagaagggagtaaagctggtgatctaatggaagaatatggcaccttagccttttattacagtgcatactaatgttcttacaaaataaagaagcttcagcaaaatcatctttgattagtgttgaaattagtagtaaaaacgtgtcacatggattgaactaactaagcacaaaaagaatcgaccattttgtgatcactagtactacatttcatggagcagctttatttttaatcaaaatacagaatcttacagaagtgattgttgtgctacaaataaatcgtcagttctcgctttagtagggctaagactactaaaggtccacagtgatagattgcaaaaacacgcacatattcacaacctttcttgagctttcttcttccatcaatctctaacaagagtacaagacatatgcattatttcactggaagttagtactatgccatcacaatctttgcaaaagcaactacggcataactgtaagaaataatcattactatgttaagctgcttagaaaacattatggtccttatatataatacagtattattagcaggtacttgtttgtataagagcacaagaaagttaggagtacccaaaaaaaaagagagaataaagggtaaagggagattataagcaggagaacaagttgtgtatcatattgtttcttgatgcatttgtaatttgttcgtctttgctctcagtgtacgaacgtttctctgcttctcttcccagttcttcaggtgctaataattgtttttagcacctagagttatgtttctcattttgaagtcagttatatttttagcgaattccctagtttgaactttaagttacaaccaagtgatttcgcatgatgcaaacgagcatttctatctgtgctgtatatctctccttttaatgcctttacactttacagtgggcgaatccattgagaacttcttgatcccgggggctttgcctttttttccacagtttttttttgggctcacatctacgtcagaagagaccaacttggatggctacaaggctattcttatctgcacagacgattgaatcattcaggaaaatccaactgagcaacagcaaagatgcgtgtaccattttatggttgttatttgttaatgatctttcttttatactgacactattttaatccacttttctattgtaggttggttggttcttcgtagtagctcactacttctggttcaaaagagtaaaagaagcaggacatgtttggtggtggttggcaatgcctgattgaagaacacaagattcagatcaagcttgcctccgagtagttatcatcagaaattggcaatggatctgtcaaaatttcaaaattatggtacaattgtacgatcttaattgaagtgtgtgattatgagaaacgtttgttggaaatttggtcataattcggcatattttaatccaaaatattaagacaataaacatgacatttgtaatatgagtagatctagtgacagtgttagatgtatacaacttgagtatgcttaatatgaaataagcttcaacatttacatagtaatgcaatgctgccattgcgaagagtattaacaaagaaacatctaatagaatcgggagaatgaaagtataccccgagaacacgtcccactgctggattttgaggcagtattgcctccgttgatgtcgttcatcttcttgtttccaatctccattgacatcttggtgaaggcgccgatgcaacaacagtagccacgaagaacaagagcagtcgcgcttgaagcgctatccaaaaacttgattgcccgcctatccgtgcaagttctcaagtggacagagttccggaggcacctgctcgtcccttacacctgcgcgcgcaggtgaacagaaccggggaaggattctgcagcttaggatcagaggaggaggaactcgaagtgcaagagtcgttaaagaacttcttcagtcctttctggtcgctgcggagtatatatatgcgagcgcgagagtaacgttcggagtcatcaaccgcggtgtttaatttcgtaactgacgcgctcgttaatatggaatcaattcacggcgtttaattccgtaaccgacggaatcaattcacgacgtttaattccgtaaccgtctgttacaaaacaatcgttcattgatacgaaatcaattctccgtgtttattaccgtccgttacaaaacaagagagcgctcgttaatacggaatcaattcacggcgtttaattccgtaaccgacgaaatcaattcacgacgtttaattccgtaaccgtccgttacaaaacaatcgttcattgatacgaaatcaattctccgtgtttattaccgtccgttacaaaacaagagggcgcaacagctgtctgcctcgcctcgcgcccgcctggttatccgcgcaccatctcaaccagtcaacagagactctccactagctccgtatttaagttgagacctcttcacttagatttccaatgtggtattattacccatagcacttaatgtgggccaatggaatttattagtatttaattgggcctagcccattaatctaacacagaggtcttccggttagctctacaaaatggtaggctagacgatctggatttgaagcatcaccccttctaattattcgatattaggttcttcctaatattcgcgttttttaagtgtgtgattctacaattctttgtacgaagaatttacggtttttatgtatataattatataattgtcatcctacttagaactttcgatttagaatcgtgattttaacgaccttgctcatgagaactaataagaaacatatgagatcgatctgtggcctctgcatcaaccataagatcataagcagagtacacgcgcagctgctgcaaatcattggagattgcaagaacagagagccgtgggctcagtctgtcaagctcgtacgctggttttgtcatgatttcttcttcctttttcttttctgaagcaattctgttctgttctgttttctgaaccaaaccttttggatgaattccaaatgctgcagcctgaatctggtggccttatctctgctcctacttgccaaactttggcgtcagcattttgctaaattattatatctgcaacctgcaaaacggaatatgatatgatacaatatacatgcagatttttctggaaataatttagcctgctactgtacatgagtatatccattgtacatgtacatgtacatgagtagtatatccattatacagtctaaatccctataaaattacttcgtccagtttttaatacacggcagcgtcgttgaattttgatacatgttccaccattcatcttttttattttttttttgcaaatatataaaaatgtttaagtgcatttaataataaaccaagtagaaaaaagccaataattacatttttttttctgtacgatgaataatatccaaaaacaaactgccccatcagttatttgaaagaaaaaaaaaactaacagtgctcgttttccatctgaaagaaaactgagcaggtaactattgtattagtgtcaatctaatcacaaacttagatgtttatgacccacaaacataacactagtgctaaggatttaaactccaaaacctgtagtagtttataataatttttattactgaaaatgtagttttacgatacttcaccttaaatatgttctatgataaatctagtgctaaatctatagttttataaaacatcatcttaaatttatattttttttataatttaactaaagtatccgtaatttcgtgtttttttttttgcatgcaaccatgtatcacggtcaatcaatgcagtagtatgttgtgcgcagctatcttgcggctgcaccgagtccacgaagcggcgttggcatcgcggtggggcccacctgtcagccacagccccgacgagacgagagacctctcctccgtctcgctctcctcctctctcgattgcttttctgcagttcgactgttctactcctcatcgactgggtggtggtgcgcgatgcgctttaaaaggcgtcgcctttgcctccctccgccttcccctcgctgcaatctcatcgtccactcccccgtttccatccccccgaatcttcttcttctcttcttgcggtgactgagaagaagaaaaaaaaaagaaagaggagaaaaattgctacgagattccttcttcgtcgccgccgctgctgctgcgttatccccaaggtgagagctttttgtgctttgagcctttggatggtgtggtttggtgggggcgctgatggttggggacctgggtggtggtgtttgcccgtgcacaattcgttcccttcttcttctttttttttttgttgttggatgctcgtgtaggctgtggtttctttgcttgctgacttacagtggatttttggtggggtttgggggtgcgattctgaggtgatcggcctcaaaggtggtcgctttggctggattggttcttgggttgagtgaatttcctctttgattttgctgcagttggtgtgtgttcatgccttgcctggtgtttgattggagaattggggtttgaggatttgtgcggtcctctgcgctgttaagttttcggtagagacgtggagttgactattaagagcataacatccttcaagaaaggattctttgcgtgcattttctataggtgcagatcgatttcaggaagtttcagtcgattcgtataggataggtgatggttatttagtgaatttatgttctttgtgagtttgagtttgagttggttgtggcaaagttagatggcaagtacccaccacaagtctacaagtacctgcttgttagtttcttctgggtaggagcttcgctgtttagaacaatttttgtgctcttgttcttgtggtcactggtcaggcttggttttgcagagacaaaaatcacatatgtgatgtagccttcaaccttgtactgtttagtgttgaatttggataaggttgtcttcggttgaaccaaagcattaggttacctgtcctacttgttctcgccttctgtgagactatattatttcttgagttgttcacttcttaataaaatctttaggacaatgattgctttcttttttttggttgaaaggaagaacaatgattgcttcatcagttctggagattgtggttcttaatgtcgtccttgtgcagataaaaaaaatcatctggttcttgttcacatttacttaggggtcatacattttttacttttacagtgttacagccttttgtgtgccctgctgttaacctccctgcaacctgcatgttgtatgctcaggagcctcattgaggcatatgaaactgcccgctataatttcttcttgcctgatgcttaggattttagcaagttcataatgatgcagtgatggtcgtgacatcctgctttttgtctggtgtagtttatgccttgctaatacttatccatttattgatctttgttctgttcagatttttgggatagtgttttctgttctctctcataactcataagggtaaatgggttcagaaggaccttcagttgttactgtccatgttaccggatttaagaagttccatggggttgctgagaacccaactgagaaaattgtgggcaatcttaaatcattcgtagaaaagaaaggattgccgaaaaaccttgtacttggaagctgcacagtgcttgaaactgcagggcagggggcacttggcacattatataaggttttggaatctgccattgcagaaagagagaatgggtcatcggctcaggggcaagtaatttgggttggtatccaccttccttgattccatattacataatgatgtaatgcagtcagcaccttgcgtattgcaatgctgtcctatcagaaaaagaataaggaagtttctatttgccttcaatgccactcgaatagtcaaactaattatcatttgaaacttgttcagatccattttggagttaatagtggtgcaacaaggtttgctcttgagaatcaggctgttaacgaagccaccttccgttgtccagatgagctagggtggaaacctcaggttgtgattttgtccaattacttatctttgtctatatatcttgacattgtgtttaccggtttgattgttccgtgcagagggttcctattgtaccatcggatggagccatctcacggacaagagaggtacaagttaaaaaaagtttgtctggaaattaatggatgtttgttgaaagtacagctacgaacagcagagttacatattatcttttcatagttcactagtcctttccccccacataattctaatggccatgaccccacaagacaccttcccattgaatgaaaaaaagaagtccaaactgccaaatagaacaccataggtctgctgcgatcactttcttcactgttacgttacctacgcgagcttgattttcagaagttctattgaacatctcttttcttcctatttctttcaatacgaacaaatcagttaggaatatattcaaaaggacaatggtaatctgtgattgcctgattacagcacgatcttctctacaaaataatatcacaaatgccccctattattttccccacatgttcagaatacccatattttgtgtttaaaacttatcataatggaatgtttaaaacctaccataatggacttatgtggtttgaatatgttgcctgtatgataacaaacaaagatagttcatatgcgcattattgaatgaataaaatgtcaatcatcagatatttcaagttttggattgagagtactgttgatcttgagactaatcacatttatctgaacttttcatgaacaaccagactacgcttccggtaaatgagttgaccaagtcactccggaagacaggctacgatgtaatgccatcagacgatgctggtcggtttgtatgcaactatgtgtattatcattctcttcggttcgcagagcaacacggcatcaaatctctgtttgtacatgtgcccctgttcttgacgatcgatgaggaggtccagatgcattttgttgcttcccttcttgaagctcttgctgtcttgaactagggaaaaagaaataacaattcaatattggaagcaggctgaataaaactgtattgtcatcgatgatattggtcttgctccaaagggtgtatttatgaggaaattggctgcttagagtgtgttcttggtcagatgccacttgtattccactacatcacttgttctaaacatgcctgaaaacaaacttggttttcaataaaaatcgacagatcgtcgaaatggatgcattgcatccagtacggttgttgatgttgcttttgcatttctgatgccagtgcgttggtgatttgccagtaaacaaaacaacacccgtcctcgtcagagttcagatatatctgtcatcctttcttccctcttgctttgatagaaacaggaactccattttgcattttcgctccagctttcacccgttttgtttgagtcgtgtgatgttaactgaatttctaaaagaaatcaaatcacttgcctttggtcagagaaagaagcgatgccctgtgcctccttgagtcgaagttcacagttcatcagataacagaaattcagaatctccagaacattttacagcgttcgacgctccctgcctgcaactgtggcaagcttgcatgccgaaaactgcagtgctgcaaatctgaagtgaatggtgattgcaatcagaatctaggtaggccgtcggtggccttgtgatttgggccatatgggccagtttcagtcgcagtcccagatgttcctggggcctgattacatggctggtaaacctgctaggctgctagcagcgatgaaagaattcatgccgttgttggatgttcgcaaggtgccagataagcagcacttcagtagctagctagggatagatcgccatggccggagctaagcttgccgctacagtggccgcatgcgccttgctcctcctagccaccgcggcggcgtgccatggcctcgaggtcggcgccactaccggcgttcgtgccccaaggcggaggccctcgtcagggccgaggtgaagaaggccgtcgtcaagaacgccggcgccggcgccggcctcatccgcatgctcttccacgactgcttcgtcgaggtaattaagcacatcgatccaccaatggcgacgcacggcgaggtgcgtgctcgccggctaattgattagcgtgcgccccgtggcgtgcaggggtgcgacgcgtccgtgctgctcgacccgacgccggcgaacccgcggccggagaagctcggcccgccgccaagggcctcgccgccgccgacgtggtcgtgctctccggcgcgcacacttcatcggccgctcccactgctcctccttcgcgccgggccgcctcgcctcggcctcgccgccgtccgacatggccgtggcgctggcgaacctcctgcggaggcggtgcccggcgacggcgagccccgccgccggcgacgacccgacggtggcgcaggacgtggtcaccccgcgcgcgctcgacaaccagttcgatctacaagaacgtgctcgcgcgccgcgttctgttcgcgtcggacgccgcgctgctgtcgtccccggcgacggcgaggatggtgcgcgccaacgcgcggctcccggcgtcgtgggagaagaagttcgcgagggcgatggtgaggatggcgagcatcgagctcaaggccgcccaccgcggcgagatcaggaagaactgcagggtcgtcaactagcgagctactgattgagctaagctagtggccgccatggatgatctgacgtttggtctcgttccaatccatctttcattttttatttcgattgcgacgatctgaagaacaatttgtgccacgatctgaagaacaatttgagagtgaagcgagtgatctactgttgggttggtggcttgctttggttctgttcttgcaggggagaagtgtttatttgttgattaattttgtcaaatttggtttcatttgctggcgtttactgtcatctcggatgaaaatgtaccaaatcctctttggtattctatttgcatgcaacatttgggaaagtcaatttacaactccggtgcacatgtactcatctcttgcatgtcatatccaaattgttatgtactaatttttttataaaaaaaaagagtataacaacagaatagattacaatgttatactacaatatgtcggattactgtaacattttagcagtaacaacaaatatgagtaacaatacagtcttctggtataaatcaataaattaaatcatgtaccaatgtataaattcagctcaatttaagttcgtaattgaatggtttttttttcagtcatgtattaaacatatggcttgatatatgcaattgtattaattagctgacgaccctgcagttcttcctgatctcgccgccggcgccggacttgacctcgacggcggccatcctcaccatcgccgccctgaacttcccctcccacagccccgggatgatcgcgttcgccagcaccgccaccttcgtctccagcgacgtcagcagcgccgcgtccgacgtgaacagcgcgctgccgttgagcacgttggtgtagtactgcctgtcgagcacgtcgggcgtcacggcgtcctgcatcaccgtggggtcgccgccgccgccgctgctcgcgttcgcgctgcactgctgcgtcagggaggcggcgagggccgggttgatgtcggagcccgacgacgacgacgagttgaggcggtcggagaaggaggagcagtgtgacctgccgacggagtgcgcgccggagagcacgacgaggtcgccgacgccgagccccttggcggcgaagctggcggtgagggcgctgaggttggaggtcggcggcgggaggatgccgagcgcctcgctggcgagcgacacgcgcccgtcgagccgccccgcgggcatggcgaagtcgaccccgctgccgctgaggagcacggtggcgtcgcgcgcggcgaaggcgacgacgtcggcgcaggagacgtcgcccgggcacgccgcctccagcgccgccttggcctcgtcgatcacctcgaatccccgcagcgtcaggttcggcggcgccagcttctcgggctgcgtgttcgccgccgtcgcgtcgaggaggacggagccatcacacccctggacgaagcagtcgtggaagagcaagcggatgagccccgctccgacgccggcgtcctgcgccaccgcgttcttgacgacgcccctcacgatctcctcggcgttggggcagacgctgtcgtagtagccgacggcgagcccgccgccgctcgaactcgggctcgggcttgggcttgggcttgggccgtaccctccttggcccatgacatggcccagcaaagctagcacagtgatcacagcagcaagcagcttagtcgccatggctgatgaatcgatcgagcaaaaatgcagaagcagctacgagtactgaactgaagttgtgtgtgcttttttgcttcagttgcttgggaagcttgtgtatttatagtgcgaggagaacgtacggtggttagaagattttgtatggttagttcgttggttggatgcgtggtaatgtaggattagcttaagctaagccagcatgaacggtaacatgggagccaataattcagaggttgacttgcgacttttgcttttccagtgattatgcaatctgtccggggtttaattaacaacgcgttaacatattattggactgatgaaattatatatgggagttcaatttgaggtgtttgtagcgaatgttgcttggataagtctgcatgtgtgtctccggaaattcagagtttcagtgggcgaaccctctgataaactgaacttgagagtttcagagttggagattcgctggcaataatcacatccgtagagtagggagagcaacgcgtcattcaacatggccaccggcaggatgcatgatttgtttacaaaatggtgattgcctaatataatgcatgtactccgtgatttatgcagagcggtgagtttaatcaaattgaacagtattaaatttcttgcttaacatttttgcttcagacagcggcaaagctccctctgctggtttcaggaaaggtctctcaccttgtgaacaacagcgaccggggaagacattaacttgtgattacaaaccgtgtcattgctgattagccatgaactccaggcaaaatgcagaagagaagaacaaaagtcagctctgacaatgccaagtgccaactaggttttcttcagccgaaatgaggtttcctcaccaagaagtcaagaacatgcatcctctaaagtatctactccagatgaattgggctaagatacatttcaatcattatacgtgcttagctgtttgtaccgcaccgacttaactgaaactgaaactgatcatccccttggcaacagctaataatctcaaccgcttgatgaagccggtgtggcggtgtcgattcagtaaccacatgaatgaaatgtttaatattcagagtttctcattatttatacagagatttggtacaataaaatttactttccaatgcccaagaggccaagaaactgcataccatccacaactctaaccaacgtttccattgggttgtgttgtcgtgcagaaaactccctaccagacagtcttgttgcttgcaaacaaactattgagtggaagttcattttaattagtccatgtatattaccaaaaaaaaatgtttgacatatcctaaaccacatttttgccaagtgcaactgtgcaagtcatgtttagttcttagcttaccggaacagagttctttgacactactgttcttgctctcagtaatacgatgataatgatacagattgccaagttgatctccatccgatgtcgtttgaaatgtagatttgagattttgttaaaatttgttttgaattttgtaacgaatatttggacatctaaacgatattgttaactacaaagttgtatatctccttgagctctacgattttgatataaagtttgatttcatccgactttatatggtgtatattttaaattacaaaatcatagagttaacaagctatattggaaattttatatttaggcccctcaacatcttttggagggttttttttttaaaaaaaaaggaggatgtggaatgtatagatttgtaaatttttgaaaccaaaaattactttttaattcttttaataaaaatgtaaaaataaaaaaaaaactccagcctagaggaatgggccataaacccatcagcaagcccaatacatttgggcctgttgcccaagaaagaactcataagcctagaaatatctgaaaggaaaaggtacacctaaggtccctcaacttgtcatcgagttacaaaatcgtcccccaaccgcaaaaccagatatccagtgtcccttaactaattaaaaccggtttacttcgatggttttgaccccggttttggtctacgtggctgctgaatcagcgtgagacccacgtgggccccacatgtcaggctgccacgtcgtgagtgtctctctttccctctcctctcccttccccctccactctctctctgcctgtctggggctaggcgggccggcaggcggttgggaggaggtcgtcggggcgaggagctccgacggccggccggcgatgcgggagaaggtgagggaggcgacggctgcgttgtcccaccaccatgagaacgccggcatctggaggcggaggccggcgcgctccaccatgcgaacgagctcgtcgtaggcctcccagtcgtatcactggggaccc

SEQ ID NO: 11538 - DNA, 15630 bp, Oryza sativa
ccccccccccccccccgcttctcctcggtgattgcagcggctgaggtcgactcccctgcctcgccgtgctcttcctcggcgagtacgtgcctgaccacacgctcgacgcagtccacgtcgtagagcgtcttcatgccgccggagtagctcgggatgagcacgtcctccagcgtggcgtgctccagctgcgtcgcggccttctgcccgagcgccgcgtccaacgcgagcaggatgtgcgccgtccacagctgcgcgaacaggaacttggcggtgacgacgcgccccgagcacttgtcggtggggacgctggtgaccaccgcctccaggaggtccctctgctccacctctgacgacgccggcgccgacgcaagccgccgcatcgacctcgatagggcggtgatggtgcccctggcgtacgacacgagacaactctccctagcctccgtcctcacatcggcgcgcgccgccatggcagccattacccttctgtacatgtccagcccgaggacggcgaggtcgtcgaaccaggagcgcgacgcggccgacgagcgcgcggtggtggcaaagggacttgttaagtgatccatgttttgttcttcatttaaattcactcttacggcagtggtaccgagaaatggcagtcatcctctcttccgtttctcctgtcgttctcgtgcttcagaaaccaacagcgtttgccagtaaggatgtgtttttatgcgtacgaatttatcagtttgtgtatagcttcagacttgcagaggcctctgtctctctgtgtctgtgttgcttcgtatttgtcgactttcatcacccgcttgtaaatatgctgatggcctccacgcagcgactgacaatgccgagctcctcggcgtgcggcagcagctcctcgcgggacttgagcgccttggtggcctcgcaggagtgccggagcactgcctgctccaggtaggcctccacgcgcgcggtcaggttgtcctcggcgtgctcctccgtcatctccaggtactccgccgcgcaccgcagcggcgcgacgttccaggcagtgagctcgacgcggacgtagacgagagcgtcgtccttgacgggctcccactccagcgacgagtcggtggcgcggccgccggggggctgcgcctgcagcaccttgcggcccgttatcccgagcaggaagggttcgttggaggcggagaggtagcggccatagcagctgcgccgccgcgccgctgccgcatcgccggccggccgtcggagctcctcgccccggcgacctcctcctcaccgccggccggcctgccccgagaggagtgagagagagagagtggaggaggaagacagaggagggggaaagagaaacactcatgatgtggcagtctgacatgtggggcctacgctgactcagccgccacgtaagctaaaaccgggtcaaaaccactaatgacctattgtgaccggttttgcttggttaagagacggttttgtgtcaaaaccactaatgacctattgtgaccggttttgcttggttaagagacgattttgtggttgggagacgattttgtaactcgatgacaagttgtgggaccttcggtgtactttttcctatctgaaatcaaactccttttttttttctgaaatgggccaaatcaaattgtttacgttttaaaaatcgactttgcgaatttcgatggtcaaaatttggtcatcgatttgtttcaatcgttaaccatgtttccatctcatttattcgctcattttaaatacccgagctttctctctgaacgcattgactattccacaccgatggagacggagttgcacctcgccgccggctactgcgccgccacgggcgtctaccggagcggccaccctccgcagttcgccgccgccgccgcgctctccttcccggagtacatcctcccgcacatgctcctccccggccgccgagcccgcccggccttcgtcgacgcctccaccggcgccgcgctctccttcgccggcctccgcgcgctctcgctccgcgtcgcgcgcgcgctcgccgccgccggcctccgccgcggccgcgtcgcgctcctcctgtcgccgaactcgctccacttccccgcgctctcgctcgccgtgctctccctaggcgccgtgctctccgccgccaacccgctcctcacgcccgacgagctcgctcggcaagccgacgacgcgaagcctttcctcgcgctcgtcaccggcgaactcgcccccaagctccgctccatcgcgcccgacgtcaaacttgtcctcgtcgagcagctcctcgccgacgtcgccgcagaggtcgacgacgacgagacattggatctgccggcggcgaacattggccgcgacgacgcggcgctgctgttctactcgtcggggacgacggggaggagcaagggcgtggtgagcacgcacggcaacgcgatcgccatggccgcgtcgctggagcgcgcgtggggtggcggcggcggcggcggcgagaagccgcagcagtacgacgaccacgacgaggcgtacggctgcgtgctgcccatgttccacatgttcggcttctcgtcgttcgtgatggggacggcggcgctgggcgccacggcggtggtggtccccggcaggttctcggtggagaagacgatggcggcggtggaggagtacggggtgacgaggcttctggtcgtgccgccgatggtcgtgaagatggtcgcggcggcggccggcgacggcgagccgtcgcggcgtcgtctccggctgcggcaggtggtgtcgtccggcgcgccgttgcagcgcgagcacatggcgcgcttccgcagctgcttcccggcggtcaacctcggccaggttcgtatcctacctggctatttgctacagttgcttccctaattaatcaacggctaatgactacacttaattctctgcaaaaataaagtaaacttaatttgtgtgatttattttacttaggctgtgtttagtacacgctaaaattgaaagtttgaagaaatttaaatgatgtgacggaaaagttgaaagtttatatgtaggaaagttcagtgtgacggaaaagtataagtttgaaaaaaaaaattgaaatctaaaacatgtcttaattataattattatagtttatgttcgtcactgcataaattcatctatacagttgacctttgatgttttataatatgcaaattgcataaaatctagtcattcctgaactttttttaaaacatttttttttgtgtcgatcgaatcaaaaccttcattgatcccttttgtgacaaatgcatggaagactcaacagagattccactttgatgcgtgggaactaattaatatcaatactgtctcgttctttgaaaataaataaataactaattagcttctcatctctgatgcgtcttgtacgatgtatggttgtatttgccatgtttacgtattatcttattttttgagagagaaaagtgtgattctcttctgtatgctcatcgcattatatatattatttgatctatttttaataatagaaattgattacatctctagcttatgttataagacacacacggtcataaatttgttaataaaaagatgaaggtgaagataaaaataaatcaaaatgagaaattaaggtgatacgataaatccaaactctcatttattattgactagcgttaaaccatatagatttattagctagcaattctaatgaaactatgccacctatagtgaaataaaagatctttggctataaattatttgatctatatcattgacataatatttacacattaattgatggaaacgataaatcgccactagcttgtgaaacactcggtaatcgatggattcgatcttctgatacctgacattatgttagttactttttgagtttgaaaggaaccgcccttaattaattattctctctcggttgtgagaagatatatgaaagaactagttttaatttgcattaattctcggtcatacgtactgcaacattgacttggtctaattctgcaactacttattggtatgagatttactactagcaaatataagtaaatcttatagcatactgttataagctcaattatgatattttgtaaatttattctgaaaaaaaatgatggccggaatttttattagatcgattttttatctaaaagataaatatttatgaccaaaggatgaaaggattatatgattgcattaaagctagctaattaatttccccgtcatctcagggctgtgatggctgtctaattaccctttccttttggtgacacaatgtcacttcgtccggttatctaatttcagcgatgcactaattagtgagatgcagtacattactattacggtactacgtactacctcagtcctaaaatataattatgagaggcaaaatcacttgtatgtgcaattaatacctgttctaaatcaaccgtgacatgtacgctcgcgtgacacaattaatatgtacactaagagcaagttctaagattaactttaattttatctacattatttactcattaattaatttgaaagtagtacatacaacaaattatctgtgaaatatttaaccccgatataccataataatcttattttatttgttttcaattcattggtcttttactcttatctctctaatcttactctcatcgatctctctaagagtttgtgtaaaggttacatatatgtgaggggtggcttctctcctccatctcatcatcacgtgattctactatatcttaagacaaaatattagagtcctacattacttgatctaatgcactttgaatcaataaatgtacccatgtacatatgtactggagtagctagctagtactctagaaaaaacaggtcggtacaattcagcaaaatactcgtacaagctgaaaattgtactcccccgtctcaaaataagtgcagttttagcactattcatgtctaacgtttgatcgttcgtcttatttgaaaattttttatgattactacttttattgttattagatgataaaacatgaatagcattttatgtgtgactaatttttttatatatattttataaaattttcaaataaaacagatgatcaaaacgatgaacacgaatatttatggctgcacttattttggaacagaggtagcagcaagaacttgcacggattaattcacaccctctaagtacagcgccgcatgtacagtgagagaaaagggcagagcactgtggcaggcgtactgtgtagcactgtagcgaaagtgtgattaaaatcattttttgtactataggttatcgctgtagtacctaggtctagagccgtccatctcgaaatggatggctgatattcacccaatgtcaccgtactgttcagtccttaccattactgcttgatgtcaccgtactgttcattccttacccaatgttagacgtattttcagatgacgaacgtgacatcatgttaactaaataccactcaaaattaatagattattaattgggcggcactggtgtacacatcccatgtgctcttcaggggaaaatagagtaattagcgcattgtcttcacagtttttcatgtccttgatatatctctggtgtacgttaaatcaacaatgacgacacatgcattccatccggttataaatactccctcctataatgttttatagggccaatttagattgctaccctaccaaaatttgctaccctactaaaatttgccctaccaaaattttggtaggtagcaaaccaaacacctctactaaaactctaccaatgccataaatttggctttgcctataaacttatctcttatgagaaaattttggcttcaatccaaataaacattttcaactctaccctaccaaaattttggtagtaccaaatcttgcccaagatttggcactaccaaacatgcccataacgtttgtacactatttaaaagtttggctaataataattctaagatacttacttttaaaaacatagaaattatatagagtttggttattgtataattttttatccaaagatattacataataatatactaattctatattttaatgtatgacaccgttgactttttattcaacgtttgacaattcgtcttatttaaaaaaattatataattatcatttattttattgtgacttgattcatcatcaaatgttatttaagcatgacataaatattttcatatattgtacatgcatatgtgcagtgctacgggctaacggagacgacgggcattgtcaccatgtgcgatctgcagcacaacgacaacggcatcgacaaggtggaaatgccaccgtcatcgacggatatgacgttcgtcgctgttgcagcgacgacgacggaggtgaaggagagaagcaccggcggcggcggcggcggcggtggcgtctcgattgggcggctcatgccggatgtggaggccaagatcgtggacccggactccggcgagctcctcccgccccgccgcaccggcgagctctgggtccgaggcccctccaccatgcgaggctacctgaacaacgaggaggcgaccgccctggccctggtcgccgccgccggctctgtctccgtctccggcggcggcgagcggtggctgcggaccggtgacctgtgctacgtggactcgcgtgggctggtgtacgtggtagacagggtgaaggagctgatcaagtgcaacgcctaccaggtggctccggtcgagctggaggacgtcttggccacccaccctgacatccacgacgcagccgtcgcgccgtcagtacactgttctgtttgatttagactattgagcggatttagagataaattaaatactttaagaaaatagtcttattaaatatagcttaaaacatgtggtctagtactaatacaggagaagaaagttttcgacaaaatgtgtataaagagttaaaacgtgaaacaaataatttacagctcacactctccaactctgcatatatatgtatggctaattaagtgtagcattgcaggtatcccgacaaggaggccggcgagatcccgatggcatatgtggtcaagaaacaaggcagcggccatcttcaggaagatgaagtcatttcctttgtacagaacaaggtacatatatacgtatagggagatcattattcaattagtgacagagctaaaatgcagattagattgccttgctgcgctgcattaaccgtttgaatagttctgataaatcgagcatggatgaattcatgatgtatataggtggcgccatacaagaagatcaggaaagtggtgttcgttgactccattccaaggtctccttcaggcaaaatcctcaggcgccagctgaaaaacttgctacaggggtctatcctgcatcgaagcaggatgtaacccatgatcacacgaataaacaccatgaatttccaaaggttcaattatctttatctggacgtgcagtcatactcatatctatactcctttaaaaatctctagatctgtcaccccactattctcattatagtttttacctattacattgtataacagctaaatctaaatgattagctacatataaaattaaactaaagtgagtattctctattaagaaaatgtgagaaatatatttcaggaaggaggtgttttatttattctggaaatattgtgatatattttcctttagccgtagcaaagtgctgacgttttgctaatttatatactcatctgtattgtactactcgtgtgcaaaaggaataatgtatatgaataaacaacatctacttatcggcagactctgcagcagttctgttaattcgtgtgaccattttcatgtaaaaattagacgagagtgccaaaaagagagaagaagtacgggctttacggggagagcgtgcgactgggccgaaattccgagaaggaagcagattcattcctaggccctcccggagcgaaatgggccgcatcaaccgtagcgcaatgggccaagttatgggctggtcttctccactgtcctgggcccatttcgggttcaagccctcgttgctcgactagtcaaatttacagcttgtgcttgtcagattttttttttcccttgctaattcgccagattatacactagctagtgaccagacaagtacacttgttgtcacaactggagaaagaatggagaggctggctaaaaactgaaaaactttattcgatcatatctctaatggagcgtacaattaattccgtcaggtgcaaatacaacatttgccccagatcatctcgaatcaagcaacgaaataatattgaaatgtgacaattcatgcttctgaattctgaagaaaacaaatcaaaatggcacgtacgtagctagatgcatcctcctctgaaattaacagttactcgttgacaaccctgcacatcctcctgatctcgccattggcggcggtcttgacctcgatcccgcccatcttcaccatcgccctcgcgaacctcctctcccacctcccgcgcgccgccgcgttccgcgccaccatcgccgccgtcggccgcgacgccagcagcgcggcgtcggagtcgaacagcaccttcctgtcgagcacgttccggtagtactgcctgtccatcctgtccggcgtcaccgcgtcctgcgccaccgtcgggtcgtcggtgaagttggggctcgccgggcacttgctccggagcgcggcggcgaggccggggtccatgtccgacggcggcgagaggcggtcggcgaaggaggagcagtgggagcggccgatggtgtgcgcgccggagagggtgaccatgtcgtcggcgtcgaggcccttcgcctggaagctggcgacgagctgggtgaggttgaacaccggcggcgggaggaacgcgagcgtctcgttggcgagggagacgcgtccgtcgagcctccccgcggggatgcggtagctgatgccgccgccgctaaggaagaaggaggcgtcgcgcgccgcgaacgcgatgatgtcggcgcaggagacgacgcccgggcaggccttctccaccgccgccttcgccgcgtcgatcacctcgaacccccgcaggctggggaagttcggtgggccgagcttctccggctgcgggttcgccgccgtcgggtcgagcagcaccgacgcgtcacacccctgcaaccacgaacgacttgtcactcagtgtcatcaattgcggcaaccaatgttgcgtatccatggatcgccatggacgtacggatcgatctgtgtacctggacgaagcagtcgtggaagaacatgcggacgatgccggcgccgacgccggggttctggcggacggcgttgccgacgacggccctgacgacgtactccgccggcgcgcacttccgcttgtagtacccaaccctaagccgcccctggcacgccgccgccattgccaacacgcacgccacccacatcgcaaccctagccgccgccatggtcgacctcctcagctactcacacactccactaccgttgtctgaatggctaagctctccattgcacgtccatttatagcacaaatccgaatcgatcagatggacagagagctagctagtgacagactagtggtcggaatccggaagaaatttgcagggtttttgtctgcgcggacagcgcgggaagaacacatgcaagaacagctcagctagcatgcgaggctcgctgactttggagctaggaattaaggagaaaataattaacgatcgaaaaattattaatccggcgtcgcatgtgagcatgtgtattatattgtctcactgcatgactctgcatgagggagtatgggcttgatttcaagctcgaacaccctgcgagcagattggaaggataagcttttgttttagccgccattgatttgtttactctgctggggtggatgttaagcacattccggacaataattccgggattgattaattaggataactagctgtcgccatgagagtcaaatgggtctcagtgtatcagcagattaattttgggggagctctctgaagtctatctcagcactgatgcaacttctcataaattctgcccggcccaaaaacgtaggtaacatggggagatggagttctcaattttttttttaaaagatggggagatggagatgaaaagagcaaactgttttgcacgtcaagaactccaagttgttaaatctgaagcttaattccagataacaattacatgttggtatttctgtagttgatcgagcacagaccgatcgaccgcccgtgttaagtaaagattttgtttttttggagaaaaaaaagtatatctcggccgtgtaccaaggatgtccgcacatcaaggatatgtttataccactactgtggtatccgcacttcaaggctaggaaggagctgttgtgtttgtttgaaaaggtgctaagatttcagagaatttgaatacttctataaattcttattaacatcacgttattgcaaacaaaagttttactcattgtttggcttaattatgctgatgcttataagccagaatttgaattttagaacttaattttgaatttgtttttttcatcgtactttattttatagcaattgcttttgagtcactaagtatatgtgtataaaagcttttcccacagatgattttttatttgccagtaagtgattccagtaaacatatgaataagcgaaacaatggcgctataagatttcagagtatttcatgtcactagtgactatagctaaacagttcccctgtttatgtcatccctgacttcacttttcttgttgagacatgccgtactgatacattgctggacctgcctacaacagaaaaaagggtacacagagttctcgctctgtcctatagaaaacatagaatagaatatgatatatcttgttcagatttgttgtactagaatatcacattctgtttgctttttatgtaacggagagagtatggtgtaaaattatgctacacctacgggcgctacagctgattcatacgcagctaggtaaaacttttctatatagtatattttgtcccaataaaaagtgatcagatcagtccaagattacaagatgcaccctataccaaattctacagatcaaactacaacatgcatgtttagagtgcagaagctagcctccattatcctcgaatttgttatagacttatagtagtagtttatcgctcgctacggcatcagtagaccagaaaatttaaattgcatacatgcatgcatgtttgcaattaattaacaaccgttaattggcagatggtatcagccaaactgacacagttcacgaccactgtaaactactccaatcaaactccaaaatcaaagaaaatttgcaaggtgtgtatggggagtaatggtccgtgatagatgatgactgatgcatgtgagttgccacttgcaagcgcacactcttccagtgaggtggccggacgattgatcatacggatcgaaatgggcgcaaggagtacgtaggatctggatcactcgatcgggaggtatcacgtttcggaccacgggcctacgtgtgtatgtaggcctgatgccgtcaagattagatttcggatggaatcttggagaagaaaagggggagccaagcccaggtagaatgctaggcccaaaaactggtcgattattttagtggaataagtttattttgtctccctcaactcatgtccctggttgaactgcatccctcaaccacaaatcgggtataaccagtcccctaactcctaaaaccgttgcaaatcaactccctggtttgtttcggaggtggttttattccacgtggcatctttaaccccgttgactggctgagtcagctcgtagaacccacatattagtgttaagcattaaaatgaaaaatggtagggcccactgtccgccacacttctcctctacttctctaggccttctctcgctcctccatccgctcggaagactcgccggggatggctatgtacgggtagggttgaaactagttcgcatagtttccgtccgtccggaccattttacgaattcggatagtttcggtcggaactatccggaaattctcggattcggaaacgaattcggatattttttctcggaaacgaaaatgaatacagtaagggtactatccgtcaaaatcggaaaacggtcagaaactatccggaatttttttcagatatccgcagacattgagcaaattttagaaaaaacacgtatatacacataactttttcatacgaaatcagatggagacaaactttatatcaacattgtggagattatgattaccccatatctacatggcggttatattccagctggatatacggtaccaaatatagatagaatatctttatgaggactcgggttagattctaaacttgtatgtcaagaaaatacccgggatcctagtcggttacaattgtattttatctgtaattccatattccgttaggatatggactgtattctgtaatacggatcccttcccctatataaggaggggtccgggttcctctcgggatgattcttttttccagtttatacaatcaataacacactcggcggaatcatccccggacaggagtacggtattacttcttgaataagaaggcctgaacctgtataaaattccttgtctccaaacccatccactttcctagcttgatagccacccccttttattattgccgaaatcttgtttcgacagttggcgcgccaggtaggggtagcgtcaagttctcgccgactaagtgcgatgggtttcgtttctggcatcgacgacttcgcctttcctcccgggcaggcgttccggttcggcagcctcaacttcatcaccaatgacttcggcaagatctctctccttgactcggattcaaaccagtcggggagagaccaggtccaagtgccattcggtattccgaactcggccaagacctactctaagatcatctctcccgagtcggcttcaaaccactcggatgagatccaatctactcttccgcgaccagatcaagacgacgggtcctatccctcaatactgatgaaacttcctgatgatttggccgctgtcttcacagtcaagacatctcccactcgaagatctaggcgagctccggcttcggccccgatccgatctagatccagggaggttggcgttatactccaacctctcgggacagtctcgacggaagagttggatggctacctcagctcccccggcgtcagttctcgaccaaccgagatcctccactacgacgattttggctaccactatgaccacggcgacctcgacaacttcgacgatagctatgaggataactacatgcccctcttcttcggcgtattcatggctgacaacgaaacggaggaacagcgccaagcccgagaagcggaccaagagcgcacatgccaagagactgaacgtcgccgactggaggaagaacgacaacgacaagagcgagaacgactacagcgtgagcaacaagatcgcgagcgagttgcaaaggaggctgaagatcgacgacagcgcgccttggaatccgggcgacgagcgagagacctcattgggcaacaggacatcgatggaacaacggtttttcgcaccccccagcagaacgcggttgcagcaatcactctcctcgacaccctcctcaaggaagacgcactcaatcaagctgatcatgttgtcaacatcttgaaccagacgaagactatgatcgctgcctcagttccggccaactctgcaagtacccgcaccccgactggaagccgagtccctcatcttcgatctcaagattatcatcaaccaagcctcagcatcatcggcacaggatccagtcgtaggagcagggaccacggcgaacgatctgttcactcgcctcccgaacgtcacagggaacgccgagtcgaacggcctcactctccgcctcaccagcatcccgtcgatcttcgcgacatgatcaaccagcgccgtgcagcacgaggtcaccgctattcacctgatcgctacgacgacgacgtggatggagtggctgccttcaccaatgacctgcgtcgagtggattggccagtcagtttcaagccgactggaattgaaaagtatgacggcaccaccaatccggagtcttggctcaccgtctacggactcgcaatccgcgcagtaggaggaggcagcaaggccatggcaaactatctgcctgtggccctagtagattccgcccgatcctggctccacggtctaccccgtggcacgattggatcatgggcggaacttcgtgatcacttcatcgccaacttccagggcacctttgaacgccccggcacacagtttgatctctacaacatcgttcaaaaacctggagaatcccttcgagactacatccgacgcttctccgagcaacgcaataagatctccgacatcaccgacgatgtcatcatcgctgcctttaccaaaggcattcgccacgatgacctagtcggcaagttcggacgtaaacctcccaggacggttaagcaaatgttcgaaaaagccaacgagtatgccaaagccgaagatgctattaccgcatccaagcagtcgggcaccacttggaagccaaagaaggacacgccgactacaggagggagtggaagtaacaaccacaaggatcgcaagcgtaagcccgaagaacttgtggcaacaacctctccatcttcccgacaacgttcccgcgtcaacaccttcgacaagataatgaactcgcaatgtccgcatcatcccaactccaaccacgtggccaaagactgcttcgtctacaagcaatttgcggagcaatatgccaagaccgcacgtaagccttcagacggagatcaaggcacatcaaagaagaaagacgatgaggacgatgccccgactggttttcaagaccatcgcaaagaactcaatcacatcttcggcagacctctggcttatgaatctaagagaaagcagaagctaacagaacgggagatcaatgcggttcaacctaacacgccccaatatcttcggtggtcagaggtagcaatcaagttcgaccgctcagatcatcccgaccgagtggtccacccggggcggtaccccctggtactagacccagtggttcgcaatgtcaagctccgaagaactctcatcgatggtggtagcgcactcaacatccttttcgctaagaccttggacgatatgcagattcctcgcacggaattaaagccgagtaatgcacccttccacggtgtcatcccaggattatcagctacaccactcggccagatcactcttccagttaccttcggcactcgggagaattttcgcacagaaaacgtttgtttcgaagtcgctgatttcgagacagcgtaccatgctatactcggacgaccggctctagccaaattcatggctgtcccacactacacctacatgatgatgaagatgcctggtcctcgaggagtcatatcactatggagcgacgtcaagcaggccgtcacatgtgacaaagaaagttgcgagatggcccaaacccgcgagatcacactcgctcgagaagagatccgactggctgtgaccacggcaagcgaaggagaagtgcctgcaaccaagctgacgaagaccgaagaaagtgatgctaagacaaaaa

SEQ ID NO: 11539 - DNA, 5395 bp, Oryza sativa
gcgctcatcacctttcttcaaaataataaagatatctttgcatggaaaccatcggatatgcctggtattcctagagaggtgattgagcactctttacatgttaaggaagacgccaaacccatcaagcaacgtgtaacgccccgattttcgttcgggattaaaaatcattaaataatgcattttctagaaattaaataaaagttaaagcaatttaatcaagtgaaataatgggagaattaaaattttcccttaaaaatcattggccgggaatattttgtaatattctttgtgccctaatatactctccgaaaatttcccgtgaattttcggagctcaataaataattttaataatacaaagttcattaatcaattaaaataaaaagaaaagaaaataattttccccttccttgctttcgggctcggcccaaattcctccccctccccctctcgggctctctctccctcggcccagctcgccgctcggccctctcctctccgaagtctactttgcctccccagccggcctccctctcctctttggccgacaggtgggacccgcggccccacctgtcagctcctcctccttcctctggctggccggctgcaaccaccatggccgcccgagccgccccacgacgccgcagtttccgcccacctcctccaccccacgcgcgcgcgctcgtccgtgggacctcgccgcccacgaccccgctctcctcccccactttccccctccataaccggcgccgaaccaccccactcgcccacgtcgccggcgcctcttcccccttcaaatccgcctctcccggccacgttctccccctccgggacctatataaacgactcacgtgcctcccttcatccgttttcccctctccccgagcaccccgcgctccctagacacctccccaccgtgctcccgtgcaccaccgctttccggcgagctccggccggccgattccgccgctccacccaccgccgcgccaatccgccaccactgtcggcttcgcggcgccgtgccgcagcccggcctctaccccatttcccctctccgcctctggaacaccgccgcctcgtgcaccacctctctcccccaccgccgccgtcttcagccggccgctgctgccgcgttagtcgtcgccgcacctcgtcgtttgcgtcggcggcaacgctgtgccaagctctacctcggcctctgctccgtttccccatttcatcgccgcaaccacctttccgccgtcgacccgagctccgctaccgccgttgtcgtctcaaaccaccgctcctcaccgctccggtcgcctatttctctccctaaccgctccaatattttccttaggtcttgccggccctcggccgcggctccaccgtggtcgggcgtcgtcggaacgccgttcccgtcgcctcccgtgccggtcgccgccatcttttccgccgccggccatctccccgtggtcgtctcgccgtcgccgtcctcggtgagaatccccaccgccccctctcctttttccccatccgccgctccccatgcccgccaccgcgacgcgctgccgtcgccggtggtcgtctggccgcgtgcgcgtagccgccgtgccatggccggccgggtcagtctcggccgcgcccgtgccccagccgcgccgcctcgtggccgtccgatcggctcgggccgatctgggccgtccacgtggtggacgcgcacccgaggccacgtgtggacttggtccaccatgcgccgcccctttgtaccgctgacgtgcggggcccgcgtgtcggcgccggcctcccctttgatgacgtcagcacggccttttcctttgtaaaaataaataataattgcgcaataaatcgagtttaattctagaaattcattaaaatggctcaaaacttctaaaatccatatctaattcattcgaactccgaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcaactgaatggtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcctgttcaacgtggtgtagcgttgatcagtggagattcaatattactttaattactcaactgttttactgttttgctcaataaaatgttttacaaccgcctttatgcaaatagccacaaacccctccttgtatccccttgcacgttcgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaacttgactgtaggttgagccaaatggtcaaaccctaaggacaagctttctgaaaaccctatttgaaaaatgtctcccctcgcccttcggcttttctttgcgaaacggtttttcaaaattctcctccctgtccctccaattcttatagttgttaaaccgtggaggataaaccgtcagcttcgtgtctgttcggaagtcaagtcaagcctcaagcttcgtgcaaggagcgagaagatcagttcagagtcgtcgttctgcgaagatcaagtggagttttcccggagtttacctaaacccaatccttcctggaagagtagtttcgttagctgctaggtcgtgtgttgtttgcttgtgtgtaggggtatggtttgcatcattggtggggatgcgaccatactaggttgtttgcttaagcaacttgaacaataaaagtctactcacaacagatcagtaggcaatcggtttaagaccttatctttagcaacccctctcttccacctctcttccgtcctggcagcggatggtcagtgtcagagataagctcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagagtagcggaaagaactccagcagtagtgtgttgcagtcaagagtcagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcatttttttcaaggacaacagttcaaaggttctcggtcacgcgaaagtatgactactctctgtaaggggggtaggtcgcagagatgagttttggttcacctcgttgccgtttcccttaaagattcaacccagtgcagcaagttggttagtacttgaaagggccagctgcaaggcgtcagcagagtaacactgatcccaagttgtctaattaaattcgaaggtacgccggtgaggccaggtcaaccgtttggcttaaagaagtagcatcaggaacagccgcaatccagacaaggacagaccaagccagtttcctgaaaatacttgtggtttgaatcaagagcaggtcgagcaaagtcattgtctgtgggttacggaagtcagtttcaaggttttgggaaaactacaccgatccccggtcagcaaagtgaatcctcagtttatctaattgccagcattagcaattcaatccaaacaaaaaaaatagaagttctatgagcaccagcagttctggtcaaggtcagactaatcagagtcggtccgtcagtttatgggaagcaacagaacagcaagcttatgcaggtttggttcatcgagcaatcggtcagatgaatcagaaagaggcagcatgtgtaagcagatcagtcagaccgcccgccagcaccagctttctttctagccatcccagaatctcgggacgagattcctgtaaggggggtagatttgtaacgccccgattttcgttcgggattaaaaatcattaaataatgcattttctagaaattaaataaaagttaaagcaatttaatcaagtgaaataatgggagaattaaaattttcccttaaaaatcattggccgggaatattttgtaatattctttgtgccctaatatactctccgaaaatttcccgtgaattttcggagctcaataaataatttcaataatacaaagttcattaatcaattaaaataaaa

SEQ ID NO: 11540 - DNA, 23540 bp, Oryza sativa
tttcagaactgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacacaacgactccgccgttttgcataggacaggaaggatgcgatcaaggaggaattaaccaagttgttagcagcgggcttcattaaagaagtccttcatcccgactggctggctaacccagtcctgattcggaaaaagacggggcaatggcgcatgtgtgtcaattacaccgacctcaacaagtcttgtcccaaagatcctttcgggttacctcgcattgaccaggtagttgactcaacggccggctgcgagctactcagttttttggattgctactcgggatatcatcagatccgactaaaagaatccgactgcttgaagacatcattcattacgccttttggggcttactgctacatcaccatgccctttggattgaagaacgcatgagcaacctatcaacgcatgattcaaagatgtttttcaactcagatcggccgcaacgttgaagcttatgttgatgatgtagtcgtcaagaccaagcagaagggtgacctgatcacggatttagaagaaacttttgcaagcattcgtgctttcaagatgaaactaaacctggaaaagtgtatcttcggagtaccgtcagggaagttgctcggattcatggtatctcaaagaggcatacaggccaacccggagaaaatcaatgccatcctcaacatgaaaccgccaagctcccaaaaagacgtccaaaagctgactggttgcatggcggcgctcagccggttcgtctcacgactcggcgagagggggatgcccttcttcaagttgctgaagaagactgacaatttccagtggggacccgaagcacagaaagcctttgaagacttcaagaaacttctcaccactccaccagttttggcctcgccacatccacaagagccgctactgttatatgtgtcggcgacctcccaggttgtgagcacggtcctggttgttgagcgtgaagaggaatgccatattcaaaaagtccaacgaccaatttattttgtcagcgaggttttagccgactccaagacaaggtatcctcaggttcaaaagttattatatggtgtcttaattaccgtcaggaaattatctcactattttcaaagtcactcggtcacggtagtcacatcgtttccactcggagatatacttcacaatcgcgaagcaaacggacggactgcgaagtgggttttagagttgatgtctttggacatatcattcaagccacgaacttcgatcaagtcacaagctttagctgatttccttgccgagtggaccgagtgccaagaagacatgccagaggaaaagatggaatattggactatgcattttgatgggtcgaagaggcttacaggcactggagctagggtcgtcttgatttctccgactggagaaagattgagctacgcattgtggatacatttttctgcgtcccataacatggcggaatatgaggcgctgctccatggattaaggattgccatctctctaggtattcgcagattaatcgtccgtggagactctcagttggttgttaatcaagtcatgaaagagtggtcatgtctagatgataatatgaccgcttatcgacaagaggtacgcaagttggaaaataaattcaatggactcgagctcacccatgtcctccgacataacaatgaggcagccgatagactggccaattttggttcaaaacaggaagcagctccttcagatgtgttcgtcgaacatctttacgaaccgatcgtgcccagaaaagagacagtcgaagccatggatattcaaggcgtaagcatgatcgaagctgactgaagagaactgtttataaaatttttgagcaaacaagaactccctcaagacaaaaatgaagccgagcggatttccaggcgcagcagactttacattattcatgagactgagctgtacaagaaaagtccatcaggaatactgcagcgctgtgtgtctttggaagaagggagacagttgttgaaggatatacattctggtatttgtggtaatcatgctgctgcacggaccattgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctagccgtttgcggtctgggggcttgacatggtcggcccgtttaaaagggcagtcggcggttacacgcatctctttgtggctatcgataaattctccaagtggattgaggctaaaccggtcatcacgatcacagcagataaagctagagattttttcatcaacattgtgcatcggtttggagtacctaatcggatcatcactgataatggcactcaattcactggcggagaatttaaagacttttgtgaagactttggcattaaaatttgttacgcctccgtggcacaccctatgagtaacggacaagtcgagcgtgctaacggcatgatactgcaagggatcaaagcacaagtttttgaccgactacgtccatatgctggcaagtgggtagatcagctgcagtccgtactttggtctttacgcactactcctagtcgggctaccgtccagtcgccgttctttttggtttatggcgcagaagcaatgttgccgagtgaagtggaatttgaatcattacgatttcggaacttcaacgaggagggctatgaagagggccgagtagacgacatcaatcgactagaagaagcccgagaagcagttttaattcggtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactcaagcgcgaagacggtactctcatcaacaattcttggaatattgaacaccttcgtcgattttatgcttaggtatttcgcttgtatctttcctatttgactgctaacttcaagtttttccttgaagttttcagtcagggggctattatgataataatggagtgtgatttttatcaattcaatttgcttacttgatttatcattgccctgtttggtctttcgacttagccaatgagaactaaaggtttttaatagcttttgcgggttttaggctcaataaggcttgacaaaggcttttaagaaatcagaagccaagtatggaacaccaagcatagcataaattcatcagtattgtacaaattgagcctccaccgtcattgatcatcaaaatcattgttatatcaatcagtatcagttttttcatcatcagacttatcagacccagtcggccgaaggtcgacatcttggaatctctcaactacatcagcagcaatcttgtcagccgctttctgcacatcactgatgaggtcaagagcagcttcttcgctcgtcccgtctgcaaagccatcaatggcatcaatatcaactcttggataaagggatttggtcatcgccaacgccagacttgctcccatactttcagcttctttgatgttcttgaagtaagtatatggagcgactctcagcttgtcgaagatttcggcagcatcaagtgtactcgacccggcgttattgaagaacatggcctagataagtggagtagcggcattagcgactttatccctggctccttcaagcttgttgatcttgccaactaagacatcaaattgtgcttgagacttgatcttgcgatctgcgtcaacagattcacattaatgaatcagcatgtagaagataatggcttttgaggcattgattattggtaccttcaacctcctttaaagccgaatccctctgtcttgctagctctgccttgtcattttccagagtttggatctgcttctctagttgagatatcttggcagcttgcactacattaacttcggttaatctggattacagatataacagcacaaatcagtaaggcagagtttgcgcgaaccttttgacgagccactcagttcgaaattggactcctggagctcagcaatccgatccctcagatcgtgttcattcttcttggcaagttctctggcctcgtacagttgactcctagtggcttcgagggttccaagatgaggaactagtctctctagggttgcggttttcacctcgtccctaagatgaatcctctgcggagcagtttaatcagcgctcgagccagacggtaaacaagatggctgaggtcaggcgtcaaagagcttacatttacaatgcgagtcgcttggttgagtgcctttttcagtaggcatacctcttcgtcttctttttgccggtttattacaattccttgaggttgcaagttgtcatcccaccacttgaccagaataggagggcatgaatcttcggctgcttgtatacggggaatttcttcttcatcaccgatcatgatcctaatgcatccattgacaaaggttagacaatcgatcggagttatttgggtcaacatggtttcggacaaagtgtttacctgtaatgatttctggacgaggacgagtggatttggatgcttttaaaggggatccagatctccggtcattgctggcgtcttgtccgcgagggttgtctgcttgggtttcgacttctggaatatcttggcttggccctgcgtccgactggtttccagtcgggggctcctgattaactccggcttcggcttcggccgactggattctagtcgggggttgatcaccagattctgcattattggttgccggttgattgtcacttggatgatcctcagcagttgactcggtttctttggaagaacctgtgtccacattagtcgggtcagagtctttcccaaacggatctatattagatggtttcttgcaaatttgattatcagtattaattgccgcaatgggtgcgcatcaatgcaagagagatcgttatatgagttgcacctagaagacttcctgatctttggcacagggcgactggatgttttcttccttggagtagcctgttttggtagtttcttggttgtctctcggtctccaggcctcctggcggcatcatcggcttcgtcgtcacttagaaccagcttcctctttcgagaatctggctggccgattggatcagaagcacttggttgagtttcagaccgaattcttggtcctctgctcccttgcccagtttggtggcggggcgatcggcgttgagcaattgggggatccgacttcatcaaagcaaattcctgggtgtaatatccttcattgttaactgattcaacaagaaagcaagaccatattttgagaaaggttgaagtgtatgaatacgtaccggtggaggaggattgaatgcattgaatggcacaacgggtagcaggtgtgaatagctgacaacaatagcgtttgagaagatcttgtacattctttctttcatgaccttaaagtcaagagaatctggatcttcccgatttggctcatgcttgccgtcaaactcaaaagccgtgcgggatctctctttgattggagctaatcgacttttgataaagtgccgagtgatttgttctccctgcaaaccttgttccttcagttttagcatgcgttccatcaattccactgcctgagcagcttcatctcccataggcaatgagttccatgtgtcctggtaaaccggaggaagacaggaatattcgggaagtgcgggttcaggattttggacgtaaaaccagtttgcgtgccagcctttgtttgaggtcttgaagggcatagagaaatacttttggcttagtgttcctctgagttggaaaccagcgcccccaaccacgcatggtttgctcttattatgttggggcttgaggaagaagattcggcggaataaggcgaaatgaggcctaatgcccagaaaagcttcgcaagcatgaacaaaattggcgatatgcactatggagtttggattcagatgatgcaagctaatcccgtagaagttcagaatcccccggaagaatcttgaggttggaagagaaaatccgccgtagaagaaatgagcaaataccacgatttcgtgtgtatcgagggtcgggaatgcctcaccaaatgccggtcgccacccgatgatctcttttgctggaagaacgtcgtgtgccaccatctccttcagattgtcttccgtcacatcggagggcgcccattgactcttcaagctttttttttcttccgccatgaatgtgaactggatggtgtgatttaattcgagatacggctggaaagggagggaaattgcagcggtggatgcggggagaaatttcgtgaagtttttgagggtggattggagcggattgatgaaccctagtttgcccggcgcagttttcattgtagcaggaaatggggaaaatggcgagagtctcggcggggaagacgaagagacgttttttacttcggtattattagggtatcgggggtgctaatgggcctgggcctgtacagtacttcagcccaattttgttttcagctttggcaatatgtgctcacaatgatgtggctcgatgctgataaaatcctttttaacgtgattcaataattctttggaattattatgatgcacataaaaaggtgcccgacagaaaggtgttataccatttttgtaagcttttttaggctacaaaagctgttgggttaatttgagatgactggtttattagtagtcattctcctagcatgttatatgcttattttgattatggtaagggttatagcctaggctattaaacttcctaattgccatgatctttatcatatttggtggatcattttacgagttttctactcggattcctgtcaaatatgtctacttatgaacctttttgagtgtttgtcactcgggtcttttcatattttttgtccttgatatgttcaagttgaaaagcagtcggctgggtatcttattgagtaccatgcatgctttgttataaaaccactcggttcttgactacatgtttagtttttcaactaatcatatagttgggggctacacctaattaggtgcatctactcgatgcaccatgttttattttcgcccttcacagtcttttagcactcagcaagctggagcaagttgaattgaagcactcggattattgtttttgtttcgagaaggctattttgtcaactgtgaaggtctcgggggctactgtggagattatggttaccccatatctacatggcggttatattccagctggatatacggtaccaaatatagatagaatatctttatgaggactcgggttagattctaaacttgtatgtcaagaaaatacccgggatcctagtcggttacgattgtattttatctgtaatcccatattccgttaggatatggactgtattctgtaatacggatcccttcccctatataaggaggggtccgggttcctctcgggacgattcttttttccagtttatacaatcaataacacactcggcggaatcatccccggacaggagtacggtattacttcttgaataagaaggcctgaacctgtataaaattccttgtctccaaacccatccactttcctagcttgatagccacccccttttattattgccgaaatcttgtttcgacaaacattgtagagcttgatgagatctacaactttattattgactattttattatttgaggtcatttaagggtctaaatattcattataatataccatattaatttttacaaaatctcagatctacaattcaaacatctgatggagatgtgttccatatcaaagttgtagagctcaacgggatctaccactttgtagtttataacatttgtatttgaaagcatttaaagtataaaacaaacattacaagtttcgaagatgtgaagtaaaataaataacatctccaatttatacaatggtaaataagttatacatctagtaaaaggtcttgggagtagaaaacgataatcatatttgcatatggatctcttagaggaacagccatgaaaattgattttcacatacggttgtaggaccgtctacaaaattgacgatataaatgttggagacgttgaactaaaataataagcgatatctctttcttgatcaagaaactcaatttgaggggtttttttatataccggtaaatattcgctaccgtattcgttccgtctcgtattcgctccgtatctgtattcgataatattcgatttcatttccgtatccgagttttcgatttcgattccgattccgaaaaaaatatgaaaacgaatatgataaagctagtttccgtccgtttccgatccattttcatccctatgtacggccggaagcgcggcgaggtcgaggctggcgtggcagtcgtccaagcccccttacggcgagcagcgagagcgcgctgagcaccacgagtagagtgttcaaaaattagtggagtgaataaagtctatggaattatatatttaaatatgaagggggtaattttctcggtccaccaaatatgttataactcatgcggattcacggaagaaaatatgttatcaccatcatgttgtgttcaacattgttatcgagcgatgatacgtaacgtgcatgaggttgcttggttcagttaatcttttttcccttaaagaagcgtgtttaaattctgccgcacacacaacagcatcaacgcaagatgtcaggccttcatgcttaaccaggtgcgtgacaaactaacaatcaataataatctcattaaaaagggaaatatttatcgataatagtctcataaaaaacttgctgaaattccaatattggtacaagcagaattacaacaaagggtgcaacaaaagaatggcaaaattaaactaactaattaaacctttaatcggtggaaaatgtatgacaaacaaaaatcacgagcttattctgaccaacaacatccccgtcgtcggagatgtggattaactgtgatcattagccggtgatcaatggcggctagttgacgaggcggcagttcttcctgatctcgccattggcgctggtcttgattccaatgccgcccatcttcaccatcgccgccgcgaacttgctctcccaccggccgggaatgaccacgttgaggaacacgctgaaccccgtctccgacgaccggagcgccgcgtccgacgtgaagagcacgtcgcggctgagcacgttccggtagtactggttgtccagcttgtcgggggttttgaggtcctgcaccaccgtggggtcgccggtgcggttgcacgcccgcgtcaggttggccttgagcgcggcgtccatgtcggaggtggtggaggcgaggcggtcggagaaggaggagcagtgggagacgccgatggagtgcgcgccggagagggtgaccatgtcgtcggcgtcgagccccttgtcggcgaagttcttcttgagctggtcgagcccggcgaacggcgacggcaggttggtgagggtctcgtcggcgagggagacgcgcccgtcgtagcggccggccggcatggcgaagtcgatgttggcgttgctgaggaagtaggcggcgtcgcggccggcgaaggcgacgacgtcggcgcaggagacgacgccggggcacgcgctctcgagcgccgccttcgccgcgtcgatcacctcgaagccgcggaggctggggaagttgggcacgccgagcttctccggccgcgagttcgccgtcgtcgggtcgagcagaacggaggcgtcgcagccctgatcaatcgaaaggagacaatacacagccacattaatcacgtggattactaactaattattaatcacgtgttttaattgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatatccctagaggcgcccggaccccctttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacagtagcccccgagtcctttgcagtcgaccatcatagtcttctcaaagataataatccgagtacttcaaactcttcaagccaaaatctgccgagtggactgtaaagggcgaaaaaaataaagaatatggtgcatcgaatagatgcacctaattaggtgtagcccccaactatgtgattagttaataaactaaacatatagttgaaagacaaaataataacacaattgtgcattatatgacaaaagcatacgcggcgcctaaataggcatactagccgactgctttttagccaccataaaagaaatccgagtggtttacactctaaaaggttcacgaatgaacacacttgacaggcatccgaataaaaaaattctaaagattacccatcaagtattataaagattatggtaataaataagtcaaatagcctaggccatgactatttaccatgaaaataggcatataacacgccaaggaaatgactataataaaaacaagtcattcctagttaacccaaacagcttttgtagcctaaaaaagcttgcaaaaacagcatgacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgtgcaggcctaggcccattagcacctccgatacccttaactgaaaaatcctatatccaagcgacgcttcgtcttccccgccggaactctcgccattttccccactccttgctacagtgaaaagctgcgccggcgaactagggttcacaactccggccaaatccacctccgaaaaacgcatcaaaatccttcccgtgatccaccgcctcaattcctcacctctcccaagccatccctcgaatcaaaccagcacatttgagaaaaatcgatggcggaagagagagaaagctttgaaggccaatgggcggcgtccgatgtgacagaggagaatctgaaggagatggtggcgcacggtgttctcccagccaaagagatcatcgggtggcggccagcgtacggtgaggcatttccatctccagatacgcatgaaattgtagtcttctcgcatttcttctacggtggttttgctcttccgacctcaagatttttccgtgggatcttgaacttctatggaatcagcttacatcacctaaacccgaattccatcgtacatattgccaatttcgtccatgcttgtgaagcctttttggggatcaagcctcactttgccctattccgccggatctttttcctcaagccccaaccaaacaagaacaaaccgtgtgtagtcgggggggcaggattccaactgaggggaactctgagccaaaaatatttctccatgcccttcaagacttcgaacaaaggctggcacgcaaactggttctatgtccaaaatcctgagcctgctcttcccgggtactcttgtcttcctccagtataccaagatacctggaactctcttccaattggagatgaagcagtccaagccttggaattgttggatcgcatgttaaagcttaaagagcaaggcttgcaaggagagcagattactcggcacttcatcaaatgccgactagcgccaatcaaggaaagatctcgcacggcattcgagtttgacggcaagtatgatcctaaccgtgaagaatcagactctctggatttcagaatcatgaaggagaggatgtataaaatcttctcaaatgcaatcgtcgtcagctactcacaccagctgccagtcgtgccatacaatgcattcaatccgcctccgcaggtatgtattggaaatcctcaaaccatgatcagaacataattttgtcttcatgctgagttgactaactatggaagcatcttgttcaggaatatacactgatgaagtcagatccaccagtcactcagcgccggtctcctcgtcaacataccgctcagggaggtggagggccaacgatcagaccggatccgcaacctcagacctccaaatcaactggtcagacgggtcctcgcaagaggaaactggtgcttgatgacgatgaaggcgacgatgataaatctggggataagggctcgcctaataaacccccaaaacgcaccatgcccaggaaaaaactggccggccgcgcaatgccaaaaattagaacatcttccaggtataagacctctcggtatgatttcactttggtaagctctctcatgagaatgatgctaaattctgaaagaatactttgcaggaaaccatctgatatagatccatctggaaaagaccccgatccagccatggcagagcaaaatatatccaaagaccccgagccaactgccgaaagccagccgactgccaaaagccagccgaccggcgcccatgcttcgggtgaccaggccaatccgagtgaccagccgccgactggaaaccagtcggcaacaactgaagcagcaacaactcaagagcccccgactggaaaccagtcggacgcaggccctgatcaagaaatccctgaagtagaagcgcagacgacagcttcccaagggccagaagctggtaatgactcaatagctggatctccaggcaaagaacaaagatcacctcacgctcagctaggtacatctccaggttaattgtcttctcatacaacggtgatttaaataacctcagcgtatccgtctaatgtcttggaaacacatcaggaccatcaggtgatgacggagaagaaatccctcgcataaaggcgaccgacgactctcgtcctcctatcttgatcaaatggtgggacgagaactcacaagccgccggtatagtcataaaccgtcaaaaagaagatgaagaagtgtgccagctgaagaaagcgcttggagaggccactcgtattgtaaatgtaagtcttccgagcgacagccttcagtaactttgttttctttttagcagaactgaaccatgatccatcgtgcagagaatccatcttcgcaatgaggccaagaccacaactttggaaaagctggttcctcatttgggaactctagaagcagttagggaccagctgcatgagaccaaggagcttgccaagaagacggagaaagaattaagggaccgaatcgctcagctccaagagtcaaattatgagctgagtggttcatccaaaggtaatctctagatcagtttcatcagttcaaactggcataactatatcctcaaccatctgaatttcaaaacagcgcaagccgccaggatggaacagatggcaaagcaaattgaagccctggagagagataagacagaactggctgcgcaaagggactcagccttgaaggaagtcgaaggtaacgccagccaacaatctgagcttctctccttataatgcaacagatgctcatcataaatgtgttttgtagatcgcaagatcaaatctcaagctcagtttgacgtcctggttggtaagatcaagaggcttgaaggagcaagggatgatgtcgccaatgccgctgcaccaattatccaagccatgttcctcaataacggtggtccgagtgcactcgacgcaaccgaaatatttgacaagctgagtgttgctccggaagtatatttcaaaaatatcaagaaagctggaagtatgggagctggcatggccttggcgatgacaaaatctttgtacccgagaattgaagtcgacaccattgatggatttgcagacgggacaagtgaagaagctgcccttgatcttatcggtagtgcgcaaactgcggctgacaaaatagcgagtgatgttgtggagcaatttcgcaacaacgacctccagccgagtaatgatgactctgatgatgaaaggactgactctgactgagtttggatgtaatacatggaggctcaatttgtacaatactggtgtatttatgctgtgcttgatgattcttgcaaagtttttgatttcttaaaagtttttgctaagctttgttgagcctaaaacccaaagaagctattaaaaactttcagtcctctcaaactaagtagaaaaaccaaacaaggcaatgataaaccaagtaagcaaactgaattgataaaaaatcacactccattattatgataatagcccccgactgacaacggcaagaagaaaacttgatgttgacagtcaaaatagggaaatacaatgataaagttaagcgtagaaacgacgaagatgttcaatgttccaagagttgtcgacgagagtgccgtcttcgcgcttgagtcggtatgaacctggtcgggtaacttcagagataataaatggcccttcccatagaggagataacttgtgccgatctcgtgtggtttgaattttccgtagaaccaggtcgccgactagaaaggcacgagatcgaacattgcgattatgataacgtcgcaacccttgtaagtaccgagctgactgaatcaaagctgcttcgcggacttcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccattgctcattgggtgcgctacggaggcataacaaatctttattccaaaatcttcacaaaagtctttgaaaactccgccggtgaattgtgtgccattatcagtgattatccgattgggcaccccaaatctatgcacaatgttgatgaagaagtctcgagcattatctgctgtaatcgtgacaacaggcttagcttcgatccacttggaaaatttgtcgatggccacgaagaggtgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgcgcagcagcgtggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatagcgacatcatgggtgcccgtaatttgagtggcatctttgtgaggtaccgtcggcgtataaatgtgttcgacaaaaacatcagagggcgccgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaagaccactctttcataacttggttgacaaccagttgtgaatcacctcgaacgattagacgctttatccctagggaaattgcaatccgtagcccatgaaggagcgcctcatactcggcgacgttgtgggacgccgaaaaatgtatccaaagcacataacttagtctttctccagtcggggaaattaaaaccactccagctccagtgcctgaaagtctttttgacccgtcaaaatgcatggtccagtgctctattttctccacgggggtatcctcttggcactcggtccactcggcgacaaaatcggctaacgcttgagacttgattgaagtgcggggcttgaatgatatgtccaaagacatcaactccaaagcccacttagcaatccgcccatttgcttcgcggttgtgtagtacgtcgccgagtgggaatgatgtgaccaccgttaccgagtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcggatgtggtgaggctaagaccggtggcttggtgaggagttgtttgaaatcttcgaaggccttctgtgcttcaggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaagccaagcagcttccctgacggtactccgaaggtgcacttttcagggttcaatttcattctgaaggcgcggatgctcgcgaaggtttcttctagatccaagatcagatcatccttttgcttggtcttgacgactacgtcatccacataggcttcaacgttgcggccgatctgtgttgaaaagcatctctggatcatgcgttgataggttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgaggagctcgcagccggcggttgagtcaactacctggtcaatgcgaggcaacccgaagggatctttagggcaagacttgttgaggtcagtgtaatcaacacacatgcgccattgccctgttttcttccgaactagaaccgggtttgccagccagtcgggatgaaggacttctttgatgaagcctgctgctaacagcttggtcaattcctccttgatcgcgtccttcctgtcttgtgcaaatcggcgaagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtcgcggcttcggtttccccactttttgaagtcttggcagcgggcacttctccttcgctcaccgtggttgcagccagtcggatttcctctcgggctagcgccatctcgcgagtttgggccatgtcgcaactctccttgtcgcatgtgacggcttgcttgatgtcgctccgtagggataggactcctcggggactaggcatcttcatcatcatgtaagtgtagtgcgggacggccatgaacttggctaacgccgggcgtccgagtatggcgtggtatgctgtctcgaaatcggcaacttcaaagctgatattctctgtgcggaagttttcccgagtgccaaaagtgaccggaagagtaatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaagcttgacattacggaccactgggtctagtaccagggggtaccgccccgggtggaccactcggtcaggatgatccgagcggtcaaacttgattgcgatttctgaccatcgaagatactggggcgtgtcaggttgaacagcattgatctcccgttcagtcaacttctgcttccgtttagattcgtaagccagggggccgccgaagatatggttaagctccttgcggtggtcttgaaatccagccggggtgtcgccgtcatcctgcttccttgacgtgctttgttcttcgtcggagttcttccgagtagacttggtgtactgctccgcgaactgtttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaattcttcgtggcgaatccctttggtgaatgcggcgatgatgacgtcgtcggtgatgtcggagatcttgttacgttgttcagaaaatcgctgaatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatctgctaaagccaccggtaaatagttcgccatggccttgttatctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtgtgattgtgtcgcgaagatcgatggggcggcgacgaggtggtgagcgaggccgttccactcggcgctccctatgaagttcgggaggcgagtgaacagaccgctcgtcgtggcccctgctcctgcgattggatcctgctccggtgatgctgaggcttggatgacggtagtcatgagatcggaagtgggggacccggctgccagtcggcgtgtggacgctttcggagttaactgggaccgtcgccgcaatcatggtctttgtctggttcaggatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcttcagcctccttcgcgatccgttcacggtcctgctgctcgcgccgtagccgttcttgttcttgtgcttggtgctcctcctccagtcggcgacgctcttcggtctcccgggcttggcgttgctcctccgtctcgttattggccatgaaaacgccaaagtagagaggggtgtagttgtcatctaggcttccgtcgaagtcgtcgagatccgggtcgtggtagcgagagctaaactcatcgtactccacgatgtcagtaggacgtgagtcgacggtgggagagctgttgtagtcatccagctgatctgtcgaaaccgtgccgagtggttggaggatgacgccgacttccctgaagctaggcgaaatcggtgttgaagccgacttccgcctaggcctacgggatgaaggcgctgtcgtggtgaagacggccgctaaatcgtcggggagcttcatcaggaccggtgggtaagccccatcatcttgatctggtatcgttggaaaagatgcgatctcagccgagtggtttgaagccgactcggttgagatggtctggaagtagctttcagccgcgttcgggaatccaaacgggaccgaaagccggttctctcccgactggtccgattccgagtcaaggagagaaatcttgccgaagttgttggtgatgaagtcgaggctgccgaaccgaaacgtctgcccgggagggaagacgaggtcgtcgatgccggagatgggacccattgcactgatcggcgaaaagcttgacgctacccctacctggcgcgccaactgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatatccctagaggcgcccggaccccctttatatactggaaggagtccggattacaaaagataatctatattcctaacggaatatgaagatagaggtaaaatacagtcgtaaccgactaagtctcagggtgtttccttgatacacaagttaagaaacaaacccgagatacagataggatattctatctacattaagtatccggtacccagttcgaataccatcgccgtgtagatatgggatacccataatctccacattaattaaataagaacacattttttttacctcgacgaagcagtcatgaaagaagaggcggacgagccctgcgccgatgccgcggttggcgtacacagcgttcttgacggtgtccttcacaatttgctcagcttttgggcaagaggaactgtaataaccaactctaagccccggggccggcgggcttgggctggttggagccgggttcggaggagttgtgcttggtggaggataggttgttggcgggctcgggctcaccggtgctggactcggaggagtcgagctaggtggaggataagtaggcggcatgctcgggctcaggcttggcgggcttgggtatgtaatgggtgtgggtgggctagcattgccggtatagccttggcatgtcacggaaccgaccagagccagcaatgtgagcagcacagcaagcttagccatctctgattctctgcactgaactctgaagcaggttacagtgttctgaaactctcaagactctgaactttgtggtgaaatgcagctgcttctgcatctccatttatagtcagtccccagccgaagcagagaacaaacaatttggtgagcacgtcgcggtgacaaatgcaccctaagtcaagcaggggaacatgggaatcgagcagctagctagaccagttgacatggaggtttctttgattaatttttgccggtaaagctgcagctgcactgaacaagtcgacggtctggttggtttaatttcagaggtttttcgtcttgcagcgtatgttccatggatgggttgtttattgtttctgaatcaaatttatcacccagatttatgttcttgcggccgttgaattggcagtttggcattggttttgatgggactcgtccacgccagcgcctacttcccggggtggtggaacgccaagttcgcataggcgatggtgaagatgggcagcgtcaccgtcaagaccgccgccggcgagataaggaagcagtgtcggttcaccaaccaggggcctgtttggggagcttaaaattctgagaagcagctagttggtagccagcttctaagaatcaaagctgggttttccagcttctgtcttgtagttcattagctggattctacaactacagcttcttagaatctaaaccaaaagctagactgtttcgggagcttctaattctgagagaagctgcagcagttagaagctcctctaaacatgtcctagtactaatcacgacgctttacatgcatgcctcaagccgagccagtgaacttaatttagaacaataattatctagattatgtgtcacctgcgataatatttaggatcttatgcaacttcgattataaaacgtgagatttcctaaaattcactctttttatatggtctccattgatcccacaacaaatttaatcggttataaaattacacggccaacctccgctagttttactaatacgactaactaaactttacttagacatgttcttatgtcatatataagggcatgttcacggctggagcctggtatatactagtaggcaatacacgtcacttaagattataaactatactcaatttctcaaatattataagagtatagtttatagtttttctattttctcatgttccctaccctatagtaaaaatttcttctataaatactaagagtctatgtttagcctgtgttaagcttaaatgtttgagaaaattctctctgtacccctaaaaattcatccaatcccttctatacccctaagatttgctcattcccttccataccccaaaatttcaatttagatcccttctataccccttccgttagttgaccattagttgaccgttaaattcatatcataaagtccattttaccctttggtatcaagaaaatataaatttatgaagtatattaatagagtgtataaatttattgtatacgattattatatttatgagtttattttgtgagatattatttaacaaaaataatttttatctcgcataaaaagatttatcttataaaaaatttcgtactactctaacaaaatatgaagtttttaatggcaaaaacaatattatttttttgttttatct

SEQ ID NO: 11541 - DNA, 7672 bp, Oryza sativa
  unsure (1)..(7672): unsure at all n locations
tatattttcttgataccaaagggttgtcatagataaaaattatttttgttttcccttcgcgaggcgaaactaaaatattacttttgttaaataatatctcacaaaataaactcatacatataatagtcaaatacaataaatttatacacttcatcaatatacttcataaatttatattttcttgatagcaaagggcaaaatggactctatggtagaaattttgtggtcaactaacagtcaactaatggaaggggtatagaagggatccaaactgaaatttaggggtatggaagggaatgagcaaatctcaaaggcatagaaaggattgtgtgaagtttcaggggtacacagggaattttctctaaatgtttcactctcctttctctcttcaatgtcagtaaagagccttctattaatattattaacagatgttgtacatgccctaaactagaggtcatgccaactttggattcctttttttcagttagtaataatgtttaaggcctcctttggaacaaaggtttttttaaagaaatttaggagaaattcaatccataacaaagagtatggaaatttttcctccatggccccttttgattaaaggaaaagccatccgaaaatcctacggaattcatttggattggctcaaaacttagaaacttcggaggaaatgtccaacctcttgaaaaaagtatactttgtgtgtgtatctccgattctagcatttttcccgtgctccatccacatggttattcttatagtttccttacatttttttcaatctataggatttgaaatgttagtgcgctccaaccctcttttttttcttatttccgtgttatgagaaattgagaatcctacgtttcaaaggagcactagttttttaggcatttataactgaaaataccaggtattatgattttagaaaaccacccaaattatgtgcaacccatttcagttattaattgggtaaattaagaaaccgtgtacaacagtccaaagcggtattgtattcaaaagggaaactattttgatctcttgaagggatgtctcctcgttatttgcatgccaatcaaatggttataaaaagaatggaaaattttgagaagatgtattaacatgtgatataacactccacaagaatgcatgttcaaattcaacttttagatctcgcaacggaaaaaacaaattaaacagcaactacataatgtattgtcatagtcaattttttcttgttgcgagatgtagaagttgaatttgaacttgcatgtttatggagtgatatatcatatgttaatacatcttctcattttttttcataaccatttgagtgacatgcaaacaatgagaggatatcccctcgagggatcaaaatatacttccatattcaaaattcccttttcataattaaaccacactttttataatataaaaattatatccagcaaacagacataccctactactagtagtcagtctggcaagtctatattatcatctttattttaaaacatagagacaattgacatacaaaataataagagtcaacacggtgcgctatgtgactgcgtggtgagcacattagcagaccgacactaatcactagtattactagtacactagtctcaaaactaaactataattgtcggtgccccatgaccttctatgagtttctataccatcagattaacaacacaaaccgacagtcaaaactgaattagaaacacaggccgcgaagcgtaattagtgcaatccggtagttgcatcctacagaggttgcatcccatcaaaacctaaacaatgccaaattgccaatccaacggctgcaagagcataaatccgggtgataaatttgattcagacacaataaacaacccctccatggaacacactctgcaagatgaaaaacctctgaaattaaaccaatcagtatcaggccgtcgacttgttcagtgcagctgcagcttaccggcaaaaattaatcaaagaaacctccatgtcaactagcctagctagctgttcgattcccatgttccctgcttgacttcgaacgcatttgtcaccgcgacgtgccagccaaattgtttcttctctgcttcggctggggactgactataaatggagatgcagaagcagctgcatttcatcaaaaagttcagagtcttcagagtttcagaacactgtagctacttcagagttcagtgcagagaatcagagatggctaagcttgctgtgttgctcacattgctggctctggtgggctctgtgacatgccaaggctataccggcaatgctagcccacccacacccattacatacccaagcccgccaagcctgagcccgagcacgccgcctacttatcctccacctagctcgactcctccgagcctagcaccggtgagcccgagcccgccgacaacctatcttccaccaagcccaactcctccgagcccggctccggcaagcccaagcccgccgtccctagggcttagagttggttattacagttcctcttgcccaaaagctgagcaaattgtgaaggacaccgtcaagaatgctgtgtacaccaaccgcggcatcggcgcagggctcgtccgcctcttctttcatgactgcttcgtcgaggtaaaatccttttttattaattaaaacacgtgattaattagttagtaagggatcacctatacatttatcgataaattttcttttaaaaatttgacagatgtaattatagtataatcgtgatgtaattacactgtaactcgcatgtaacttatatgtaactttcaaaaatatctatgtaacatactttttaggtaaaacggaggtcgtgggagctaatcctctcaaatgtttgcacacagtgacttttttcattcttcatttgcataaatcttgaaacaatctaacggtttaaaattatgtgaaagctatatgcaagttacattatagttacagtgtaattacactccgattgtgctgcaatcgagttagtaatccacgtgattaatgtggctgtgtattgtctcctttcgattgatcagggctgcgacgcctccgttctgctcgacccgacgacggcgaactcgcggccggagaagctcggcgtgcccaacttccccagcctccgcggcttcgaggtgatcgacgcggcgaaggcggcgctcgagagcgcgtgccccggcgtcgtctcctgcgccgacgtcgtcgccttcgccggccgcgacgccgcctacttcctcagcaacgccaacatcgacttcgccatgccggccggccgctacgacgggcgcgtctccctcgccgacgagaccctcaccaacctgccgtcgccgttcgccgggctcgaccagctcaagaagaacttcgccgacaaggggctcgacgccgacgacatggtcaccctctccggcgcgcactccatcggcgtctcccactgctcctccttctccgaccgcctcgcctccaccacctccgacatggacgccgcgctcaaggccaacctgacgcgggcgtgcaaccgcaccggcgaccccacggtggtgcaggacctcaaaacccccgacaagctggacaaccagtactaccggaacgtgctcagccgcgacgtgctcttcacgtcggacgcggcgctccggtcgtcggagacggggttcagcgtgttcctgaacgtggtcatccccggccggtgggagagcaagttcgcggcggcgatggtgaagatgggcggtattggaatcaagaccagcgccaatggcgagatcaggaagaactgccgcctcgtcaactagccgccattgatcatcggctaatgatcacagttcacgtcacagaataagctcgtgatttttgtttgtcatatattttccaccgattaaaggtttaattagttagtttaattttgccattcttttgttgtaattctgcatgtatctaatattggaatttcagcaagttttaatgagattattattgataagtacttccctttttaatgagattattgttggttgtgtgtttgcaaaatttaacatgaaatgagcgtagctgaactgattatattacttatggtaaaaccagcccacctagatttaaattttagatttgacacgacacgggtgtttgtatttactgctaattattttttcgatggtagatgacgtacccgatgatagcggtcgcaacagctgaaatagaagccgccaaaagcataaagctctcaaagatagtccttgtgtcaaagataaggaaagaggccaaaaattaggctctatcaggagcaaaatgattctgagctcacatatcttaactattttttcctttgtacagttcttctcttacttgtccaatctttttgatcctgctatatcgaaaagaaattgacactatagatgcacgttaaaaaaatcatttgtttctcgagcttcctgaagccattaatttcttagtgtcaaacatgctagaagcagacaatattgaccggagatcttcagaaacgagttatcaacccttgcaaaacgccgttagtagttcatgtctgtagttcacaggtattgagaaattcgcctccgcgaacttggcgttccaccacccggggaagtaggcgctggcgaggacgagccccatggtgtccgccgccgtcatcagcgccgcgtccgatctgaacagcacatgctggctcatcacgttcttgtagaccagtgacgaatctagaaataaatagcaatgggatttgagtaaactagatagagttacagtccccctcctatctacatatgataaaaaattttagtggggtcttcgtgggggctctcatagtcttcacgtcagtagtgggggctcgagaccccgccgcccccatgctggatccgcccctgcttgtagtactggttgtccagcgcgtcgggcgtcacggcgtcttgcgccaccgtgtcgctcggcgtcgtgcactgccgccgcagggacgcgacgaggtcggcgtccatgtcggagccggaggtggtggtgccactgggcggcgggacgcggtcggcgaaggaggagcactgggagcggccgatggagtgcgtgccggagagcgcgaccatgtcgacggtggagtcgggctgccaccaccgtagccatagccgccggtttggcacgcaacggaggcgagcagcgcgagcaaggtgaggacgacgacgagcttagccatggtagcgggaaactattttcatccctcgaggggatagccgccggtttggcacgcgacggaggcgagcagcacgagcaaggtgaggacgacggcgagcttagccatggtagcgggaaactattttcatccctcgaggggatagccgccggtttggcacgcgacggaggcgagcagcacgagcaaggtgaggacgacgtcgagcttagcctcccctcattgtttgcatgtcacccaaatgattatgaaaaaaattaagaagatgtattaacatatgatatatcactctgcaaacatgcaaattcaaattcaacttctacacctcacaacgaaaaaaacaaatttgactgttaatatatgataactagttgtagttaattgttttttcgttacgagatgtagaagttgaatttgaacttgtatgtttgtggagtgatatatcacatgttaatatatcttctcaattgttttcaaaatttttcatcactatatgggttgacatgcaaacaagaggatgtcttctcgagggtgaaaatccactcccgtagtagctagctatactgagcagtgagctcaagagtggcaagagagggatgaagaggagatgctgggttgcatggctatttatagtcaccggacggcggccggggacgcacgccgacacgccgtacacagtacgtactgctgcttgggaatgtttttggcgcgcacgttgtggtggtggtggtgtggtgtgtgcagggtcaaccgtccggtgaacgtggcgagcagatcgaatgatcgatcgaatacccaaagctagcttaattagtgttagctagctagtgtgtgcttgcattctgcacaagtcatagctatagcgttaacatgagctgctcgatcgatgacgttgtaggtgactcgatcagagaagggaggatctaccagaatcccaaattaaactctgaaactctgaatgtcaaatcaaattcacatccctttgaccggagaacggcgtaaaccggaacgtgcggcttggctgggtcggagcgggaatccgacctccgtgcagctcattttttttgggttaggaatttgtggcatataattagttatgtgggctcagatctgctcttgacgggctttcattaaaggcctggcccaacccatcacggagacaacagtcttcaaatatgcttataggggtagaatttacgtgcgtgcgtttatagggggtgagtgtgtgttgtgcgttgtgagtgtgtatgtgtttatggtgtgtaattttttttaaaaaaacaccagatttgtacattacacgccattactaaacgcgccgatcgatcgatgcagcactggtatcatcttcttgtcgggcaaatattctagagaggaaacaaaatagccaggaaaatatttttagataaatagggagtactagtatagtacacgcatgattacatagcatgcagccgccaaaataagaagggacgcagtatcatttttgtctccagcctcccaacagctgaaagccacgattatacgtaccttcatgatgtcaaaccaaacgtgcaagaagcagacaatatcgaccggagatcttcagaaacgagttatttttcctcgcaaaacgccgtcagaacaacccaactaaatacccctaatctagacgcccgttcgaacatatccattgtcggagctatattagccgttgaccccggcaatgtcaacttctgtatagctcgatcctgttcgatcgatgatctataactgcaaatcgtgctcccatgttctgccggttgataatcaagctgctaaaaatgattagaatttcttaattaattatacacacaaacattccctccaatgcatgcatgcacatattctgatcgattcatcgatctccatgctataaatagactcacagaacagcagcttccatcacactaacacttgaattaacacggagtagttgtgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11542 - DNA, 644 bp, Oryza sativa
gaagatattgtgacagagacagctgttctcaatgtaagtcccatgacctacatgcttcaactgggttatgcacttatgtttcagtattgtctttttgttgaggtttgaaatacagatcaagagataattgtgatttggttgaccgtctggaggtgtagataacattcataatgaatactacttcctttgtgctcgaatgtccttccaatgcacggaattgtacttgacatcttgtgtttattctgtttctatgcagtcctttgatctggcaactatgaaggaaaatgaaatggattttacttcaagctttgagctgaggctcagtgaaagtggtgtatcacaatctggagtaacctggtgctatggcattatattatggtttgacactggctttacgaaccgattctgcaaggagaagccagtcaacctctccacctctcctttctccacaccgactcactggtctcaaactatcttcacctttgaagagcccatcgcaatggcaaaggaggaatcagccgttgtctcatctgcgtcagttggcacagatgagtgcccagctgtgatgatcagatcccgcatcagcatcctgagggcctctgagcaccgcaccatatacatatcgactgaaactacaggaatca

SEQ ID NO: 11543 - DNA, 2411 bp, Oryza sativa
caccaccaccaatcggagccaccggagagcggcggcgcagcagacggcggcggctgcggggggcgagaggccgattcgccggaggagagaaggagagagagagagagatggcgttcacgatgcgcgcggtgaaggtgccgccgaactcggcgtcgctggaggaggcgcggcaccgcgtgttcgacttcttcaggcaggcgtgccgcgccatcccctccatcatggagatctacaacctcgacgacgtcgtcaccccgtcccagctccgctccaccatcgccaaggagatccgcaagaaccagggcgtcactaaccccaaggtcccaacctcgcacccacccccatcgatttcatccgtcttcccgatttcgtcgatctgcgcctcgtgaatgagaattctctagtggcttaaccaactgctcgcctgctctctccgatctggtctcttctggtccttgggagttgatgatttatcggtgttaggtgctggatcggtaggttttgattaacctaggatttgatagcctcttgtttgcagcaggggatttagactaaccttctgcctcaaggacagtagtattccggcaggtttgatgctatgtgggcagtaaattgttttcaccgatggttggtcaatttctatatctagacatctggatatcatttagtgatctactttctgtgacatagcacatgattatctgaacttcattgctgcttccatgttatatttatactaccagtatcaacaatgcgattcacatttgtcgatggtggtagtagtagctagggatatcatctgtacaatgcgggctctcacagttaagacagtctaatgaggtttttggtctttgcacaatcttctgataggtatcttctggcattttagtttagactagagagagcggttttgtcggctggcctcctttgcttgtaaaaattgagaaaatttgtcagtttaattgagcaagagtgcttatgaatacgattcaatgcacataatattagatccataccacctctccatgtacatgtttctagatcccctgaagaaacattttcttttgttatgatttgcatctttgtaggctaactatgtttgctggcttcaatttgaattacactcatttgattaggcccttaggaagacttcacctgaagcatgcacttaaactaaaaaatgttaatgtcagtaaaagggatctatatttttatcttggataatccaaagctgcatcagcttgagttgcaaggatcagagattgcacgcgttgatttgatccaatatttgaagaaacctcaactttgtaacaaaacgcagcaaattcatgttttgtttttggataccttttgtcgtttgttagattagagttgttacgatcacatgaatactattgggaatgcttctgttccatacctcaggtttggtccagtccttgctcgtattgcccagttctccattgtatctgagtgcagtaaattcagatgaatgcttcttttgatcaaacgccaatttgaattcattgatcatcacaatctaaaatgataaatttctccctcataccccctgttttggtgattgtgttgcatttgggatccctgtattatgttgcccctctttatgttaagtacattttctaccagtgcagaattatcttgttgtttgtagcttctcatgacgcatcacgaatgacctgaaaatttggtcgttcacattttctttttgtctcacttaccttaatccttactgtatcaatgcctcatctaagctatttttgtttgcaaacaggtcattgatatgctcctgtttaaggggatggaggagctgggcaacatcaccgaacacgcgaagcagcgccatcacgtcatcgggcaatatgtggtcggccaaaagggactggtgcaggatatggagaaagaccaagggtcctcagacttcctgaagaaattctacactagcaattactcctaatctgtgctgcaaactcctcctccttcagtaatacccgagaagtgatctgaataagacgctgagaacccacagctttaattgttttatcactggaatctttttgttattctgcttgatccttcaatcatctgcgcagtgtggcgctgttgctagtgaattgtttgtaacttgtagactgtactctgcaaagttgatgttcatgagttcataccgtgtgtcaatgggttcgaactcatgtacccagcacatgaccatcactcgtttgtcgtgaagtcattgattcgattaatctgtagcataaaaggtcatggccatggaaacaaataataagtgttgccgttctctaatatactcttgagtagttgtgacttgtgaggtatattaagaattcagatggcatcagatgatcagtattcaggtgtccctgtctgcttagcaa

SEQ ID NO: 11544 - DNA, 11589 bp, Oryza sativa
attatattatatggtctgtttggcacagctcagctctatccctggagcttagccaaacaattccagctccattaaaactgggagtggagatatgtgaagttttttcacataatgaactagtgttgtggagctagatttaggcagttccacgacttcactccagacccaactcctacagctaaatttaggagtcggagctgtaccaaacaggccctgtgaattgcaatactacttagaacttttgaattggattcagaatcgtgattgtgtgaagtactaagaatagatcggcagacggcatcaaaattcagttgttccatgctggcgtgcttcgagtagcagcagtacaatagctacgatgtcaaagatgaggaggggcctagagcaagataagatagatggaatctactcctaccaactaaaacgctggccccacctgtaagtgagcattggatagatagattatctgacagacttcctcaacgaacgtagcgatgaataccccaacagaatgttgcgcgggcgcttgctaaatgctaatccatcatcattttatgcgctaatccactccagatcacgccgctaatccttatccaaacgaattaacaacaaatcagtcgcgcgtttgaaacgagtccactccacctccatccagatcagtgtatataaaccgccgcgccgtttgttcgtgctgattctctctctctctctaatcagtagtaccccagatcagtttgttgctttgctgcttcttccggttccaatctgagaggggggattcgcgcgggaggcgaggcgaggcggcagccatggtggggcggagctccctcccggagggttccctcttcctcggattcgacagctccactcagtaagcccgatggtttctcttggtttttcagttgggggcttagatctttttattttttttggcttttgtgtgggtgcgggtggttgtttcttgcgaattggtcggtgttctagatgcggaatttgatgtctgctagaacgtactagttagtgtaagtggaggctgatttcgaattggggggaaactgggtagtgcttggaattgaggtgattggcaaaatgacgacggttattcaaggataaaaaaaatgtttattttgttcatctgcattgtgcaaatccgggagatgcatatcagcatatgtgagcaattgcgcaggtattctatcagggaggggttggggtagattaagttcgtaatagttgcattcagtgtctatttttttttttagaaaaaaatgacgacttgcatgcaatttggaaaccagagaattatagggagaacaggggcttatggagttccatatctagtggtggtgctatagtctgaatccttcacagttcagccttatgtctgaattcctgtattcatgttatagtctgaatcttcgaagttcagccttatgtctgagttcctgtatttaagtgatcaagtctttgtccatgctagctattttttatgttgacagtgaaggtaatttcattgaaccgagcacgccagagtcacttcattttttttagtcttgcgtaaaaaaaaaaacttcatttttagtctgcctaaatccataaagctcaatttaaagaaagaagcaagatacaccacattttggcatcagttccaattgatgtgttcgctttgtttcagtatcctgcatattgatagccatcgcctcatgacatcaccttacatactatcgatatttgacatcaccttacatactatcgatatttgcatctatatttctgtgtattccatgctgttccttttacctttttagggaccatcagagtggaatcttatattgctaatctcttgttacaggtccctaaaagctaccgtgctgaacaacgaattgataatagtagcttcagatattgttaactttgattctgacttaccgcactacaaaacagaaggtggtgtttacagagatcctgcagatgatggccacatattttcaccaacaataatgtgggttgaagcctttgaattgctacttgagaagctaaagccaaagatcaactttagcaaggttgtggccatttcagggagtgggcaacaacacggcagtgtttattggaagaagggtagtcatgcggtgttgtcttccttggatcctactaagagcttgttatcccagctgaaggatgccttttctaccatggactcaccaatatggatggacagtagcacaactaagcaatgcagagaaatagaaagtgtagtaggcggcgcattggagctatcaaagttgacaggatctcgtgcctatgagaggttcactgggcctcagatccggaagatataccgaacagttccgcaagtttatgatgatactgagagaatatctttggtgagttcgttcatggcatcaatcctggtggggaactatgcaagtattgatgagactgatggtgctgggatgaacttgatggatataaaccagagaacctggtcaaagactgttttagaggtctgcccctgatagctcctttatcatgcattcaagatttctcacataactaaaaaactttgccttcaagatctttttaatactaaaatatcaaaattgtgccctctctcctgaaggcaacggctcctgggcttgaagagaagcttggaaagttggcaccagcatatgcagtagctggtcgaattgctccttattttgtagaaaggtgagtttcttttaccattctccattgttcttgcactcagtacaactgtaaaagaaaagaaattctggaagactggaattgaataatcgcaaggtgtttgaaattctggaattgaataatcgcaaggtgtttcggcatttggctgttccctaacttggcatcaaatgggctaattactctctttaatcatttcttataatctactacattttcgaccacagattcataatgaaaataaggaacatctctatcatagctgacagattcagattacactccctctgttcatattcttgtcaaggggatttaggtgaattgtcctcaacatatagaaaagaaataatatgtgaatgggaaagctagctgtgccaaaactttagctgatatcatctgatgactgaacaaacaaatatttgttgccctaaattttgtttgagtgatgcattatgaaaatgcaggcttcagtttgataagaattgcttagttattcaatggtctggagacaatcccaatagccttgcaggtgcttctcttgctttctttctcgagattttgtaattctttcttcttttcaatgcatttgttaactacggaccattaaattattcttattttgatgtgtcttctttaggtttaactctgaatactcctggtgaccttgcaattagccttggtactagtgatactgtaagttgcaaagatgccacttttggtagaattggcttttctttctcaggctcctgggttactcatctccaaattgcctgttaggtttttgggataactgctgaagctaaaccaagtcttgaaggccatgttttccctaaccctgttgaacctgatggttatatggtgatgctgtgctacaaaaatggttcattgacccgagaaggtataatactttccatccttttttctcatgtaatccattgtagtactgggacttttctgatattagaatatgttcaatgtgtttgtagatgtgcggaacagttgcgcggagaaatcctgggatgttttcaacagttatctagagaaaactccacctctaaatggtacgttcttactgaaatgaaatttcttaatataagttcttactaacattttcttgctcgtttctgttccagcaaccttgttttccatcaggttatttatagtgtttcagtacatacaaaataaatcagcaatttaaatgttcactgcagtctcaactattatttgttcaaacttgctacgttttttcatacatagtgttattttaaatttatcttattaatattccttcatcaattttcttgtgtgaatcgaactgtgcttttgacatcttgtcattcttctttatttaacatataggcggaaaattaggattctactacaaagaccatgaaattctgccgccacttccaggtaatcatattttagtgtttcttacatctcttcacggtattcttacattattctctatcatgaaaaacaatggtttattctatgcagttggcttccatcgatacattgttgaaaacctcaatgatgtcacatccaacaatctggtggaacgtgaggtggaagaatttgatccaccatctgaggtttgcaaagacaatcaaaatacttgtttcttcgtggcgagcccattaaccttatcaccatcatcccttgttgtgttaggttcgcgccataatcgaaggccagctgctgtcaatgcgaggccatgccgagagattcggcatgcctaaccctcccaagcggatcatcgcaaccggtggcgcatcctccaacgagcgcatcctccactcaatcgcgcagatctttggctgtcctgtctttacagttcagagacctggtacagcaccttaactccaccttttttttctgttcttgcgcagcttcctgtttgctgaaactagtaatgtcacccataaattcaagcaaaaaactaacgctgcttcttgatcagattctgcctcgcttggcgcggcactgagagctgcccatggctggctgtgcaatgaggaagggagcttcgtccccatctcctgcatgtaccagggtaacctggagaagacctccttgggtgcaaagctcgccgtctcaaccggagagggtgtggaggacaaggagctcctggagaagtacacggtgctcatgaggaagaggatggagattgagaggcggctggtggagaagattgggcgcgcgtaggtagcagcattgcaaagctgctgtcctcgagtcacagttaattagagggaaatgaaatcattggtagaaacttatttataatatatagttagtagtgtatcaagatcatgttattatgttcttgtgcacggaataaataataaatgtaaatttgcaaactaaacaagctcgtctgttctttctgttcatcaattagatgaaactttaaatcttctttaaattctcatagatgaaacttgtttgggtggcttaaattctcataggggcatcttctacttttccaatttccaggtttatgattctgtcctcgttttttagctaaagcttatgttttgccccctttccgttaagaagacttaatggtgttaaaattcatgtcaagcttgtgcctgaccacttattttaattgaataatatatgtgaaagttcatgtcaaaatatttgataaggcaaatctacatcttcagttttaaaaagggaaaaaggtccaagttctctcctaaactttgaaacaggacatccaacccctgaactataaaataccattcataaaacattgtagggtggttttgcaaagtggtttctatctaattgatgtgacatatgcattatacatactagttgaaaccccgcgtgttgcggcgggcacattagaaaggatgaatatgcatgtaagtatgaataaacatgaataagtgagatataagtgagtagttctgctacctaaccaaacaggaatatagtatagtatacaatttcaaaagtaagcagttctgctatgtgatcaattaaagatgatatttgcatcatcaattgctaaaagtgccaagcacaaaaaactcatttcgagtccaaggagttggaaatttatagtcacaatgacaacaccattcagatttactagaaacattgcaagcagaatattgttaggaacaccaagatcttcaccagaggataaatataagttgagtgaaacacatgcaaatataaaataaagttcaattttgctatatatttgtcgacaaattttcccccaaaaatttgacagatgtaattacagtacaatcgtagtgtaattacactgtaacttgcaataattacactgtaactataatgtaacttgtatataactttcaaaaatctctccataacatgttatttcggtaaaatagaggttgtgggaacaaattctttcacatatgtgtgtgctgtgattttttttcttcctcaccaaaacaaatcttataatagatctaacgtttcaaaattacgtgaaacttacgtacaagttacactatagttacatgtaagttatagtgtaattacatacaagttacagtgtaattacactacgattgtattataattacatctgtcaaatttttaggagaaaatttgtcaacaaatgtataggtggtcccataaagttttgtttattcgattacagcaaactgtaggtaggtagtaatactgtgagctggaaacagtaggaaactgtaagttctaaatctcattgtttttgacattttctccatcgagaatgatatgcatgtgaggaagcttatttttcatgtaattcacaacgtgagcttgagttggctgcagcttggagaggtcgtcggtggatgatttcccttggagagtgatagaaatagctgttgatttggatgcaataatcttggaaactgcttgcaggtagttggtgtggatgagttgcacctcatggttcctgaagaagagtaatgcgttttatgatgtatagataggcatatacaatgtacagagcactgaaatgcatgaagcatgttaaatataaaatataagcttgaaaactatgtaattaggaagctatagctgaacatggatagcgagagctaacctatttttttctggttgttggtccatctgtgttggcaatggacgttgtgtttgcagaagaaattttgtgaaggaaggactgtggtatgagaaattgagcagtgcacatgtggtggtgttgtgggtgattcttatagtatttcactggtgataataaggatactaattttgttttctcatttattgcagaatcagatatgattaagaatcatatcttgagtcttttattattgaggataaaatatggaatagatataaatgccatatttcagatttggttggttttgccagtaaacttgcaagtaatggttgcaaagataagttagcaatgatggtgatagatttggtgcaggtttaaatttcttaaggaaattgttagcagtgatggtgacagatttggtgcaggtctaatttttttaagaaaaactatatatgttgctgataaaaggccatgttgtaggagaattgtgaaggatttgaagagttgtacctgttccttgtgacccgatggctgttgatcagctatctttggctgctgcagctggttttcctctccattggtggaggcttccattctgaatttagcagtcaaattagtagcaaaacatacatacatatatatatgcgcgcgcgtgacacacatatatatgtttataggctgaaacttaaggtgtgcacgtacacttttttatggcgcttagaattttgtcctggagaaaattctgttgacggttgtttttccttgctgagatctacttgttgggaatgataaagttgatttgttgcaacctgaatagtgtttgcaattgctgggctgatgcatatatgaaaggaatttagttgaagaatagtttgtatattctgcaaaaagaacttgtatcagtgcagtaccttggttgatcaatgtgtaactccttttcaaattgaagagctctctttgctgaaggtataatttggtttactgtattgttgtctagagttgtttctggaggttgtagggacggtggcgtagtgggatgttggtcttctttgctgctattagttgtagtcataaatatagaaatgttaagcagaatataataagtaaaaaaggcatatgttggttaacctgtaatgttccatggtggttagcccttcatctgttgcaagttgtttggtggctgattcctgaaaaaagttatttttagattatagatggttggtagaagatatggtaaggacaaacatttgtatacctttgctacctttgtattttccagagtaggtagcatcaaacttgtattttcattttcaacgggataactcttcttgaggacataattgatagtgaagtgtgaagagtactttgtattcatggcaatgtgaaacagtcttgttttcccaatggctgtatcaagagctatggcatgttcggttgcatcaattttcaagttctgggtagcttgagtagcatttacctcaaccaaatcctcagccacattgtagaatgctactgcgtccaaagttcctaattcatctttaattgttaaaggaagtttgtacctgaaagtttgtttgagtatattagatttgtttatagaaatgtaagacgaattaattaataagaaaaattagtattatagatatgtcacatacattggttttggcatggaatgctgacattgacatcttggagtgtcggagttgctattgtatgatgcagtacatgatttgcatattttgtagtaccaatttgtatatggtactatcgctgatacctttgcaatgcaactgtatgaattccctccctagtgtgtaagaaatattgaaatgattatttaattagattagcaacttatttagtgatgtagtgtgaatgaggtacctcgaaagcagaaatgggcagtcttgatatttcttcaagtttgtatagcttaccagccgcttgaagtggagttaaatgctcaactcgtggcatttgttgttggagagttggaatatcccattggtagcttgaaggaagattgatgcatttttgaagcaaaatataaattaaaatcagtatgataataagctatataagttacctgctttgatattcaacaatctctgttatatcggagtcaaaatatatttgtgttgctaaacttgatgtagcctctgttttgccttttaaaattgtagcacataagtgagtagtgttgtttatgagagggggtattaaaaagttatttgagggactgacctaaataagtccctgctgtaagtccaacaagtatagctactactattttgtggtctgtagatttctgtagaacaaaagcttcatcaaatgactctccatattcaccccagaggactattccttgttcttgttcactacaaattggtgaaacaaaaggtataaactactgtgtcatatacatttggaacataaaaatataatgcatatgtgatacatactctttgttacggattttgagctttctgtttttcttggatgatgttttgccagcataatcatatggcccaacatggctgataactcctatcagatctagaggcaaaatgtttgagattagttgtataataattaaataaaagaagatagaaaatgcaagtattacctatcaatggttttgatattctgcttttagatggtatctgatcaaatgggcagaattcaaaaccatagtttgggatggatgaacctcttgattctaggtgatgaacctttgtgctggacttaaactgcaacatgtatttttggtggtggtaaatatattttttgtttttaatgtcagcagtattgacatccacaaacatgtagacacagcctagagttagtgatggacgaaattcattttcaagtttctttggaatagtaaactgcatcatagtgccctgcaagattagaactggtataagtctaaaactgcattgttttgtcagtaatatttagattggaagttaagcataggattaatcattttttggtgtaggatagtatacctcttcatcaagaatccccccatgaatgctaaatatggttggtgtactggctgaggccatgtttttagcatcccatagtctaataagtagtccgaaaactttaaggttttgctgtcccaaatttatctgtttgagttttgttgctgatcccatctatggaaatgttcctgaaataagaggtctaaggttagctagtagacaatatcagaaaacatacattgcatataagagataatttgtttacaaaataccttggtaattaattcatatcattgttgatacggtgaaaaatctcatgatatactacattttgcgtgcaatgttcattttatgaactattgttgtttataagtatcgcaagccttttgtagatgttactcgtgataacgcaacatataattgcccatgagaaaaaactggagatggcaagtatgtaccaactttttgaagtgtttgaccttagcttctgttaattgtcatcgcatatgaaaaacatattggaaattgacgtctttttagcttgaatggccacttagattgggctgatgtcgttataatacgcagtatgtatgcttttgaacctttggctttttcagtcattatttccccttcaatgatgcgggttgtgagctgtgtaacaataagtctagtcccattacagagacctctagaaggatcaaggttacgcaaaagcattataggaacaccaattttgagatgcaaaacatggtctggaagtccattcaaagatattgtgttgaggaattctgttgggtatagagcctctcgagttgaatggtttgcacagctatcatcaatagtatctgagctataatatgacatttcagcagctgttacttgagcaatgattttgttgtttatttctgaaacaacctcatttgttggtgataaaattgcacgatcacaaaaatatgttgtaatattgcttggttcatatcctaagtcatacacaaaggaaatcaagctatccagatttctggaatctgagggcaacagaagagattggggtatctctataaaagtaccattggtttcattttctattgaaatatgaggctctgtaccatttcctactcttaaaagccaatctgcaaatacccgtagttcttctttatcggatggtgaaaggttttgtgagctaagtctcatattttcagtcagttgaagaactacacattgatgccataagcatgaattaacaatagaagctcgcagaatttggtgccttgttgcattctgaataacaggaagtgtttgccgaaaatctccaccaaatgcaacagttattccaccaaattgcctatgctgtgcattaggtcgaatgtccgataatatatctctaagtgtgcgatctaatgcttcaaaacaatacttgtgattcataggtgcttcatcctaaacaataagagatgtttgttgaataagttctgctaagtgtgtgttcttctttatactgcacatagaattctcacgtatgtccaaagggattttgaagcgggaatgaggtgttctacctcctggaagtaggagggctgcaattcttgatgatgcaacagctaatgcaattttcccttgagttctcacaaagtttaataaagttgtccataagaaagtttttccagttcctccatatccatacacaaagaatgttcttccctcattatttatgactgagttagaaatagaattgaagatttccttctggtttgtattcagactattgatgtcattagcagatgtagatgcaatgctggtaatatcatagctgagttcatctagtaataatct

SEQ ID NO: 11545 - DNA, 535 bp, Oryza sativa
ggggggtaggcgaacgcggtggcggtgggagaagcaggcagggccggcggtggcaggtgagcgcggtgccggcgggcgaagtaggtaggggcgacaggcgagaacagcggcaacagcgggcgaagcaggcaagggcaatgggggagagcggcggcggccgcgcgtgctcaccgtggtcctccgtagtcgcgtcgttggccgcatcattgaggcggctgctcgtcgcggtggtcttgttcacgtggctcccgttgatgtgccatgtccaggactgcaggtacaccgacgccaccgcgttgaggcaaagcgtgccgtcgtatccgcgttgaggtctagtatccgccggagacgaggagaggaggccgggcggagttggggagatgaggccggtcggagagagggaaagaggtgacacctcgccgccgcgtcccccgcccctctgctttgtcggcgccaagagccgtcgctcgcccaccgcttgccatcgctgcagccgccgctccgcctgctctggccttgcgctaacaccgcccct

SEQ ID NO: 11546 - DNA, 779 bp, Oryza sativa
ccccctcgccgcccatttgcaggcggccccccgcacagtataaaatcgccctatcggagggcggcaagggggccacctgcaaatttcgttgacggccgtcgcccgagagcgaacggccggctgccatggcattttcgccgccctctaggagggcgattttttaaaaatcgccctcccagagggcggtaggcgactacttccgtcaattttcaaaatggaaaattatttttgtaaaacttttaataaaaaaaattataaataaaaaaaattcaaggaggagattttcgcgatttgggccggctaccaaaaactaggaaaaaaagtacacccaaggtccctcaacttgtcatcgagatacaaaatcgtcccctaatcgcaaaaccagataccaggcatcctcaagtaacaaaatcgttcgttttaagtccctcggtggttttgacccctgttttgtctgacgtagcggctgagccagcgtggaacccacgtgggccccacatgtcaggatgccatgtcatctatcccttcctcttgtctcagttttctcctcatctgggtaggcaggctagccggcaggttggggaggaagtcgacagggcgagccgggaaaggaggaggttcggcggcggtggccggcgatcttcgatgcggcagcggcgacgaccacgcaggagcaggctggtcggcggagcatgaaagcgacgggcggagcgacggcggcagctgcgcccaccgcaccgacctgccggagggccgggcaagtggtgggcgaagccggc

SEQ ID NO: 11547 - DNA, 5612 bp, Oryza sativa
cacgttcaaactcggcagccgccgccgtatgcaaatgcacggtactcggaggccgagagcaacgacggcttctacaaagctttgctcggcacggcgcccaacgaggccttcgcccttgccatgtgctacgccgaccggaactggacggaatgcgagagctgcctacgcgcggcggccatcgggatggcctccctctacccgcggagccgtgcggcggccgccatgtacgacgcctgcctcctccgctactccaacgcgtcgtcctccttcgccgccgccaacaccaccgtcgtctctgcctactccgtccgactccgcggggggctacattgttgccggcgtcgacaccagcgcctcgagcttagacagcgacgacgcgcggcggcagctgctgctaggcctgctctgggaagaggccgccggttctgagaagaggggaaagagagagataacgtggcatgctgacatgtggggcccacgtgaatcccacgctgactcagccgtcacgtcggacaaaaccggggtcaaaaccactgagggatctaaagtgaacggttttgttagttgaggaacgtccggtatctggttttgcgattgggggacgattttgtgtttcgatgacaagttgagggaccttgggtgtacttttccccaaaaacaacctacatgccacaaccacataatttggcccacaaagaggcctagcaaatttgggccactcccaggcccagaaaacattaccaagtcgaacaccgcaccagccatcatcgctgtcctctctcctctcctcccaacgcggcgaccgacggccgaggaaacggcgacgaggcggcgcccggccggcaacacgggcgcacggggcaagaggccaagcaagctgcagcctgcaggcgaaggagggaggacgggagcgagtaggagattcaaggcggcggcgcggcggtccggccgtcgaccagcgaggcgcggccgcacggagctgactgggccactgggcgcaccaaaggggcaaatcaatttcaagatctgatgatatgctacactgagaaacagatttgattttaagaactacaccaaatcatccaaaggtttgaatagatgaaagagcgtccaaagaatttagtggtatcatgcttctccctaaatctctaaattattttaaaccattatttatctgttatcattattcattaatctgtcatttctttgttttttttatagattgctgctcgtgaagaaaaatgggtggttgatcaccgcacatcatttattggacaatggtttcgtactgtaaattctactccctccgtccaaaaaaaaaaaggcaaaccctggtttccgtgtccaactttgactgttcgtcttatatggaatttttttataattcgtattttcattattgttagatgataaaacataattaatattttatgcgggacttgtctttttaatttttttttatatttttttcaaataagacggacggtcaaacgttgggcatggaaaccaaggtttgtcttttttttttgggatggagggagtatgtatttcagtatgtgtactccgaatcagatatgtagcctacatgaaagatgcaccaaattgtgttggcctaatttgttaagcctcacgtattattttttcatgaatctatggtattaatcatatggtagaaagatgcgcatgcatgtcttagggattgggatcctctgacgtgaagtcagagagacgtggtgactgacatgtgaaccccaccactcgcggacccacttgttagtgaccatgtcacggagcagttcacgtcagaggatccagttccgtcttacagacactcaaaaaaaaaaaactaagcccgtttaacaagctgagcacggagcggctttgccatcacagtggtgaactcattcttctcggtcaagtccacctcgtcgccggccacctccttccactcgaactccttcaccaaattcgccacgaaatactccaggtgtagcatggcaacgccgagcccggcacagatcctcctcccgacgccgaacggcatcatccggacctcccggctgcccgtcacgtccactccctcgccgtcgccgccggcgaggaaccgctcagggatgaactccatcggcttctcccactccctctcgtcccttcccatctcggccaccatgaagttcaccgtcgcgcccttggggatgaggtacccgccgacctcgacgtcctccgccgccttgtgcggcagcacgaagtgggccggcgggtgcttgcggaggccctcgaggatgacggccttcaggtacggcatgtcgtgggtgtcctcctcggtgatctcgtcgtcgctggtcttggacttgatctcgtcgtggagcttggattggatggatgggttcttgaccagctcggccatgatccactgcagcgcggtggccgtcgtgtcggtgccggcattgaggaactcggagcagagcatcaccagctcgtcctcggtgagggcgctgtcgccgtcggtgtcggggaggcttacgtcgagcagcgtgtcgacgtacgagtgctcgaacgtcgtctccttctccggcaccggtgggccgccggcttgctggatatggttcttgcgcgctcgccgggcatcgatgagtggcacaaagagctccttctgctgccgtcgcagggcgaggcctatttggaggcggcggcggaagatgtgcttggtgaccgccgggtagaacgcgaatacgctcgtcttcctcgcgacgtacaggagccagtcgcgctgcgcggcgccgatggcgcgcaccgcggcctcgtcgagccgctcgccgaagcacatgagcacgaggaggcagaacatggcgtaccggaacgtctccaccaccacgcgcgggcgtggcggctcggactcggggcgcgcgccgtccgcgagcttgtcgacgagcactcggcgaacccaggagcgcgcgggcgcgaacaggcggacgcgcgacgggtgcagcgtctcggcgacgaggttgcggcggaggacacgccacacggggccgtagctggagcgcgtgatggtgttgccggtctcgccgagcagcgagcgcgtgacgtccgggcggtcggcgagcgcggcgccgcgctccaccagggccgcgtgcgcgacgcggcggtcggcgacgaagatggagaggcgggagcccacgcgcagcgacacgacggggccgtaccgcgcgatcaggcgctggaggagcggctccaagttcgccgaggagtgcctcagccacaggaggcttccgagcaccggcacggcgagcgggccaggcgggatgcggcggctgccaccgccgctccggcgccgccgcgcgaggaggacgacgagcgggaggacgagagcgacgaggagcaggagccatgaggtgtccgtggccatggcgtcttcttgcctttgctctgctccgccgcctcgtcagttgagctttagtagcttcggagttcgagtcaaagttctttcggctgctgacgtcatggctgatggatctgattcggtggcgtttctagaggatgagcatgtgcgagatgcccttggcttcaaagctcgatgacagatgctttggttatcctggttattgaccttattaaaaagagaaaattcgatccataatacatgaaagaaagcggtaccaaaaaataacataaaaagtttccactttcaatctatagcataggccaccgatttttctttgtcccgtagcacttccgtcacattctgaagtaacggcgttagataggagtggagaaaattttcgttgcactcatttgccctttgttcccccaccaggtctcctcttttgctcccgcgtggacggtggtgcggcggccatcagcgtgccgagtgaccacctcgtctccccgccaccgccgagagggctgcggtgcacgctcttcaacaacatggacgcgtggctcaccatcgccaccgacggcgaggtggaccccgtctggcgctcggcgctgctgatcgagggtgagccacccacgccggcggtcgtttgacgacaaggacgacaacgatgacgtgggtggccctatcttcggcatggatagatgtggcccatggtggccgtactcgccgccggagaactgcctcttcctcgccacgacgccgcaccacgccggcttgccgctgcttccctctacatgcacggctgctccaccggctgcagcacgctccgtctcgccaaggacatcgccgagaacaaccgcggcgcgtgcgtgctcgtggcctgcgcggaggtcttcctcatagcgttcgccgcccccgatgatgcccacctcgataccctcgtcgttgcgtcactgtttggtgatggcacctctatgtcttcctcctctccgttgcagatggtgggcggtgccggcgcggttcggctcggcggtgcgcttggagacagggatggtggcggcgcggctagggatggggatggcagcggcgtggctggggacggggatcgtcgccgtgtggctgtttggtgacggctccggcgccgtcgtcgtgggcaccgacccgagagaacgagatgatggtgattacggcgaggaagatgaagggcaaatgggtccaacaaaatttttctatacttcgatctaacgttgttaactccaacctgacggaagtgctacggggcgaagaaaaaccggtggcttgtgctgttgatcgaaagcaaaaaaaaattcttgtgttattctttggtaccgttttttttttctatactatggatcgaattttctcatgcatagtaaaatgcatcgtgttgtcatcgtcacatgaactattctgggacaaaccaaatgctccatcgggaggaatttctgaagaaaaatcgaccatcttggatgatcctgaattcctgatgtctgaaagcgcagacagaaacagttgaacggtacacgggccacacggcttcgtctaaatcagaattcttcagaaaacgatgccgttttactgttcacttgttggaagcaagtcaagctggatcaatcaatgacacggcgaatgcaagttggccatatcgttgcacggtggttctccgtcacataagatgtttgacaataatttgaagtagtaaacatatactatttacaaaactaattacataaatgaggcggaaacttgctaattgatgcgaaaaaaaatcaaaaaatgagaaaaaaggaaaaaaaatcgtgaaaaaaagggaaagacacgtgggaaaaaggaaaaaaacgcggaaaaaaaaggaggggacgcgtggcgtggtgggggccgagcgcgccaattagcaattgtgttcaccggaggtctcttaagttaacagcgatatttttttaggtcccttaatcccaaaaccagaaatgtgtaccctttaccttacacatgccgtgcacaaggtcctataccagtatatatgggaagtttcgctgatgtggcatcctagtcagaaaaaaaaattaaaaaattacgtgggtccacgtctcagctgcacatttttttcttctcttttctctcatctctcttcgccggcagcgggcggcgatggcgagcagcttcacgtcgccaagcatgtggccggaggcaggcggagcagcggcgtcga

SEQ ID NO: 11548 - DNA, 4610 bp, Oryza sativa
ccgccatcgccctgcccgccgaagaagacgagagaagagaagaaaataaaggagaaaagagaagaaaggtgaagaaagaagggatatggggcccacatcggtttctctcacttgcatgtgggtcccatatactttatttatttatttttgctgactagtatgccacgtcagcgaaaccactcatatatactatcatgtgccataggaccttgtgtgcacggtttatgtaagttaagaggtacacatttctggttttgtggttaagggactaaaaaatctcactgttaagttgagggacctccggtgaacttattccaatccaagaaaacgaacggttcgaccttcaagtccgggtgatttggcaatgggccggcccttccaattcggcccgctcgacctacaacgccttctttctcagccagcaattcttcccctgcactgagtgcaaagggatggattgccactcgttgtgcctcttttatgcgcattagggaggagacggccgaaacacatcctgatcatcggatgtgtcttcgctcgtttggtttggcttcgagtgctcaccttgatcattggtaggggagatttctcatcggacccgcatgccctgttgcatgattggtggcagctctcaagggatcgactgggcaagcagctcaaaactccagttatgttcactgtctaatcctttttattgttggttctttctgttccttaggagcttggaggaactgtatggaatagaccgtactgaatccgacttgttcagagaatagaattgcccgtttcaatgttcacttgtgacttaatttgtggttgtataatctactactaatatccatctcgtacaacagaagacacgggagtctcgtgaagcatcacacgactacacatctggcgattacattttgtgacctcaagggtgaagccttctacagttctatattggatggtagaataccaggcagacgtaaaagagtggaatttaaactttcgaggatgtgttccctcgttgtttgcaatatcacttaaatgattataaaaaaaatgagaagatgtattaacatacagtataatatatcatttgaaaatttacaagttcaagctcaacatatcgcaacgaaaaaaataaattttatatttagttcagaattagctcatttggcaggcatataagacagtaaaacaaaaatggcccaaaagaatttaggcccactagttttttaactactaaatacaaactcctaagaaagcggtaaaaatcgttaggctcgtttaattagccggacgcggagcgactttgccatgacggtggtgaactcgagcctctcggcgaagtccacctcgtcgccggcgacctccttccactcgaactccttcaccatgttcgccacgaagtactccaggtgcagcatggcgacgctgagcgcggcgcagatcctcctcccggcgccgaacggcatcatcctgatctctctgctgccggtcacgtcgacgccctccccgtcgccgccgccggccatgaaccgctccgggatgaactccgtcggcttctcccactccttctcgtccctgcctatctcggccaccatgaagttcaccgtggcgcccttggggatgaggtacccgccgacctcgacgtcctcggccgccttgtgcgggagcagcaagtgcataggcgggtgcttcctgagaccctcgaggatgacggccttcaggtatgggaggttgttgcgggcgtcgtcctcgttgatctcgtcgtcgttgtcgccgctcatcgtggccttgatctcctcgtagagctttgattggatggatgggttcttgaccagctcggccatgatccactgcagcgcggtggccgtcgtgtcggtgccggcgctgaggaactcggagcagaggctgaccatctcgtcgtcggtgagcgcgcggtcgccgtcgccgtcgacgtcttgtagtcttatggtcagcagtgtgtcaacgtacgagtggttgaatgttgtgttgtcgtccttcttcttctctgatgccgctgaatcaccggactgttgaatttgtttcttgcgctctcgccgggcgtcgatgagtggcatgaagagctccttctgccgccgccgcacggcgaggcccagatggacgcgcccgcggaagaggtgcttggtgatcgccgggtagaacatgaagacgctcgtcttcctcccgaggtacaggagaaaatcgtgctgcgcggcgccgatggcgcgcaccgcggcctcgtcgagccgctcgccgaagcacatgagcacgaggaggctgaacatggcgtacctgaacacctccagcacgcgaggaggagacgcagggtgcgcgcccgcgtccgcgagcttgtcgacgagcacgcggcgaacccaggagcgcgcgggcgcgaagaggcggacgcgcgacgggtgcgtcgtctcgacgacgaggttgcggcggaggaggcgccacactgggccgtagccggagcgcgtgatggtgttcctgctctcgccgagcagcgagtgcgtgacgtccggggggcggtcggcgagcgcggcgccgcgccccaccagggcggcgtgcgcgacgcggcggtcggccacgaagatggagaggcgggagcccacgcgcaacgacacgacggggccgtgccgcgcgatcagtcgccgcaggagcggctccaggttcgccgaggaggagtgcgtcagccacacgaggcttccgagcacgggcacggcgagcgggccaggcgggacgcggacgccgtgcttccgcttaacggcgccatgcttcgcgaggagggtgaagaggaacgcgacgaggaagacgacgaggagcaggagccattgtgttgcatcgatggccatggcgatggcgtcgtgtcgtcccttgcgttccgcaagttaattatcagctccgcttcgtcagttgttgttaaagatggtttagcttccctgccttgtggctctagcctctaggcctgtagttgatggatgggtttccatggcattccggacaatatcgatcgatcagcatggccagttaaatattcactcagattcatattataagttgtttgattttttcctaatcaaactttgttaagtttaattaagtttacagaaaatttaacaacatataaaatatcaaattagttttattaaatctaataatgattatactttgataatatgtttgttttgtgttgaaaatacggatggctactcagacataaacgtttagctctggatttggtctaattcttaaaactttagctaacgatgactatcatactttagtttataacgataaaaatgatgtacaaatatttgacttaaatacttatttttgtgattgtataatctctagtccctccgtatcgtacaaggcttgtctgattccgtagcatatcgatcgatcagcacgtgtacgctggatcaattatttatcacgacaaaattcagaagaaaaatcggtcatcttgaacttgatgttcgaacataaacgtgcttggtttgccgacttgcccgtactgattccgattttgcagaaattggtagccatttagcgcctcacttgttgggggcaagcagccaagcaatcagaatcacacgatgaatacaagttggccatatcatttgctagttcagcaatagcacacaatgatctgctctttgcagaacacattaatctactcgtatattgctaacacactccagcttacatacagttactacactcacgcctctatacactcgcatatgacctgcgctacaacgagtagagcactaactcttaccaaaaagtaaacaaaatgactgtataggacttgacaaggctgagtttacagtcacagagcctgatgccgatggacttagaagatttgcacggcacaagcacaactagcagcacaggactatgcacaatgcttctgagatgtggccccagcttagtttctgtggggctaagcaggggccacaggtcagaagcacaatgttcaaagctgtgctaccaagctgggcgcacacttagccacacaaacattatacggcaagaaaccttacataaaatatcaagagctgacctcggcgaccttgcttgctgcatctgagatcctgaggttgcagagcaatgcatcacgtcccgtaagcacgatctgaaagaagtcgcctacgcgcttcgatagggagtccaacccatgccggagcccctccgcgcttttcgacatgctggatatgcagtttaatagttcctccttgctttcctggacactggttctctcaggaacaaccagggcgctctcatcgctgctgccattcgcctgctttacgttactatcttggtgctctttgtaactgattctctcaaccattgccacttccttttcatagctgatatccttcttcatttcagcttcttgtgttcccccttctgcaatactctctgaaattactattccaccctccctggtagtgtcatcagcaagtttaagaccacagtgatggtctccttcctgcgcaatgctgtctgacatgacctcttcctctgtatggctaacagcatttgccaggttggcagcttcttcttcaagctgagaagtgctaaccaaa

SEQ ID NO: 11549 - DNA, 5354 bp, Oryza sativa
attgtcttgtgagttcctcactgactgcagtatgaaggtcattgaaggcctgagaccaaccaaatttttcagggacatgcaactccaccagtggcttggggctgccagacagtacagctacaaaaatactgcatacgaacaccgtcacagactcgattccatataacgctctcatgagcactttccctttcgcggagttcttgaccttcatcagagaaaggttcccagcaagctcctgcaaggtcgccgagcagctaacaagccttgcacatcttacgcccaccagctccatccactccctaagtgatggctcagctctcttgagttgctcctgcgacggcacgccactctccgagcccaacacatgcagggcatactgcaacagcaattgcccttgatccagacgagagagctccgagctcagcgcgatgcaaatatccagcagcttcacgctgctgttgagataaatgtccacccatttgtcatcccagtccgagacaggcagctcgagatcggttatcaggttagctatgttggtgtgcagctctgacaagcaatccactgcaagcctcatccatgacaaggtgaggacatccgaggcggcctccggcttgagcttcctcaagctcaatgccagggcatcctcgtacgaagcgagcaactcttggagcttccgagataggtgagctccccctggaaacataactcgaaagggattccccacagggaagaacgatctgggactaccgtgtgcgcgactcatctccactgaactgcaaccaaaggggaatcgaatcatccaattagcacttcgcaacacaaacatggatgaataaagcaacaaaccaatcggccgtacatacaacaccttttgtggatcaaatcaagcaaaagggatacctaacctcatggtgataatagtccacgattcataaaattcacagaatctcccttttccccgattcgtctggcagataagctcccactaaacatacaaaccctagcgatgctccgcctcaattcactgcgccgaactaacattacactcttgcaacacaacatgaaattttttgcagtagcatatctgtatcatccatggcgaccaaaccctaaatcgagctagacaagtaaaaaatcaagcaggggaatcacagccacaaattcccaacaacaaaccaccatacctccaaatcatcaaatccacgaaccgataagaacacacaactaagctacgtccgcacaagttgacctcagatccaccaaaccacccagaaaaaaaaaaaacttgcgccaaaatactctcaacccaaataacaaccacacagggatgagaagaggaatccactcacctagatcggcggatccgcgcgcgggggtgctcaaatcgagctcgattactcgtcaatcgtcgcgtcttcttcctctcttcttcttcttcggtgcgagactgagtcgaaggggagaggagaaaaaaaggggaaagaagaaaattatttgggagaggtggaaagttcgagacgcggaatgatacgttattacgttggggttgggggttgggccgcgcggcccgttaggcccggatttctttttagttttattgtgattattatttctcggtttggatttttttgggggggagtgggagccaacgggcaaacagctggcaggctgatagccatttgtcggcgtggttaagttaatgcgatttttgtttgtttcgatcgatgtcgttatatattttttttccgggatttgttcgtgtgtgtccaactgtatggtgcgatgatgcgaatgcttatcttaattccggaattccctcaagcaagatactgtatcattaagaaaaagtggagtaccgaatagtttccgttaaattgttttgcaatgcatccagccatatggagtatataaaatacggtcctgctttgtatccctcaatcgtgatatctgatatcacgtcctttcaattattaaaaccaatataaattgactcttttagtgctattaacggtgcttttcactgacgtggcttattaacctaatacaaccagctaattgttagctactcctacaaagacacaagaacagttggacacgagtggatacgagaacacgatagataggtttcctctcgatccgacaggatcaagccgccgccgccttcgcctccgccgtgttctcagttcatacctttcgccatcgttctcctctgtttaatacaatctcccacaacccgtgacagctgtcacagcacacgcaactcacacacgccatcgcacaggatggattactcacttggcccacatcggcccattaacacgaacactgggtcgtttagcacgcaggccgcgccccaggtcctttcctgattcacctccctgctgtagctcgtcatcttctttgtcaactcccagtgcaactgcagacttgtcagaccttcccgatgtagttatgccgcttggttgggatggtctgacaatcccccagtcttgaaaactggcttgtccccaagccagtgcacgcggaaaccgcgcgaacagatcctccatgtcctcccaagtagactctgacggcgaggaatgataccaatgggttagtaactgaagaacggaacgattacctttctttaccaggcgtttgtccaggaactggaatggaacttggagagctcccaaagaagttggtagctcatcttgcacctttttagaaaaccccacagctgcttttaattgcgaaacatggaagactggatgaatggagctagtagcaggaagctggatatgataagcaacagtaccaactctgctcatcacctggaatgggccatagtagcggaaagccaacttgtgacaagcacgttgcgccacaaacgtttgaacataaggttgtaacttcaaatacacccagtctcctactgcaaactgtctgaaactgcgctttttatctgcctggtgcttcatttgctgctgagcacggttcaggtgttgttgcaagagctgctgcataaattttctctcagtgtgccactcatgtaagtcagcaatctgacagtcatccaaaccaatgccaaaatgggatggtgtatagccatagagtacttcaaaaggggttttgttcaaagtggaatggaaagatgtgttgtaccagaattatgcaagatacagccaggaagaccacttgtggggagcagcatgtacaaagcatctgagataaatctccaagcattggttcaccctttcagtttgcccgtcagattgggggtggtaagcagagctcatgtgcaaatcagtgccaaacttagagaagagttgatcccaaaattgactggtaaagattttgtcgcgatcagaaataatggcacgaggcaacccatgtaacttataaatatttttcatgaactcttgagccacccctccagcattaaaaggatgggataaaggaatgaaatggctgtatttggaaaacttatcgaccacaactaaaatgcaattgtaatgagaggagcgaggtaacccttcgatgaaatccagtgatattgtctgccacgctcctgcgggaactggcaagggctgaaggagacctggataccgagctcggtcaggcttggcttgcaagcagacttgacacgattgtaattgttctttgatcaacttcttcatgcctggccatgcaaacaaacttttcaccttgcggtatgtcactgggaaacctgagtggccaccaaggggtgtcgcatgcagctcattcactaatttgtgttgcagggctgtattgttgcccacccagatcttgcccttgtatttcagaattccctggcacagttgataatccttccggctgttgggactgatagctagttcagccagtagctgtttagattgaccatccagctgatacccttgcattagttcttgcatccacgatggaatacattcagatatagcagcaacttcactgattggtgattcccttctagatagagcatcagcagcagcattagaaactccctttctatagcagatcttgtattgcagccctagcagcttggtgaaagctttctgctgccaaggtgtatgtaatctttgctctgtaaggtgcattaagctgtggtgatcagtgaggataataaactctccttgttgcaagtatggtctccaatgttcaactgcaaggataatagccatgtactctttttcataagtagacagtcctcttgtttttgggcccaaagctctgctgagataagctataggatgtttttcttgagatagaacagcccctatgcccacatcacttgcatctgtttcaatagtgaagtgcttggagaaatctggcagtgctaaaacaggtgctgccactagagcctgttttagctgctgaaaagctgattcaatttcaggagtccacttgaagggtattcctttctttaacaactgtgtcagaggtttgctaatcagtccaaaatgtctgacaaacttcctgtaatatcctgccaaacccaagaatcctctcagcttcttgattgtggtaggttgtggccaactcaccacatcctgtatttttgctggatcagtagccactccagcggccccaattacatggcccaagtaagagatctcttgttgagcaaaggagcacttgctcaatttcaccttccactggtgggcagataagagctggagcactgttctgacatgttggaggtgcagttccagtgtgggactataaatcaaaatgtcatcaaagaatactaaggcaaattttctcaatactggagacagggtttcattcatagcactaaggaaagtggcaggggccccagttaatccaaaggacatgaccttgtactcatagtgtcctgagtgtgtttggaaggcagttttgtattcatcaccttctgccatacgaatttggtggtatccagccctgagatctaattttgagaaccatttggatcctgctagctcgtccaacaattcgtctatgactgggacaggatacttactcttgacagttacatcgttcagttgcctgtaatcaatacagagacgccatgttccatctttctttttgaccaatagtgcaggtgatgaaaatgggctactacttggttgtatcacccccgacctgagcatttctgctacttgccgctcaatctcatccttgagggctggtttgtatcgataaggtctcagattgacaggcttagccccttccaccagtggaatgtgatggtcacaattcctcttaggaggtaattcagttggctcagaaaaaatttcctgaaattcatttaatatgggctgaactatctcaggcactgtggttgcagtaagagtttcagcaacattgag

SEQ ID NO: 11550 - DNA, 26551 bp, Oryza sativa
  unsure (1)..(26551): unsure at all n locations
gttcagctcttccttgggcaaaaccgctgtagtcacctttcctgcaaactcatccccactcggctgtcgctggatgctactctccaactgctggactttatgattcaaagtggcgagatcagagctgaggatctctacctttttctccactgctggaagacgaacttcgagagatttcttgagatcggcgaagtccgtgcgcgtgcgcccatcaacctcctccctcttcttctcattctcctccatggtccgcaatagcaggtcaagcttgccctcctgtgccatcagctgcgccgcctgcttcattacgtacctcggcttctccaaataatccggcttctccagggttctcgcccaaattcgccacactccgagctcagctaacctggggaaggcaagttgccttttcgcggggtctgatccgaagaacagccccaatccctcccccggaatttcacagccaagccaagagaattgggggcgaaattttaggctctgataccaattttgttagctactcctaacaaagacacaagaacagttggacacgagtggatacgagaacacgatagataggtttcctctcgatccgacaggatcaagccgccgccgccttcgcctccgccgtgttctcagttcatacctttcgccatcgttctcctctgtttaatacaatctcccacaacccgtgacagctgtcacagcacacgcaactcacacacgccatcgcacaggatggattactcacttggcccacatcggcccattaacacgaacactgggtcgtttagcacgcaggccgcgccccaggtcctttcctgattcacctccctgctgtagctcgtcatcttctttgtcaactcccagtgcaactgcagacttgtcagaccttcccgatgtagttatgccgcttggttgggatggtctgacactaattcatcatacggagcacacatgtcagcggcatctctctttctctttcccctcctctgccacgcccttgactcgcgatagctccccttcctcgtgccctgtcaccgctaatatcaccatcgcggcctacccagccctttccacacccgactttgacgcctccgcgcggggggggggggggggtccggatgggatggcttgatcttgagcatgcagaatggcgacgaaagagagatgtggctaacatgtgagtctacatggtaactcagttggttggaccagatcaacaagcccacgttaataaaccaccattgtcaatccttctcaagagttaaattatactaggtttaatagttagaatgtcgagatatctggtattgcgattgagtgatacgaattggattagacctataattgagagaattaaagtggacttattcgttcattcaaacagggaaaaaggcccatctatctatatgggctcaagggtataactgagccatctaatcgggctagtttacattgtcctttcactaattggacgtgcccaacttctctctcaaaggcattaaggcccatgtgcgacatcctctgagaaatcccataaattctggcccctgtatcccaggaaccaatctttggatcagcttgagattcattctcgagaattgtcaacatgtcatcctcttctccggccaaccaccggccggcgcgcggcgacaaggctactactaccatcatcgccgaggtgcctatcgcgtacgcaaacacgcacggtaaatgcaaccaaaatctcacctcaccgtgattaatttgtcgcttaatttcaccttctcctgtttgaacattgcaacaaccgatccatctactccggcgctctcgcaagtcgtaacctccagatcgattgatccgatccatcatgaggatttgcacgagaagcttcacgtaaaaaaagccccggccgcgaaggctttcggctcctactacgaaccctagcctctcagctcacctgtcgcgtcgtgtcgtcatcggcatcaacaaaaaacgcaatcaccggagtgcaatagaagcaaagaacgagcatcctgacagattaatcagctagctacagcagtagggtttctgtagatcagaatgccatcttctcttgtactgatccgtgttctgcattattcgatatccatccatccatcgattagcagcagctgtgatcgcttttggaagattgcacagtggtggtaattactttcaggtatctgatgatgtgatgtctcactgtaaaattataagcgtcggcaaccgctcgttcagtttggctgtggatgagcagtaaaaatcacattttctgttggtgtttgattgctcgctttgaacctgaggacgatatgcattgcttgctcagttcaagcaccagccaattctcaccatctccagtctcctccctcgtgctgtctcccactaactgatgacatacacagagagaaaaagatagaaaagatgcatatggcaacgacgaccactgtacgaagtgtttgtgattcgttcgatatcgatcgatcgtcattgcaattttgcagagacatgatctcactcgatcatttcatctcggcgtgaggtgaggggggagaacaaaagggagatcttgaggccagcaacactccgaggctggccctagcttagctcaaaactgagtgattcctggcctcaagttgtacacatggatgtacattctttttgtgtgcttttgttcagttcatgtgcagtacttgtgcatgtgaccaaccaacctgtcaagaacaaatgctctctgtagtatgttcgactcgaaagaatgatcagtttttgccacacgggtcacatcctttctttccatggaccatagcctcacatcttgagcttttactacattcaggcttcgaaaaattcagagtttcaggtctcagaattgcagctatgaaaaattcagacttcagggtttccctgctctctcattgggtctctactcatcagcaaatcacaaggcatatggatgcacaaacaacagatggttcagaaaaaaatactcaaagtttcaggttcttctacctaccctgctgctcaactactgccatgcatgcgttctttgcaagttgagccatgatccgatcaaaaatcctaaacgaaaagcatcagtagtgtcctagtcatggccgtgcttgtgcgtaacacagacacaacacaattccatgtgcttccaagtaccacaacaccatggccgctgctgctgcagcagcagctagccattggcatcatcatcagctagataattggcccctcccatgagcacaaattctctcttgcctttttttaaacacactttgtgactctctctctctctctctctcatgggcatcattggctcgaggaagattgatgatgacaattgacactaaacttttccctcatcatccactttatcgtcgacttttcggtggtcgctggtgatcagcatctcatgcacgccggagccagctctagattaatcgggccgatcgattcgtcactgtcatacatttgacaaatgctaaagcaacagttcgatcgatcggtcttttcttaattagtaattgtggcattctaaatttctaacaacgcctttcgatggatcgatgggtaatgcaaagaatgccaggtaactcatctttgatcgatcaatgcctaaagaactaggcaatcatacatttttttaataggatataatactttaccttttgtgtattgtttagtgtgatgatacgcaaccaagtgctagaaacactccattaaattataatctactgaatagttaattgactagagagttggtgagaaattattagttttgcggagacaaaaatattaggggtttaggaggacgaagacaagctgtcagatagatgttctcgcttgcagaggaagccaggtatggtccaaactctgcacattgccagcaaaacaaggatcatgtactgtagtctgtacaaaggatagatggattggttggcatggagcaatggagaataatgatcgataattgatgccgttgtccaatgtcacctatggaatctgacgaaaaaaaaacagcaggaaatcaaaaccggcctttctgaattaaattcagtacagtgtagtgttcttttctgaattctgaattcttgatgcctactagagtactgccaaggcatgcaatgcatgcaagcgagctgatcaaggagacaaactgaacaattaggtcacacgtatccgattgctctgggggccatgtcgtcacatcaccattaatccatattatcgtcgtcgtcgcctatgatcgccaggagaagacaagctaagctaaacctagacagacagacgccatgggggggccattgccatggacgagagacctcgagaatttaatttcttcctccatgatttgggccctgttcttttctccaacaaaagttggataaacttttggatactcgtggcatgcttttcaaactgctaaatgatgtgtttcgtacaaaaactttttatgtgaaagttgttctaaaatatcatattaatctattttttcaagtttgtaataattaaaactcaattaattacacgttattaccatctcatttcacgtgaaacacttaatctttatcttcatcatcataacatgcaaagtttcaaacactagcgcaggaaaggaagcaaagtaaaagctccaaacctgagcctcacgttgccgcacgggccactggagtgtgggcccgcatcccggtgtcccaggttctctctctggatcatcagagttgataggattgtgcttcttccatgcgcgcatgatggccggagttcgccagaagaagcggctgcggcggcgaggaaggaggtcggtcggccgcatcctcgccgcacgttctcgtctcggatttggggtcaggtcaccaacctcacctggagctggggacctgggggcaaggtgggggggcttgagcttttactgtacctgccatggccggggtcaatggagggaatgatgcaggtgtgggtgtggttgtggtgggcgccgccgttttcacatgccaacatccatgcattcatcgcttccaaactcccaggcaaaggccattaatggcggctcgcttctctacctttcttcatggctactactggtagtagtaggcagtattagtccctccatccaaaaaaaaaaaaagtaaatctagaactgaatatgatatattctagtgcaacgaatttatacagatatatgtctaaattcattatactaggatgtgtcacatccagtactatgttggttttctatgagacgaagggagtagctccttgtgaacagtctgtgaaatcaaagtgtagttttttattattaatttgcgatgaataattgacatgatatataattgattttaatatttagtgattattagtgaagtggtgatctccgtttggagcgggtcagactacataggttaggtcggttcaactggcgtcgtacgtatgtgcggtcaaaccggcaaaaccgacggtttgatcggctggatcctgattagggtcggttttcggattgtttattagtatactcgtgataatgagttctagatgatttcttcatgtgtgtaatattgttttgtgctaatgttgagtcaagttgagaaagaacttgtgctcggatatggtttcttgtttgattcatgtgtaggtgtgtcttgatgccttgggagagtgttgctggtgatggattgggaatcaacttgaaagaaggtgacgcccaaacaatcggaatatcctacgggatgcttaggctagaaaaacaatgcatgtagttgatggagattccatgcggcctacgattgaagattgtgtgtgtatgaaaagcggagtcaaattagggaagagtccaaatttgggaagattgaaattcgaattgtgataagataagtttgtttattgtaggggaagttttccaatggattaggacttcttgtacaagttagattcgtgactctaggctgcctacctcgggtatacttagagaggggttgagaccttttggtattaattttgtgggagttaagtttagagaaaagttaggatttcgagtttagtcgaattttgtaagaggagtgttattgttacactttgtaaacacgaataaaagtagtaaagttcaatctactttcaagatattttcgatttgtgttttcttgggtgcgatggtcacatcagcgggataccaccataccggtggtcagaccggcggtaccacgatggttggaccggatgcaatgacaagtgacgatgacatgaagggtggtcggaacagctaatcttcttcggtcagaccggcgacatctatgtgatcaaaccaatgatcaggcaacggtcaaacggatcttcatcgaatcttgagggtaacttttaattccgttaagagttttaggttttttgtgttactatcatttgccccttccccctctggtacgtttagttattgtttttcaatcctacccattcaatccccgacccttgcgatcggtggagggggatggtcatttgaagtagcaaatccgatttcctaacatcaagttacatggaaaaaaagagaaatttatgttgtacggagcggataatagctgaatgattttgtgatcaccattccaaggtatagtgaaattaattaagtattatcaagttaaaaatgaatttaaaacagttttttttaaaaagaaattcatatatagaaagtttttatggaaatcgtgccaggcatgtacaatggttgtcaatagtgatctcttagcgttgctaagtaggaatacttgttgacatggaggaaagagaaagaggagagacaaaacatcgttgttatgtatgacaacggcttaacaacgactcttagtcactataatatggaaaaatggttgcatgaggataaacatatggaaagaatattaacaaaaggaatattttttcagttaatgattagagcctttgtcgtctcaactattgtaaagacatggtctctaaataatcttgtattgtttaaaagaccatacccgtctctaccattgaacatgcccaaaagctcagaaagcgtgtctcattcatccatcctaatggaaagaacattccccgtaaattaaagtccagacattccgttcatgcacgactgcacgagaatttctaccaagtttgtctctctcttttttttcttttggaagctgtagctagtaaattaaccacttggcaattttttggtcaagaacgcacttgctgacatgcacaatacgcactgtcaatttctcactgcagcgggttggatggatgctgtcggctactctatcgatttggcaaatcaggaagagtgaatgacgagtggagtaaactgtaaaagccaatctgagctcaataatcttccctttccggcatatgcatgcacctgcattttcctctccatccaagagagaacaagtgctccacccctcactgattcgtgtagtgaatgccacaaaagagctaaaattaagctaatctagctacccaaccagcttcgaacatgtttaagaaacttaagattctgagaagcagattctgagaagcagctgattgatagtcggttttaagaatttgaaaaaggtgggttcttcagtttataaactgacttctagttcattttttttattctacaactatagtttcttagagtatggatcaaaaactaaactgtttagataagcttcttattctaagagaaactgtagcagtcagaagctccctaaacatactttcttcattggcgtaacggcaaacaagctgcacacggcgccaatgacggtgaatcgatcccttcttcttttttcttttttttttggcagcgacccgcgtgaattctcaggcaggcacacggtaactcgaggtatttgtcctcctcatattggctatcacctcaaaagtgttcataggttcaggtttcaggctgctcgcccaagaaacgaatcgtgtgtcaacatgatctttgattcttctctttctcttcttttagatcaccaaagcatatgattttgcaggccatatgtaaaaaagcgtacataaagcacggattatagtgccttagtgggacaaaattggtgctaggctctgtttaagtgagagggagactctaccggtgagattcggaaaaatctggtaatttcgatattttttttgtactatgaggattttgacttctaattcacttttttgattctatagtttctgatacaacctaaatgaaaaaatgaattgttttggaagctagttgaagaaactatggccgccagaaattccctcaaatatagaggtaattttaccatacttagaaggtatcaagagataacatattttctaatctaaaatttgatacctttagatattaagtattttaaggtattgaatattttaatgtaaaatttaggtatcttaagatatttttttatggattataaaaaatttctccaaacatagccttagccgggctaagtgctataggctatagctgcttgcttaattcttcggttgtaattttctagtactatgcaatgatgatcgatttgttttgggccaaattctgagcatattctttttgatagtgctgttattagcagctaaaccaataggttatgcacttatactgggctcaagggcaaaaggccttgccaaaggcacaaatctggccgtcactttacgcacttggatgattcttctcctgtaatccgaccttatcaatagcatctgcgattaatcagccattgaatgattaatggtacgaaaaaatgaggtttaattcgtttgactcgagcagacaaggacgcatgcggctgcctctgctagctgctgttctctgctcagactttcagagattcagctcagtttcagccattcgtctcgcgatgttctggcgatcgtttcgtggccatgagctaatcctaccagtactagcaattcactgttcagcaacaatcgatgcattgaattgtttctacatcagtagagtacagagtttctttcactagtggtgtaaatgtgtgtgatcacatcgattggatgagttcagagttccacatatcatactagatcatgacattgtgataccgtggtagcattaataccactagttgtcatgctcctacacaataattttgtatggaatgctgctcatcaacaaatcaggtaagacttaacaaggttattagcaccgacctgaacatgtgtggaaagatgcattataaatgatttgacccgaccaaattgattaagccacatgtccagttaagcaggagctagtatagcatgaattgattggtgcatatatatgcatgcagtcttggaactaagccaagcttgataaagatgggacaatcatagcaggatcaaagtggagaggagactgatcagctctcatggcaggtggtagtagtatgatatgagtaggacacaacatcactagccaaaatggtactactcagatatccacactgtagtagtggtgggagagagatattggagctagatagccccattcctcttttgccatgagttggagttgaaagttcactctgaaaaaacagattttcaaaatcttcagtactttggctgccctcctgtttgtgcttattctcattcgcgcgcttttcggtcccagaaattctacgataatttttcgttagtcttatacgttatagcccgattttttttacggtaaaaagtataaaatcatgtgtttcgaaggagacttggtctgtgtaacatgctgtgtatatggtagcatgttttgccactcggtagctctgaccatttgctggcacacatgacaagcatgcaatttttataccagttctaatgtttggtatattcggatttaccggagtcatatgtactcggttgttggtgcatgagtcctgtgtgtgtatcgaactctgcgtgagatcatctcttgtattgtttcgatcagatcgcacatgcatcccaatattttttggagaatgacgattaatcaaagcctaatgattcatgttgtcctagcttcatacaaatcgatactacatttaaaaaaacagtattattattgataagtcaataacggctggcagcattgcatagatatggtaaacaatgtgggtatcacatcatttaatggttttttcatggcaaatcagaagtcaaaagtcaaagagatattttggttggatataaaattcatgctaaaaatctgttcagcatttggacccataaattgattctttttttcaggaatttttgtgctgaaactgaatgtgcaaaccccactactgcatttgagggacaacatcatgtactactggtgctcacattgcaaaacccaaaaatacaccctcaaagtcatacaaaaattacaaaaaaaaaatacatttacaatatcatcttcacaatatatatcatccaaattgaaagatttaaacccaaataaagaagagcacactttgtcagaaatgtaccacaccaatgagtgcatgcatggtttctctctccccctcttcttttttcctctcctgagctagctattgggcagcctctccatgacagtttgtcctctttaactcatataaaatacttaattattagtactagttacttcacaaacttacaaaattacagctactgcttcttctgattaagctgatgcgatccccaagcctttttagtacttcgcgttgcattattcgggcggagcagttgggagatacctcgctagcagtggacgccattgacctcgatccatcgcctcatgtgcgcacactacgcctatatacagtcgcaccacacacagctacctccaccacccaaccccccaaacacctagctcactgcatcttcttcctcctcctcctgatcaaattaatcatcgtctcctccattgcattcttgcatccatccatctagctagttagtgttgttcttgttcgtgttcttgttcttgatgtgcattgatctttcttctctattgatctaattgttcttagattgagagtgaagttgtgagagagctggacaccatttctctcatcaatatcccttagccaaaccttgagaaaagcctgtgaagcatgtaagaacacaccagtttgttccatccaaacccaacccaaaaaagcaccaaaaaaaaggtcatcagttccaagtcccaaaagcattgttctttcataactaggcatctcggttaattagggtggatattcctccactaatcccttagcgaaaaatctacaaaaaccactagatcatgtaattttcggcgaaatcattccacccccagctgaagaaaaaaaaacaaaaaaaatataggccaagagaatcatattccagcatgcatcgttagctagtagccatcatctcagtcgcagtccggtagtaatactggacacaatcctcccattgctgtagcatttacctctgcaaaagccatcaaatcatgtaattagtagctaaaaacccatcctatttctacctcatcattcgcctgaaaagagaaaaaaacaagaacaaaaaaaaaaagaagttgcaagaagaggagagcaagaaagagttgatatattaatggagatggcggcgccgaacgggggcggcgcggcggggatgtcgtcgccggtgaacggggcgtcggcgccggcgacgccggggacgccggcgccgctgttcgcggggccgcgggtggactcgctgtcgtacgagcgcaagtcgatgccgcggtgcaagtgcctgccggcggcggtggcggaggcgtgggcgccgtcggcgcacggctgcgtcgtggagatcccggcgccggacgtctcgctcacccgcaaggtacgcgcccccatgcacatgacgcccccacgtggacacccaccgcttctttcaattccctcctctcactttgggtgttcttagttcacgtcaaaataatgtgatggaaacattgaaagtttatatgtgtagaaatgttttgatatgatgaaaaagttagaagtttaaagaaaaattttggagctaaactcggtcttcgtctcaaaataaatttaggcacctttctttcttctgttgcttcggttcgttttaaaataaatcaactttaagcaagaagtactctgtaaaataaaaagaaaaaactagtatcaggtttacaggtaggattgatttttttttctttttatggaggggatatacatgcaattatttgagttccatccatttttttttaccttttttaaagaaaatgtttggacactcttagctagctctcttctcccactcagctatgtgatttgattattcagtggattattgctgaggactattggtttgatttgtaggtatgaataaaatatttttgaaaataaatttaataaatagctccaaacaagagatataagcaatataatgaaaaaaagtttttcaacatgactaaaaaaatcgtattttttgagcgtcgagcaaataatctatcaataattgggtaaattaataagctggatataacatgactaacccttcatcttttaacctttttttgtatgtttttaaaatggttttttggggtgtttttgtactatggagttgaacgtgctggtactttttggtgtacttttactctgcttctgaaattgtgcgcgagatgtcgtagacgtagtcgtacgtacacaaccagcacggtataatgtcagagacatgtactgatgtacaaacatgcatccggtacaaaaatactctctggcatccatctgcttcagaaaaataaaaataaaaagtcagaggaactgatcgatcgtcctattcctagcaggaattttttttttcagtgcaataaatctggattttttttttacgagacaaagagagtatacacaacagacaatgaaacacatgatttttgtttgtcacgaagcttcagaaataaaaaagtcagaggaactgatcgatcgtcctattgctagttgctgaatagtactagtatttttttccgtaatatacacggtatattatacggccaagttgggtatgatccaatgtccttttggttagttttaaattactaggtgccatttctaaataagtgacgattaattagtctctaagaggaaaaaaattccgtatattccccctaaatattgaacagtttctccccttatatttctcttcttagaaagaaatcaaaaataaaaatggagggttgatatatagagtaccaacatgctcttctatttggccaaagtgctcattcagaaaaccatatatcatgcaaaatcattttttaaaaagagcaattctacggtccttgaggtaccaaaattttagtgtaaaatttaataactcatggtacctcatagtacctagttaccaagaggtaccaaatttacaatagaaaaaataataactcatggtacctctttaaggaccgtaaaattgctaaaaaacgttatataacggtggtataaagtttggatgttacatggggtacatgtactttttgaaacgaaatgtgttaacagtgacgtatggagacaaaagagcaacatcacactgacgcggtttcagtaggtgattaattaaggaagtgacagtggttagatctgtacttacacagtgctaacacactggaatcaggggtgccgtcagcagagctttgttggatccgaacctgcagactcaaaattttacacaggtccactctggcaatggtcctccgtgagaaattttaaaatattctgacgattcaagcaaccgcattgtattcagtgtgtttcaaacaaacctttaaaagtttcaaaattcagttcgaacgttgaaatcaaactcatgtgtggtgtgtgaagatattgccgtcatcaaacttacggagtcatcaattggcttttgcttatgcatattcgtagtttttattagcaaacaaataaaaatttgggagtaaaaattttaacatgttcttagtatttaaaagctagtgttgtaaaatgaattacgaatttcaaaattaagttttagaatttaaattttagcttataagtataagcataagtgaagaaaaccaataatgatgttataacgaagttaaaccaaattacaatgaaatacataccaaattaccgtggaactcttatcttcaaaacaatcccttaggacatcaccaatgtatatggcaaaagtggtctatatagatgggacccatataataaactttaactatagcaatcctcacaatgtatatagatacaatgtaatattaggagaagacagagaagtagagatagataatattatttatgttactagatggctgaatggaatagtttatttcctatagactactttttgtagtacattgtggatgtccttaatcgaaggtccatgtactccatttaactaatactatttatcttgccgtctacaaagaaaacacgcaatgctcatctttggaagctgaattttatattgtcaatgatcactgatgggatcaaacagtacagtactacctaaggcgattaggtcctagctagcctacatcatgtttgattaattttgtgagtataaaacctgcaaagatgctgaattttcttggccttgctcggcgtcagtcggcggcggcgcgcgtaatccggcggtttgtctgtcaagtccgcgtttactgttcacgccatccctgtgtgtcccataacccatcgcaatttcagaaatccagaactgatgattcgattaaaaatttggtcatgttgtactccatttggagtacttaccatttggaaaaagaaaattaaatactactcctatcaatggcactgttgaagtcgatgacaaaaatgcattttttaaaataaaaaaacgtgcgagcgagaaagtacaatgatttttggtgataaggttttttttggatgtgacatgagagggccgtgtccaaaattcagagttgactcaacgatcgcttcgagccatccatccgtgaggagagagtggttgctttgctatgtgcctgtcatgtctaatctgtccctggttttcgtttctttttctgggagggtaatcagttcatgatttgacataatcgccgcagaattattggttcatgattatttgcgaaaagcgcatggttttagtgtaaaatttcaacgggacattgctgtgtgattcttttggactaaaagcgggtaattttgttatcatgcacagaaacaaaactttataaacatatatgtcgtttcagcttttgattagtgcctgatgatcccacattcctactgttctttttgtcacgaccaaaatctcgctaaattcagaagtacgcaatcacaaacttttgtgtctgattacacctttttgcagtttagcattgccacataatcaatcagacgcacttgaaagtatccatagacttttggatggacttttgaaagtacttctgaaactgaaatgtccagctcaatttgcttgattgatcaatcaaacagtaaattaatcatcaaagagagagtgtcttaaattgattgcaaatttacacgattcatatacagttacagttatggtgtgtttagtttttaggtgtaaaatttttgaagtatacggacacacatttgaagtattaaacttagattaattacatattccgcttgtaaactgcgagacgaatttattaagcctaattaattcattattagcaaatgtttactgtagcatcacatagtcaaatcatggcgtaattaagtttaaaagattcgtctcataatacatacaaactatgcaattggtttttttcccatatttaatgctccatgtatgtgtctaaatatttgatgtgatgtttttggccaaaatttttttagatctaaacaaggttttaactctattatgaattcactttttttttaaaagagagctccactatgaattcatgaactcgtaaattatagtaatctgtatgagtgtgttaattaagctgggagattaacgctgaacaaataattaaactgcggtgcagcttggagcggagttcgtggggacgttcatcctcatcttcttcgcgacggcggcgccgatcgtgaaccagaagtacggcggcgcgatctcgccgttcgggaacgcggcgtgcgcggggctcgccgtgacgaccatcatcctgtcgacggggcacatctccggcgcccacctcaacccgtcgctcaccatcgccttcgccgcgctccgccacttcccgtggctgcaggtcccggcgtacgtcgccgtccaggtgctcggctccatctgcgccggcttcgccctcaagggcgtcttccaccccttcctctccggcggcgtcaccgtccccgaccccaccatctccaccgcccaggccttcttcaccgagttcatcatcaccttcaacctcctcttcgtcgtcaccgccgtcgccaccgacacccgcgccgtcggcgagctcgccggcatcgccgtcggcgccgccgtcaccctcaacatcctcatcgccgggtacgtataatcctcttcctcctccttgtagccaggttttaatctttcagtttgaatgtttctatcggaacgtgtcgatataccgaaatttggatcaaattttagtcaaattaagcaaattattaccaaaataaaaaaaattggccgaaataatcacataggggatccaaaataaccaaaattttggaaatttcatttcagaatttttgaaccctgctcgtagcacgttactgcctctgtgttatattgcaagtttattaaatttatataagaatatagtaacatttctaacataaataaacatattaaaagttagttttattaaaaactattttctataaatttggaaaaggaaattttgaaaaaaaaataaaacgacctataatatgaaacaatgagcactaaaaatggatggatttccaaaaaaaaaagaaaatttgaaccatgccacacaaattttataaattttgtaaaatttgtgatatgacaccctgacccacatgacattaacttatgtggttcctacgtgtcattgagatacgggtggcatattttaaattttacaaaattagggtgtcatggttccaacaaacaaaaaaaaaatggatggatttgatctccggctaaccggcggcgtgggtgcggtgcaggccgacgacaggagggtcgatgaacccggtgaggacgctggggccggcggtggcggcgggcaactaccggcagctgtggatatacctgatcgcgccgacgctgggcgcggtcgccggcgccggcgtgtacacggcggtgaagctccgcgacgagaacggcgagaccccgcgcccccagcgcagcttccgccgctgatccaaatcatatccaaatccatatccataaaaacaaattattatacacgacgtagttaacctgaacaaattatatggcttccaattaaaaaaaaatcagtcgtgtcatccttgggccttgttccacatgggccgaacaccaagagaaatccgcgtgaatatgggccgtgattttggttgaaaattttcggtccattcacgtagatgggccgggtttgaggccttttcaaatgagaccttgggggcgtgtaataaaccccgttttgcttcgtccagaacggcagagtataatagttcgagttgtgtgtgatgtgtcagaactcagaataaaaatgcacgccgatgcaccggggtgatgggcatcttgctgtgcgaatggtgtaaggttttatttaatttcctatttgacaaattgtgtaattttccctgttccgacattgataattgagaaaaattgtcccaaaaactgcgtagccaactgtcagtgagacgttaacaaaatgatgatgggatctctgcaatgtatactgagcaaaattgtgcttagactatgtgtgatgaaaatatgtcccctctgctgtaaatccatgcaagatttgtgccagtatataccactcaaaacgatcttagtaatctgaattttcgggatttctcctctctctttttttaattattcctctagatgtcatgcttggattggaatttcagtacggcgctttatttaccatacccaagtggttttgttcacatttttccattacgtttcggtaagtgaaatagctaaaacaggtgataatatgggggtcggccccctgactcccctgcccaacaacatcgacaaattagtaatccaatttagatgggtcgtattagtaatctaaatttctgaactttttcatatatgtacaaccacataaatttgtgttggtttcgaatttcaatgcagtgttttcatagtgaaacagccaaacatgtgaaaatatgggggtcggagtccaattctccaaaccccacaaactctcctgctcaacaacaccaacaaattagtaatccaatttggatgggtcgtattagtaatctgaatttctaaactttttcgtatatgttttttttttttgagaaaaggcccaaacaacattaacgaatccaagtccaatttagatgggctgtattagtaatatgaatttatgaatcttctagtttatttaaaaccacataaagttgtgtttggctttgatttcaatacggtgtttccaaggttaatcaaccaagcaagtgaaaatacgaattaattttgaaagtatattgtgttttttcttttctcaaaaatattgatgtagttttatcgacacaaatatacagttggtattgcggtcccgcgcgagactgctcggtgtcagtcttgcatgaccaacaagcgagaccagccagcatgctgttcttggacgctaatcaatgattaattaatcactaatcatttcatttccaacactctcgcaggctgataatgcgagactgctcggtttcgcaccctctccgcgcaagaccaacaccacgtggtctcgtgtcctcaccgtgcgagaccacccacgtcgtcactccaccatcactttcagcgatatcgaagatatatttgtgacaaaaaaaccgcatcaagaatatttcagagagaaaaaagaacgaagaatatattttcaaatttaattcgtgaaaatacaggggctcggagtctaattcaaagtactcaacgacctcccaaattaggagtccaaatccatttaaatgggtcgtaatggctacccggcatctctgcctgtgtattctgggctttccagcactggttttgcgttgtagtgggccgtccttgctgacaaatggatggtgacaaatccaatggaactgatgaaatgctttactcgtcgctaatgaaattccattcaacatctactcgaatagggaaaagtctattttacacccttgaactcttatgcgtgtctaaaatacacctccgaactacaaaaccgggtataatacaccctcgaactgtcaataccggacacttaacccccccccccgggctgtttttaccgtggtttttgccacgtcagccctcaccatgtcaacacacaaggtaatatgggccaagcccatactctgttcattcttctctccctcccctgttcgttcctcttcctcacgtccgctagcggcagcagcgcggagctgctgcgagggcggtgacggctgtgaggacggagctgcggcggcggctccccgttccacacgtggccactaccagctcgcgaccggctacggtgttgagtctcctccgcgcgaggggccagtgcgggtccctcctccacccgcgccgcctttgcttctctattgcgccagtagcagccgcaaagcccgaggccgtcggtaagcctccaggccccgctcctccttcccctcgcgtgcatggtgctgaaccgttgatatgtgcgatgatatttgtagggacgaccggggaggcagctgcggcgccggtggaagagctcgcgaaatctctgcagggggtgcagggggtggaggtgttcgatctgagaggaaaggcggtgcccgctgttgatctgtggaaggacaggaattttttatcgtgctttgtaagattgattgtgtttgagacgattgatgatggttgtttgcatgtgtgtgctgtgccataagagggccgatcttcttgtggctaagcaggatagtttagtggccgattcctctctgcaaatttcgaggaacaaaggaatacatcaaatgcttaaagtgatgcattcttctactctcttttttttttcaatctatcaggttccatttacaaaaacataaaatgttttcatattcaaccttcgcagcaccgccgccctcgcaacagctccgcaccgccgccgcagccatcgccggcctcgcagatccgtgccgctgccgccagtggtcgtgaggaagagaagaacgaacagggagggagagaagaacgaacagagtatgggcttggcccatattaccttgtgtcctgacgtggcgagggctgacgtggcaaaaaccacggtaaaaacagcccggggggttaagtgtccgatattgacaattcaagagtgtattatacccggttttgtagttcgggggtgtattttaaacaagcataagagttcgagggtgtaaaatggacttttcccactcgaataaataataagttttcagttttgctcttcagatctacaaacctaaactttttatgcgtttctggaaaattagattgttcatgcacaaaatgtttcacggccactttagctatggaaacgttgtattacaagcagaagttcttttttaaggcccgtttattcgtataaatatttagaagcaaagtacatgggtgagagatttcactccctagatggtgggtacatttcactccttcataattcaccagccataggctgtaaacgtgtgcttcgatcaggatctcatctaaaactctgctgtaaacgaggttggaagccttaaaagagaaaaataccacctatatatgtaataagaaaaccccactctcaaaatttttgaaccgtgcacgaagcaacctatcattttactccacttctcccatatgcatgtgagcgagcgcaaggtcgcttggttgcctcctccactgcctggccttgcccgcatcaaaagacatcaccaatgaggcccactcaatcaacctcttccctcctcctcctccccaagctaaaggcggcgagtgtcccaccccaccatcttcccatattgttggagaaacacagccaccgtccttatattataactagtcaattgcaatccctactgttaccgttacatcattagctcaccgccggttaccaaccccacagcttcgaaggtggcgccgcccgcccgttctaacgcctcccatgaccaactggccaaccctcctctccgcaccctcccactccgctaccgatcgccatggtcatcaaagctaaaggaaaagggtcatcagcgctggaggagaggacgtaggctcatcagagcactaatagtgaaacagatcttgaagttgaaagtctgtaaattttttggctcaaaatgtatgtcagatgtgatttagcaattaaaaaaaaaggtctcatccagttccgtgaacgttcagaaaacgttttcaccacgagaaccagtttgggagcgacgtatatattcctcattcgcgagtcgcaacagcgcgattgttgggcgctgcacgcaaagaccaaaagcgggcagtatacacgcacggtccaggctagttctacatctactaccgttccatcgccttcgccaccgaacgatccgtggacgcgagcgtgatcaggtggccgagaccacgtgctcctcctcctcctccatctcgtgtattgtggctctcgtgcagcgcgcgccccgaacagtagaaaggggcggatcgatcgactcaccagctgccccagctgggcctgatccctcttcgtccactcgttgctgtcatcgcgttgtgccttgacatcgtcaccatcctcctaacttggggattccgatctgcaccggccgcccggcatttggtgctgtcccgtctttcaggacggatcacaaatgcgatatggtttactgtacggtttactgtgacctctgttttgtgtactagtttcccttttttttcaaagactatgcacgtgaagtgtaaccggttgatggatgctgtcaaatgtttccttaaaaacatcaaaatgtctcggaacgtatntcttaaaaaaaaaaagatatttncccatatgtatggttcttttttttttggggtggtactaaacggctataaaagaactctacttgtgatgacaatggaagatcccgtagatctctanaacctgctattattaacaattgttgtgaactttgctagcagtgttaaagacttttaattatttgtccatatagatattattcatatgttacttagcccactgggttacccatacacgcgggacatgggtatatgtattggtttctgcccgctagtgttttggggcatcaaggatgttgttaccgtccccgtcacggccaagggccgcgtcagccactttgtcgaggcccagatccccaaggatctgccatcggtgaggctcgacaagtagtgacgacttccgcaaactcaggagcgacgaatcttgggagttgcttgccctaccaccaccgcaccatgctaagtcgccaagatagaagttgatcgaggtgggagaggacgggaccaatgatgagcttgacgattgtgagctaatgcaggcgagctcttttattgttggtctttgacccatcttcttcacctttttccgtgaatttgttttttttaacgaaccggtaagctgccaattttattaaatagataattttctgtgaatttgtggtggaaatgtgtgttgctatggaacattgtgatagagacatgtaatttttgtgtgttgtttgatctgatttacagtgtgtgtccaagttcaaacccttgattatttttttttggacgaagggagtatttgatatgttccacagacaactactaagttataaggtggtggctcaactgcttatataaaccgaggttgtgtttagttcgtgtgccaaatttattttttaagtatacggatatacatttgaattattaaacatagactaataacaaaacaaattatagattccgcctgtaaactgcgagacaaatctattaagcccaattaatccatcattagcaaatatttaatgcagcagcacattatcaaatcatggcgtaattaggtttaaaagattcatctcgcgatttacatgtaaactgtgccattggttttttttctccacatctaatgcactatgcatgtgtccaaatatttgatgtgacggaaaaattgaaagtttgaagaaaaaattttgaatctaaacacggtccgaatttagcagcatgtgaaaatcactttcgtagcattgacacgtccaacaggcaacacagagttgcatgggaaaaagagtttgtgttttctggtttatagatttgtctatttacatattgtgaatgaatgaatgaacaaggagggaatacaaatatgcagagtaaatgtgcagtacccggtgaccgaaatgttacagcaaatttactcatcaccaataaacattgtagtacttgcaagcagtgaatgattttttttttcttggaaaggcagtaattaaggtagtagtattgcattgtatgcctcgacaatgtacatcgagccctgtggtcccactgggccagtggcccatgctcgaggcttaactccatgttaccttcgggcccaccgtgtaccgtgcgctgcactctaaatttcccctgttttcttctcgtcagtgaaagcgattgtagcctgctactactgcagctagtccagtactcctactagtactatgcaaacaagaacaaaataaggattttattacaaatggagaagtgttaattactctaagataatgtaaactttttactacagtccatgtcacaagatatggacttttgttagccagagctaacctttgtttaatctccaagttttccagagggtgacacacacttgggtcactgattctctgcatattttatgccatgatgggcacatgcggcttgcaagcctacatactactaccctacaaacaaacatgcctcaatccatggaatggaatttgcagtgtgtgtatgtgcagagaaaagaaaaaaaatgtgcatgcttgatgcttccatggttaaataatttcattaatcttgctcatcgagtcattgtttgattacttgtttactcaattgtttaggtggtgtaagtttagaatttggatgctagtaagaccaggttggcagcgagcttagaaggtccatatgattggtgctgcgtagttgtcttctcttggtctacttcacagtttaatatactgcctaattggttaccaaacaagttagtagtaaatttattgtgctactggggactacttaaattgcggtgatgcagatggctggttaaagaaggaactccccatcaggtggattagtgaaactgcaacattttttggatgattttgcagagcttgaccaagccagtgatccctaccatgtactcccatgtgtacatgattcatcagtattttctgttctgctaattaacatcaagacacatacacaaagtgatcagctttccatgtctgcatgctgtcctgtactcctgtacagatgttctagagttcagagttctccatgtggggtggaaacccaataggatccaatgcattatatggtgcatttttgctcactctgtccccccatggcaacaattcactgcaacacttcacagttcacacgcacacaatcacacagaatgtgagatgatgataatagaggcacatatgacaaatcttgattggcaaattggcatcatggcgtgttgcatgcccacatataatcaggtactgtcactatgtgcattgcaatgtagtgttcttggcattatggccagggacagaaaggctgggggagtcttggcgttgggatgactcgccaacaaccatgttctctgcactgtcctgatgccgattgctgatatctccatcccacatgtatgcttgcactggaatccactccaaaatgttacagatggtttggtagaaaatacattgccctttttgtttttggcaatatcattgtgatttgggggatctttcagatgatgtgttcatggtttgttctgttgttttgtgccgttttggggtcaattcagagttcagacacctgaaactgtgctactgtagaattcacggatacatcttgatctgaagaattgtttcatttttacatcgattttaaatctgaaaagttggtttaagttctcgactggccaatttaaaacattcatgacagtgatctgtgtagtactagtacaatgtgttgggccattctttttgggtacgtcacctacccctgcagggtcatgctcttcctgtggagacaaaagcacataaattgtgtactcactatatcatgcgaattaatatgacctttaggtcagggaattaaaagtatggtggacaagtgtttatttcactccgatgcttatgaactaataacataaaagcattttcacaacatatggcaagagggtaactgaaggccaaacatttggagctgacccttcacagtttttttttttaaaaaaaaacagtttggatgatgcgctagattcacgtaataaacaaaaaaacaatcttaaggtatgggtataaactatgttataaacttcaaaattgaggactccatgggaatgcgaatctcacaggaactagttaaattcctatgaaaatcaggctatgacttgtacaagctacaactcttttttttaaaaaaaaatgcagtacaaacgtgagcgtttactcacattatgaacacaccctacccttataagcacatttaaaaaactagcccaacatattttgagattaacgaagtcatcacagacaatttgctatttacgagtaccactgaatgaataattagtataaatgcgagcacctatatcaaatttagagcttaaccaactctttttataggcacttcaagggtttttgtctcgctttgaaatcttcatatgatatgatttaattctttggttgtgtacatttgttatgtgggggttattatcttcttcatctaaaaccttcccctcatcttgccatattatgagatccaacaaataagtactccctccgtattttaatgtatgacgccgttgactttttaacaaacgtttgacctttcgtcttattcaaaaaaattatgtaattataatttattttattgtgacttgatttattatcgaatgttatttaagcatgacataagtatttttgtatttgcataaaaaaattgaataagacgaatggtcaaacgttggttaaaaagttaacggcgtcatatattaaaataatatggagggagtattttgttactcgttagtaagggcagtcccaacccataacaatagacatggtttccataaactccacatcatcaagaaactagtactagacactactcttccaatgcaaacaccactattccatacttcaatttaatgctacttctttcacatgatgtcttggatgttgtgtaaaaaccatgtctcatacaagacatgatttttttt

SEQ ID NO: 11551 - DNA, 5268 bp, Oryza sativa
atatggtcataaaatgagctttctataagccaatttagaaaaacttgcggttcatgcaaaccataccatattcttctttcatgtaagttcagttactccctctttcctattttaaacttagtcatgaatttccatgtcaaattttaatcgttcgtcttatttatttttttcacacgtaaaatactatttatgttttgtcatctaataacaacataaatactaattataaaaaaaaattaaaattagacggacaatcaaagttaaatacgaaaaattatggttatgcttgaaatgcgacggaggaagtacaagttataagaaacagacaaacgcttgatttaaactgtactttccatcttgttaagagcgtcccctgtcaacttctcatcctcccatttgaaaacagagaccagaccacatccgagcgccggtcattatcacgaaaaatttcaaattctaatttcaaatcacatcgaaaacaacaacaaacaacaaaccaacgggttgggaaaagtgcaataaaccaatcaaaagctggtgcgccaccgcaccggcacaccacctgcccttttttggggtatttttttcacctcgccccctacgcttctccgcttttcactttttacccctccccgaaaataaataaacacccctcctcgcagttattcccgcccaccacccgcaacctgtccacgcatttcaaattaccgagccccaccgccgtcactggtaggtgggcccgtgcaccgtgggccccgcgcgtcagcgccgcggaggctgacacgtgtagtacagtcgcctcctacctccctctgcgtcgcgttggcgtctcgctttaaaaactcgcaacgccgtggcctctcgcctcttttggagcaaggccatgtgaagcctctgaccttccgataccttcccctcttccgccgcgtctcgcctccgcctccgcgcgctctcgccgtcgagctcccccgccgcgccgcgtcgcgccgcgcagcgtcgccttgcgggggggaggtggggggagggaagcttcggtttccgtgcgggatgtcgtcgaggccgtcgtcgtcggcgtcgtcgaggcggagcagctcgccgttctcggcggggagcaggcggcctccgacctcgtcgtcgtcctccgccggctcgtacctcacgggccgcctcatgccgcggtcgtactccacggcgtcgtccgtgtcctcatcctcccatttcttcggcggcgggggtgggagcgggggaggctcgaggtccaccaccccggggcggagggggagctcctcctcctccttggtggggccggttccgtcgccgccgtcgcccgtgccgttccccagcgcggaggagctcgtcatcgaggacacctcccgatccggggacagcatatccgtcaccatccgcttccggccgctcaggtgagggggatctgggagtgtgagctgcgcggatctgtttgcggggcgtggttgtgagtatttcgactgatttgagctggatttgggcgtggctgcagcgagcgggagatccagcgcggcgacgagatctcgtggtatgctgatggggaacggcttgtgcgctgcgagtacaacccggcgacggcttatggttacggtaagtactatgcttcagttgcttgtgcggttaatttggcaatgtggtgatttgaatagtacatttgagctttctgtaattttggggcttgggattgaattcatgggttcagccaatgtcggatgttcacagccgcagatttatgggataagtcgcacaatgctgaaatcactaaggagaggcttaggattttggataggcataaatgcatcagcgctgggacaaggcttgatgattaattgaaaattgaaaatgcagttcttcgttttgcattttcgcgacattttaagagtcagcttttactgtgaagttgatagccagctaaaatctaaaacactgcccgtgaggtttcattgccttgttgccttttcatgctgcttgtactgtggtcgtctttcagaagactgctagttcccgattgcaattatttggtatgctataagattaatgaaattgacatcaatgttttcattcaagaagtttcatggcctactccctcaaccagttattaagcatttgttctgtgctttctggcgactgtaattatgtttctggtcatggtcaatcaacttgactgaaatcaatgcaaaccttcaatgttcatattaagaacaatatcacattttgtgatgctgttctctatggtatcatctggtttctacttaataaccaatcatttttttactgctgtttcttttcagatagagtttttggtcctaaaacaactactgaggctgtatatgatgttgctgcccggcctgttgttaaaggtgccatggagggtataaatggtatgtcacctatccttatttagattgtccgacacattgtttcatgagttttccatttatttatatctgatggaggacaattattgttcgagagttactctatggtcatattgtaatatattatcaccatgatggcacacacttcattccaaactgttctctaccatatcatattgaacaaattacctttccttgtacaatgtttgttgctgttgtccatatcatttcatttagtgttttaacttctgagatgtttcagacttgcagtactgacattcacatattaactttatgctttacattgtatgttgagtttttttgtttatcaatgtaatcacattgctgagcacaaatctgtgccaacttgtaggtacggtttttgcttatggtgtcacaagtagtgggaagacccacacaatgcatgtaagttcttaaatcctacagggaaaaatccttggtctgttgtcataatgtcttcttctaggaaagagatacgatcctgtatttagtgattccaggttctctaattctctgttgagccgtcctgaaaacttcctctatatcattcctttgaatgcaatttatattttcaagatattctgggatcctcctattgcaagtgatcacagttatggttgtcacgtgtacattttcaatcatgaatgttgttgctaaagggaaagctcaattgtgatttatgaagacttgatcatttgatccatacttatatctatccatttatttctgtaatcttttgcagggtgatcagaattgccctggaataatcccattagccatcaaggatgtattcagcttaattcaagatgtacggaattaaatgctttacttacataatatttagccgtctatttttttccaaatatttacactgttgtagtgcatatttttatttgtttaaatggagaaacaatttacattggtttcttgttaaaaaaagtatctccaaaatatgcagtgctgtctcctcttgggatcctgcattcctgcttctgcacatggttaatgtccatgtggataataccgaatttgaactattttataaagcatgactcacatattttttgtaatggtccaagcccatctgaccataataatctcaattgtaactgacacagctttaaaagggagtctatgtacctttgtgctactgtgatggccctttctttaagattagctgcctgtcaacctttcatctatattcattttaaaaggctctagttgactagtggtggcagcagtgaatctgccaccccacctcttgccactgcagtttttataaattgtcccctgataaattttagtattagtattacaaaaaaatcctataaaaatgggttaccccattatataatcaagctgagcaccccctacataaaaaaaatggataatatatatgatgcaaaattatagtttatttatttcaggtaatattatgacattttcttttatctgtagcaaattactggcatttagctaaaggaaaaatattttttatccatttgtttgactaaaagttatagggtttaacgacttccagaagctgcaatcagtgatcataatgctctgtgttatgcaaatgcaatcctaaatcatataatttttgcacattccattttcttgtactattgggtgtacttttcactgtttgctacccaatctactttgttttgtcatttattctggatatcactcaattgctatcactgttttatcttaatttacagactcctgggagggaatttttgcttcgtgtctcatatctggaaatctataacgaggtattctacctcacagtccaggaaacgcatcattttgtaattttgatatatttctcccatggcattgcattttgtccagccccacttatgattactccacaagtgctatgtctcttcagttatttctgaacttgcccttcatgccttcaccaaaggattggttgatgacctacccagattgtgcataaaattgttctcatatatacatatagaatttactggctgcaccattgcccttgtaatccacaaccatttctgctggctatattcttctgtttccagctttgcagttagttactgcctagccttcatatttccaatcctatagtgtaaatactgtccaagtgatacctatgactatgggcagtgccacatttatttaagaggtcttgtcaaattttgaggtttgttagatttagttgtattctatatgtagttatgtacattcatctcaatggatttaatttctctctcattgcaggtgataaatgatctacttgatcctactggccaaaatctgcgtgtgagggaagatgcacaggttaatcctctacagcattggttatcatgttggcatgtacttctatataatatcggtgctctaatttatttgtttgcataccccccttgagatcccttcttttgctttcaactgttacatctaattgtcctttttaggcaagtaaacttctcttctgttgatatagataatgctgtagcagacaaactaccttccttcagaccttgtttgttttatcatggcacaatggttcttttaaaagttctaaacttctaacggaatatttagatctctatgatatcagaacagaggatttgattgttgtgtagtgtgtactgaaatataaattcactcctattttgatgcgtggaaacagtttgtgcgattctcattttgtaatgaattcgttaaagtcaaaatgtggcctgttttttgtggagtgccatttggttcagacattgatgaacatgaaaagtttttaatcattttgtaatttatattcattgtgcgtgtcataatattttcatatctaactttgcta

SEQ ID NO: 11552 - DNA, 3551 bp, Oryza sativa
attagaaggctagtttattcaagctattcttaccagaaagtgacatgtctcttgccattccaaaattaattccacttaacatggcagagcatcggcatgttggttcaaacaacttcaacttatttagcagccgaagtcataccattttcacattggtgagttcataaattctttcagcattcaatcatttgttaaaaaaaaggaactagtgttttctaattattgtattaatctgcctgatgaatccaatattgggtatgctatattactttgtttggggcctataatatttgcgtgctcttctgcagatgattgaaagcagcgctcatggtgacgagtatgatggagtcatgtactcacaacttgtatgtttttctcataagcaactctctgtattttcaattgctccagctttctagtcttacatttctgtgctattgtattttgtagaatttgattgatctagctgggtcagagagttctaagacagagactacaggactgagaagaagggaaggatcatacattaacaagagtcttttaactctgggaactgtaagttcttggtgctagccaccaccattcataactcataattgtagttagaaatcaattattatttgttttcttgagatgtgttaggagttagaacatgattgcaactaccaagttcaggttggacttgggaagcatctggtttatgttgtttttatgttgctaataatttattgttggaactgttgaatatataaaaataactaatcccatgcaacccctaaaagaatgaaatgatgcgcctgaggaaaaacttccaattcacaacatttgttgtaatcttaatcttaatcactgttggtcctacttactctgaaaatttcaaacccacaggttattgggaaactcagtgaagggagagcaacacatataccataccgtgattctaagttgactcgcctgctgcagtcatcattgagtggccatggccatgtttcagtaagtaccaacctgtttgctttcttttgcagctactctgttcaaaattcactacatggtgctacactgttggccattctttcactatgaattgaaatttgatcatcaagtgatggattaacttatattttacagctgatttgcacaatcacccctgcatcgagtaacatggaggaaacccataatacattgaaatttgcaagcagagcaaaacgtgttgaaatttatgctgctcgtaaccgggtaagtattctaggtgtatgcagctgacttcttgtgtaactgttttggaggtaagaactaatggatgcttcatgattttctgctgcccagatgatcgatgagaagtctttgatcaagaaatatcagagagaaatatcctctctgaagcaagagcttgatcagctaaggagaggattgattggaggtgctagtcaggaagaaatcatgattttacgccaacaggtctgttccttttgctatttgcgagagaaattactggagttctgtggttgtgtctgctcgcaattgtggctattttcttttaggatacctatgatttatgctgttaagttaataaatgcctaataagttactctttttttttatcttgtttagttggaggagggccaggtaaaaatgcaatctcgcctggaggaggaagaggaagcaaaagctggtctgatgagcaaaatacaacgcttgaccaagttaatacttgtttctacaaagaacaatattcctgccctgacagatacgtctagtcatcagcgccataattcggtcaatgaggaagatgtaagtgctcgttattacactattgtgcattggcacatacaatttttcctttatgatatgcattcatcaggcaggccatttcacttcaacaatgtactggtcctttccatttcagaaagtaagcacatcacaagatagttctatgcttgtccaaaatgatagtgccacgaaagattcgctatcatctgcttcgccagatgctgtggatgagatcaatcaactaagatgtgctagtggagaccattcttcgattgctggttctggacccgatgaaatgcaggtagtttgactttacgctggttactgtctaatgacatgtgccttgtgaataaattgttcgcaattattgtgtggaagtgtccttataaaataagttccttggatttacatcaatatgacagacccatgtatactatttatttttttagaatcgaattagtctgtttttttggcagttaatgtatgagaatttccgccccttatcactgtcctctttcacttccaaaacacaatgggtctattctggatgggcgtattagccatatccagtggattccattgatagttggccctgccttcctactgaacagtttgaacaattatgaatgcaaagcgctcactagacagtacaatattaattcaattagttttcattttgtagtgaacatgctgaatttgtgaatttaattgcctatgatttcctgtattttgcatttcagggagggatcaccgcatcggatcaaatggatctactgattgagcaagtgaagatgcttgctggtgaaattgcttttggtaccagttcgctgaaaagactgattgagcaatctattgaagaccctgaagggacgaagaatcaagtaatatttttcctcctttttcttaatacttcactagaaaaaatgcccatgcgttgcaacggttgaaggctatcttaatcttattattgttatacgatttagctaagatgaaattcaatgtaggaatttgcttggatattgtttttacaaggtcataagctacaattaggagtctgattgtcttgagttagtatgcgagtttttttctaaagagatttcttatacgacgacttctatatttccaaaagtgaacgaacttaaaaacctactcaaatacaaatatataatttcaaaaacgaatgaactcaaaaaccgactcaaacacggatgacgtaccaaagttccggcaaaaacgtcttcaatttttataatagtagatatgtagttactacctttgggcagttttcgatcttttctatttgtagaagaagcaatcatgtaatttacttctagacacaaatcggtagcagaacaaatgacacatcttatgaacaaatcataccaatttctattcaacaaaatttcgaaaaagaatagttccctgacccctgttatgctgacttctatggcaggtaaaataatattatacatggctgggcactcatagtttttttttgttatttattgtatcttacggagtacttcttatgtaagaacagatctatgactgataagaattgttacctgaagtttaaaagttatcttctcaaggattaatgaacttatactagtttcttattttgtatttatgaaggatagacgtatggaattgttgactgcagtataaagtgctgaacttcttgattttgtttcattacgaatatatctccatgcttcatgtcacaccttagcactccattttgctatatttatgtctctaactctctatgtcatcactat

SEQ ID NO: 11553 - DNA, 1624 bp, Oryza sativa
gcaatttttctctgtccaggctccagagcccctggcgttcttgatgttcatgtgatgttcttagtaacattttttgacttttgtgaaaacagacgattaccaagctgacagctcagtgcagtgagaaggcttttgaattagaagtgatattttaaaaataaatgtttcagtatgctgtctaaaataaaatttatcccataccaagtattaacttttctcacgattgtgcctttttttaatgctacagttaagatcagctgataatcgcgtccttcaggagcagctacaacagaaggtgctctccttttctttatttctttcttatcgttgttcagtttaaaatgtttgtgaatggtgaatgactgaatggtgcaatttcaatactggtttaacacaaaaatcacccctacttgcagaatgtggaaatcaatgagttacaagaaaaagttctacgccttgagcaacagctgacaacaaatactgaggcatcccctgaacaatgcacagaacatgagcttcatgatttgaaatctaaacttcagttgaaggttccttttctgatcctcatttccgcacagtttgttgaaatttttaatgctttccgtgcaattttttgaattgatatacacaatatttttaatatgctttgacaggaagcagaaagtgaaaagcttaaatacgagcacatgaaaatcactgaggaaaatcgtgaattggtcaaccagaacagcacattatgtgaggaagttgcctatgcaaaagaactggcatcttctgctgctgttgaacttaagaatttggctgaagaagttaccaagctatctgtacaaaatgctaagcaggcaaaagagttactaattgctcaggagttggcacactctagggttcctggtagaaaaggccgctcagctggcaggggcagggacgaggttggaacttggagtcttgatttagaggatatgaagatggagctacaggctagaaaacagagggaagctgccctagaagctgctttggctgagaaggagcatcttgaagaggagtacaagaaaaagtttgatgaggcaaagaaaaaggaactatctctggaaaacgatttagcaggaatgtgggtacttgttgctaagctgaagagaggggctttaggcatatctgacttgaatgttgatgatcgatctattaatctagctgacattactaacggtacaaaggaaaacaaagctgacaaaaatgtagctgtagttgagaaacaactttcagataataccgtgaagtcattgactgcagaggaatacagaaatccagaatttgaacctcttcttgttcgtctcaaggtatgtttaaatatgctgcatatgcatgttatgttatgactggatgtttattgtcttcaggagtaatcctgctatgtagagtagctaatatgtgccactgaataaaacaaattcttctaaatgcaggctaaaattcaagagatgaaggagaaggaaactgattccttgggtgacaaagatggaaattcccatgtctgcaaagtatgttttgaatctgccactgctgcagttttgcttccttgtcggcatttttgctgtaagtacagtcccatctatccatgaattttatt

SEQ ID NO: 11554 - DNA, 689 bp, Oryza sativa
ttcattaacatatatatgtatgtgggcaatgctagaaagtcttacattgtgaaatggagggagtagtatgtaagctgatcgttcttgtttactaactgctgaaatgcttctcttcagtgtgcaagccttgctcgcttgcctgttcagaatgccctctatgccgtacaagaatcgcagacaggataattaccttcacctaaagtgcatgttatcttaaaaggtaccaaaatctctccactggcatcttatttgctttttacttggtgcgctaacctctgaaatttctaaccaaataatgctgtgcgtatctgtcaggtaacttgaagcacccaatctcttcttgtaaaatcatcagtggtatatgattcttttttcccctagcaaagaaggtgcctttttatgttccttctgtgtttgtatcccaattctttttttttttggtttgctctatagctttcccagttcaacctgttctttgttgtacgagaagttacaagatataacttctctgcaaatatgtatagatatgcgactcgacagtataatacatttgcttttttttttctcctttggcttttgggaagtaaagcaaccaaagaacatgagatccaagagacagagactggtacactctgcctcttatccgttgccctttgcagcagtctactgccaaggcggcctgtacagca

SEQ ID NO: 11555 - DNA, 93 bp, Oryza sativa
tttcccctctctttcgcttcgcgagattggttgattcatctcgcgattgatcgagctcgagcggcggtgaggtgaggtggaggaggaggagga

SEQ ID NO: 11556 - DNA, 1665 bp, Oryza sativa
cgatcgatcgatcgctgcgcccaccgtgatggccaccacaccagccgtcgtcgtctgctagctccacacctcccccttgaccaccgggaccgccaccggccggccgggccatgcacggcgaccggccggatcgaccaagccgacgccaccaaccaaatccatcccggtcatatctctgtcgcctcctcggacccccaagctccatcacatggtggttgtcattactgtcactcgatgaaaccccatccattgctgcggacacttatataagaataaaaaaaattttggatgcacttaatagtttagtgagaagggacgtgtggtttcaacccagaggtccctattcaatccccaacacgcttacatatttttctttaaaaaaaaatggagaggcgtctctaccctccatatctccattttttaaggaggatggaaattttattaaataaataagcaagaacaattagcaataaagtaggtactaaataagttgagtaattaatagggaatataattgcatagaacatgaacggttgagattaagcatgagagagatcgaatggctcatcttagcttcacgcatgttgagcttgtggctgtaactttatagaaagagaggatttgtgtcgtcagtgtaagtgtactgctggtaattgcacagtttaattaccagctaatgcatggctgggtggttaatcagctagatctctctggttttgagctagctgatcagtgatcagtgtagcagcggcaaattaataaatgggatgaaaaagcttttgcattgcatgcatcatttcgtacctcacctagacgatcaatggtggttgtgagacatcctggatcttgaaggaaatataactgtcctgtgtcacatataatggcgtttcagctgtaatctaatccaatggagctacctaagctaccacgtatacatgtacctatagctcacattatgagtgatcgatttatctaaaatccaataattagcccatccaaaaagggccataattgtttcaatttcagtgtaatctattggattccagggatgttggaataatggaataagaaggtgagctcaaaacggatttcctgtacatgtttaacaagtgtatttgttgtaacctaacactggcgagtgagtgaatgagtgagtgagtaaggtgggccccacatgccagtcactcacccccaggctctgctttctgctcctgcataataatcaattttttaatcagtcaccagttcatctcaacatctcatcctaatttgtctttgcatttttttttgcagtttacacccccaccaaatctgaaatccccacacgcagcaatatataaggctacaatacagagccccaaacgccacacaaagtctcctcctttcttcttcttcttcctcctctcgcctttcctctcctcctcctcttcttcttcttcttcttctcgtgggtgcaagaagcagagaaggagcaacgcgagctgagatcgagcgcgaggatgtggcagagatacaggttcttgtgctgcggctgcggcgggaacatggcggcctcggccgccggtgacagggggtgcgacgatgacgcggactgcggcggcggcagcggcggcgggggatttggggaggaggaggaggggggaaagggtggtgtggctggggcgg

SEQ ID NO: 11557 - DNA, 9202 bp, Oryza sativa
tccaccgcgtgttccgccaggagctcgacgctctcctccgcgtccgccatcctcacatcgtccgcctcctcgccttctgcgagcagcaaggtgggttgggtgctcccgttctcgcgcgagcctcgccgcgggcgtttgctcgagcaggttgtgtgccaccgcgtcgtgctgaagaattctttggtttttttttgtccttgcagaggaaggcgtgctggtgctggagttcgcggcgaacgggaacctgcacgagcggctgcacggcggcgggaaggccgcggggacgatgccgtgggcgcggcgcgcgtcggtggcgctgcaggtggcgcgggcgctggagtacctgcacgaccggtgcgagcccgcggtggtgcacggcgacgtcaaggcgtcgaacgtgctcctcgacgaggccatgtccgccaagctctgcgacttcgggtcggcgcggatggggttctccgctgccgtccgcccccggtcctccgcgcacaccatgctcggctcgccggggtacgtcgacccgcactacatccgctccggcatggtgaccaagaagagcgacgtgtacagcttcggcgtcctcctcctcgagctcctcaccggcatggaggccttctgcgccgccgagggccgcctcctcaccgccgtcctcgcgccgcgcctcaggcccgcctcctgcgccgcctgcgacgcccgcatgctggtcgacgagaggctgggcagcgcctacgacgccggcgaggcctccgccgtggcgtcgctggcggcgtcgtgcgtcggcgagaacccgagcctccggccatcgatggccgacgtggtgcgcgcgctggagcagggcgcgcacggctccatctcggccgtcgcgaggagatccgacggccacgggaagctgtgattcacacgaggcgtgtcgaatcctaggcgcttagatctggggggcttttggtgagctgtaacttgcgatgacgacgatgacgtcatctggcgtcacctgcacacgtggacccctcctactgggtggagcttagaacaaagcggggtagtgggcgagcacctcaaaaaaaaaagaatcaaaaaaaggagaaaaaaagtagtagtggtatgatttggaaaagatttggagcatcaaaaggtggggtttgtgtgtgctaatggaggaatttcgatcacattgtggtgcaaaaaaaaaatggcagcgatttgggagggtgaggtgattatgaaaatggatcgtccattttacgattccaaagagattttggtttttattctttcgtttgttcgtgtaaagttcaccgagtgcctcctgtttctgttcatattgttgatgattgatttagatttcgaccagagtttgaattccaagagactatgtatattctatgttcaacttgattctgtactgcttctactattgacagcagggctcatgaattagagtctagatctactaaacactgaatctggtaagtatagctcatgatcaagaataaatcagcattatgaacttaaaacacaactttattccgctgtaccgaagagtgctaataattgattggatcatggcgcccaagatttcaaagagcgtctctgaaagtctgaactgaacgcatatattcgcttcccttttctcactgacaactcagtcttcgctgccctctgaccagctatagtaggagcagtattctactccataatgctgaagtatctccaagtcaaacaaccgtattctacatttgtactcctctagtacgtactggttaccttcgggccaaaatcgaaagaacttgcaaacatttgataatctgctacctactctaatctgattatatttcccctgcattccatcagacttgcccaattcatttgacgatttccatgtattagcaaactaaaaaaatgtgcgactataaaaataaataaataaaatctaaaacgcaattttacagttgaatttggggacttctcattgaaatttatttcccagcagtgacttttaaactgagaacaatataaatatacaatatttacctataaataattttatgctaatttttccgtgtttctaccgcttattggttcaaacagcctgacttcatttcttaactactttaaaagcacagtcgttctactctttccctagaaaaacagctccagaaaagcccgtgaaaaaccagcataaacaaaaccgaatttcatttttatttccaaatccgatataaaagaaactaaattacaagtttttttatctcttgttcccgttgcaacacactggcacatactccctcaatttcataatataagtttttttttcttaggctgtgtttagttcacaccaaaattaaaagtttggttgaaattggaacgatgtgacggaaaagttgaaaatttgtgtgtgtaggaaagttttgatgtgatggaaaagttgaaagtttgaagaattattttggaactaaacacggctttagtcaaagtttttaggtttgatcaaatttataaagaaacacaataacatttccaacacaagacaaatatactatcaatcaaggttatatatagtgaaactaatttggcatcataaatatttctcttttttttctataagtttggttaaatgtaaagaagtttgattagaaagaaaattaaaacaacttatactatggacggagggagtaattagtttgaaataaaaacgagaaccagttacaccacggtgtatagaggtgtttgctgataataattccggtcaaattagcgaaatgattaggggatttgacctgaacccgatgtggacgcgcccgcgctctgccttgcccccaaaccaaccacgcgccgatgcctctgctctcctcacgccgagccgagcaaagcaaaacacacccacgtcgcggacgacgttgacgcgcccgcgcgccgctcccgtgacgccgccgctgccggtgccgcccggaggcggtcacgggggacgcgacgcgacggcgcccgcgcgcgcaccggcaccggtggcgcgtccccgtcggcgacggcacgcccaacaacctccctcggaaaaccggcctcccatctctttcgcccgcgacgcacacgcacccctcccccggttaattccgatttgaatcttacacgtactaattttattgttattattattttagtttttttttttatttacaaacttgttagaaacgccggtgtggtgtcatggtgtgatgaaatctgaattttctcggtgcgtttgcattggctgtacgtttagtttagtactcctatatgcatcctaaattttgatgtgttattggaagtcaactgtgaatgtcactctactaacaatatgttcaatcttcggatactttctatgtttcataattaaatatttttaaattaagaattaatagtaagtactaagtattactaagttacagtacttaaaattaattttttttaagtattttaaaatcaacaagtaccaagttaacttgtcatgcatccttaatttagttttttatttaatatttctaaaactagaaattaacacgtaccgatttgtacatgtcaagaacttgctgtttccttttctaatacatagataagccgttataatttgctcctgagcagatagatggccaatttttttttcattgttttttttttccacagaccactggcttgaagtgactaattaagcatagataaatagatagacccaccagaagttcagagaaccaactgaacacatggcaaagcctgaagattcagttattaatcgtatacggatacagagcagttgttgcaacagggagaaattaggtcggagtgacaaaatgggaagaaaaaaaacagagaggaagagcctagtgagcgtcttcctcctcgcagtgcttggtgtacttggccgggtccagcagggcgtccagctccgacgggctgctcggcttcaccttgatcatccacccgtcctcgtacgggcttgagttaatctgtcaccaccattggcagtagcattagggtttgaaaattgtctcgcaaaaaagaatttgtaattctagtttgtggagagtactaatgaattaaattaacaaagagacattccggttaattaaactaacacctttaaacagggacatgctaccagtcttgaaaaaaaaaagagacacatgtaattttacagcgttattgttaatatgccctatgttaaaaaaagtaacttctgagaatgaatatgcacaaatgtatgtttagatttattttcaaaagttgattttttttaacggaggttatactctctttgagacggtgggagtacataccaggccgggtgtctcagagagcttgtcgttaacctcgacgacctcaccggagatgggggagttgatgtcgctggtggccttcacactctccacgttgccgaatgcacctccctggctcaccttcgcccccgcctccggcagctccacgaacaccacctctcccagatggccctgcgagtatacatacatatctagtcatggctatgtatatccctcatgaatacagagaccggattaataaaaattcattatctaaaaaaatatatatctagtcaggtccaatcaaattattttttaccccccatcttactgttacttttgttttcaaataattgccatcattactgtgtagcactaaaaagtaactggctagcattctgcagtggaagttagttcctttatcttgtatgttattaaagtaacaaaagacatgttgtatttagtttgaaaaaaaaagttacagcaaaggtacttcatcatatttcttaaaagtagtaaaggaaaatgttctgtgacatatcaggaaaagggttgttagttgttgcagcagagggcagaatatttgattttgtagcatgccacgtagtttagaatacaacagcaaattgacacttaggccctgtttagaaatgcattaagctttaactaatcttgttgcacatgaaaggcatggaatattttctcctttggttggctcacctgagcatggtctgtaattccaattgtggccacagagccatcattcttgacccactcatgagaggagctgtacttcaacccatcaagaactgcaataccagcatgaaatcatcaccatggcttaaatcaacagggaccatagttacaacaagtatactcaactcttttcaacaactggaatttctaaattttattcccttcccttttcaatcatttagtatgtctccggtgtataactacagcatggaccagtcaatgtaacaatatagaatgtaaaaaagaaagaaaagaaaaaaggaagccacagcaatttataactgggtgcaaggatagcatggcacaatgcaagactgtacaggaaccagaacattgtaacaaccacatgctttgttgcaaaaggcaacagaaaatttatttgatatgaattctactactcaagctagctataccagtggagaagtatctggagattgagtaggcaggtgcagccctggtggctccactgcatgagatcttgagggcattggcagctgagctagcccacagcctcagagccatttctgtgccaatttcttgcttgttaccaaagtatctgtgttcttcttttttccttctcctagttagctggatgagtagtggcagctcagtggtggtggtagtatagtggaaagctgcagtgagatgaggggatagggaattgtttggctcaggaggagagggggaaaatgagagggggttgtgcagggataggatttgtatggttggtgggtgctcatagcctcatcctttgtttagaccattaattcccctctgcttgatccagtgtacatccatgggttaggacagattagttactcagttaattaagtgtgagactggaaaaaaatatctgacggcagttttataagttgagtgattgaactagtgaaagttcagttaactgtcaacggctgtagatttgggatggcagactgttctgagtcaaaatgaagcttttactgtgcgtggttaccaggtgcagtaaaataatttcagatctaatcgcagtaaaaaaaatgtagtactatatgttaagacgagattggtcggtcaaaatctatctggccctttacatctcccaaatgttacctcagttgcaggtggtaaaaaaaaatcactcgtttcacgtgatgtcggcagatcatggaccatgtctcaaatgctgaaactctgaacaatcaacaaaaaaatccaaccagatgagctgtgcaactgataattgatcatcacactatttgcaactcatctttcatgtagatggaacttcaatcccgaagaaataatgacagcaaaatgctgcgatcctgaagaaaggatggcggcaaaatggcagcgataaaaaaaaatggttggttactgaagaattatttgtgcagcagttgagacagtagcaagataagagctagctaagctagctaggtagagttggatggaagagtagtagtatgagatagagcatggagcgcgacaactcaagtggatgctaaagtaaaaggcattctcttctcttgtttggaatcagaaaagaaaagaaaagacttgagctgcttggctggaatgtttggttggatcatgcgcgctctccttagcttagctcgccaagaaatcctctcttcatctctctcaataattcaaagccacgagctctctgctcatatccagtgcgacgattcccgttaatgcaaatgcattatatccagttcgaaatgttacaattcttgcgtttgcagcaagccagcaagtggtgtgaattgtttaatccctcgtgcatttcaacgaaattctctcacaaattcgcattgacttctttcttagcacaattagtaagcagtgacaaataaagaatttttgaacaggatgtctttccaaggaaggtgagattttttatgtggatagcaaggatcgcctttccttagcatgaagagaatgtgatcaactttacaccttgcttacgattatggccttaatttttgataccctaaacaggagcacatcacatgcatgtcgacctgagaccaccaattaactgattaagttggcattgcagatgcatccgtcagttacatgatcaggtgatcgatggatcaactgtaggtttcattgctaatagctgctgctacatctgattattggagccagaaaaagatgcctgtcctttgcaatgtaaagagtgagtgaaaaatctcttcttcatctgctcctgcagcaatgcataccttgagagaatcatatcttgctagcattcgaatgattcatataagtaattgttagtatatattagagatatgtacttgcaagtagcactgaacaataataaactttgcatgctgatatatatcaactgaactaagtacaggttgttcaagaaaaagctgcaagaaccaaacatcaagtagtccagattgtagtagctacttcttcacggggtgcaatgcaatgcaacaatgaatcagaaagtaggataccttttgcatgcacttgaggaggggcatttgttaatccaattattcaactactaactaaaaactatatgtaattatgtcacatccacctactaccagacgtcattcacagacattttttagatggaagcttaactatataagtttgtgtcatccaaagtacacaagcacatgctaaatgttagcatgaggttgacacaatgctaactgccattgcaacaacagagaaaaaacagactagttaacaacagctgctgcatgcatacctagtgaatgattcacattgatcaaccgatgatccatattaggagtatatatatatatatatttatcatcatggaatgaacagttcaggagagaataaagggttcctagctggtgagctaaaagggggaattgcatgaacaacccaactgcattgctgctgtgatcatcaaccaacctataattattcatcctaacatgcagaaacatcaattctgcgttgatccataatggagtttaattagaggaagcatggcacatgccaaacacttgtcattggggcaatgctgtggtcatatccagcagcatgagggacatcctcgacatacttggtcacttccatcgataggtcaacccatcaaacggtactttcaaatatatttatatcaagaatgttattatcagcattgccaattactctagcaatctcccacatgcaaatgcacagtgttactttggaacagtcattctcagagattgcgtatgtggcttggtttaatcatcgttgttaaccggtaatcgagtgatctatcagcaatgcaagcagccaagctggcagtaggtggtagtagtagtagtagatacatgttgattgatcgagaggccaataagaccttgcatttcgcagagcataattggtacctagttgcagggttaacgtgctactgctctgttagttgcaatgcactcaaagcgattaaccattctatatattaattaatttctccaagaacaacaagatcgaagagatagtgccatttgccattggtctaccatggaggaggataagattgtgcattagctcacatgctctggacctcaccttatccatggcgaatccatcattgccgccatgatcgagagagatgagaggccgggagatggtgttgttggacatgtgtgatgtgatgatctctgcacccctgtctgtcctgtcgagtgtcgatcaccactgaaagctggagtaggctgcatgcatggatggatggtccccatttcgttgcaacttttcaagaacattcgacagcaatcactatacttgtactgccagtggtagtacattaaccacgtcgatcgactgctaattaagcattgttcctgcctgccattgtctcgacgactgttcagagccgtcctactctaccagctgtttagctaagctgattgtagtttttggcttcgttcgagtccagcgttcaaaatttcggtcctatcggtccctttatatgatattatattggccgaaatttttattttaaaacgtttcatgaattttaacaatatttattcaaatttgactaaatttttgaaaatattgctatctcgacacccttaatacaaataccgaaaacgaatgattaagccctagtcgagtctgccactcgtcaattagctcgagctcgattgactcgaagctttaggtggtgt

SEQ ID NO: 11558 - DNA, 15049 bp, Oryza sativa
  unsure (1)..(15049): unsure at all n locations
acaccaccttagcaacctgcattattgtgaaaatgtcgccgtcgatcgacggccggccggccggcgacaagcagcgccatgtgagatgatggctgatgtaggagaacaccctcgtgacaataaaaccacagaagtctggctccatgcatgttaatttgctactgctgcagtagtggtttcatgaatgcgacttggatggatggatggatagatccataccctgttctgagcagagaccggacgtgccaagtcataacatgtttgaacaacgtatattctttgactccacaggtccactagtacagtgttgtaccgtatcatttcatctgcagggatattgctgtagaaccttttttctttaaccaaaatacaatgttaacatatttaattacatctgcaatcgtacataatttaggccctatttgagattgctttaagtgaagatgaagtgtacgcacgtaaaaaaaactttagcatgttattaattaagttttaattaatttaaacttaaaaatgaatttatatgatattttaaatcaatctatgtatataaatttttcgcatgaaatatagtgtttgacagtttaaaaaacgtgctaacaaagaccgatgtaaaatctgtatcttaattgaaacagtaccttaaacgccaatcaattcgcaaatgcgtcggtgagccaagcttgattcggcagaaccgcaaaaacagatgaaattcgagcaaaagctatactactagtacgaatcttggcaaaaatgcagtatgaatcgtccttctccagttcctccagtccgtgtcatcgtgctcctggagtccttgctagctactgtagtagtatagctgtcatggcaggtggggccctccacccagcacgccgcaaggttggaccgccagcctggcgccccatcccaccatccctccccgatccgatcgccgatctcagccgcccgcaccaaattcaaatcccccgcgccccgccacgtcaccccccccccacacgccacgtcggacagaatccggtacacgcgggcccgtcacgtgactgctcgccgccgccgccgccaacgacgcaagcaacgcgaccggtgggtggcgcgagtcgctggtgataataccacgggatgggggagaacgcgtcgcgagtgtgtacaagaaatcccagcacgaattgtcttttgtacgcatctaacaactaccagtactactactacctgtatgtatatatacacatcaatacgcataatgcacagtgcattagtgcacgatcgatgattgattgcattgtgggggaggtatgaataagtgtaccggtagtaggccgtatagcacgacgcagagcaacatacggcaacaccaggagtacgtacgatgccgtgggttattacgtactcccccgtcccaaaaagaaaacaacctgtgacgaatctagacaactcttatccagattcgttgtattaagaggggataaatttagattggtttttttatggagagagtagaaaacgaaaagaaattagtatcactacagagccaacggcctagatatatgctctctacattccaaattgatctgcatataattttttttatgttattcctaaattatctacatatttgtgttcatttattaagtctattcgttatttgtgcattggagtaaatggacattgatgcatgcatccatgcacacaagtatttataacccacatgcaatatcttgatttgctattggctaagaaatagtagggatggtgtatacattgagtttgttgctagagtaaatatagtatgagagagttactccgtattagtttttcttggtctcgatgtacctataaaatatatagatcaatttgaaatgtagggagtactgtctccgtccattttgggatgggggaagtatctagctcgccgtcgttctttcgttcgttcgtctcgatggccgtcgggccctcccccgcgtgccaatgatgccacgccatgtgatcgttcgccgcgctcgcgcgcacgcctttacacggtttacaccagcaaagccagcagccacgcacgctggcgcgagccgctcgtccacggcgtcgcgcgacgcagaccgggcgcgggctagcgaagacatcagacatggcacatgcatcccgtggatagctagctaagataggggggctgttgctgctggcatggatcgcaaaaggttgggcgcctttgcgagtttgcttcgctttggtctcacctttgatctgcctttggagcagcctactactagtacgctttatacccagttgtagtactcctccgatcgatctgattcgatgctcctgagagtgcttttctttgctggtttatgatgactgatgagaggggaggggttgatgtgtgtcgaggtgccatttcaccagcaggttaatctcggagcaaacgagcccatgagcgatgcaaatccttattaatcctacattacctctatgtactaccagtactcagtactgatgatcacacgctgcactgttttattttactcctgcgcagacgtcggcacatgttttataacagtttttccttaaccaaaaggctcgcaactggcgtagcttttcagaatttttttagaaaaacgatccataccatacgagcactggtacgccagcagctagctactcctagctctgacatgttctgcaggctttctgagccatacgcgagatgacgcaaggcaagggcatgtgtcgtcaggacaaggacgcccccctctccaataatctatcgctgcacccagctgcaatcattggccgcccggcgcagggtatcgatgcagacatgtacagtggagtatcatcatggccctgcacctgcaccactactactcctactgccagtctaccactgaccgactactgtacaactctcctcggaaagacaagcctcacaactcacaagtcacaagcttgtttttttttttgagacaaaggcggcatgccattcattgattaagcaacatcatcacaaagtatgtcccggatataatccggtattacagaacggtacacagtacaggtagacagctcggcattccgagctagagaatgagccgccaaattggacaaccggttaacatgcataaaagagcataaaacaaaggtggacgccaacttcttgatatcttcaatcacgcatcccacccctgagcgatcccttcctgaagtttggatgcgtctgattacagtgagacaatcagatgccatgacaatgtgttgcaggccctcttcctttgctagacccagtgcccgcctaattgccagcgcttctgcaagctcaggtagcaccacatcgctgatcatctccgagcaagcaaccaggcatttccctgtattatcacgaatcaaagccccgacccccatggtcctggacgagctgaaaatcgcagcatcagaattgatcatccatacgctggccggcggtggctgccatctaggtatggcttgagtgtttccaccccgctggccatccaccgtcttcgtattgtgctttagaatcatgtcgacataagacaaaattttgatgacaacacgttgggggtgcactgtgccattgttgttctttgtattgttccttgcttcccagatgtgccaaaaggtgacagccaaaagggtgtttgcatggctggatccccgtttcaggaaatcaaagatccattgcctcatggttgagaacccatttcttcctagtttgacagcgcacttacccttgatttcctcccagatttgagcagcaaaggggcagaacaggaagacatgttccactgtgtcatctctgttgcaaaaaacacagccatcagtagaggggatatgccgtcgtcgaagttgaaacccagtcgctaagcattcatgagcagcacgccagagagtaattttcatctttcccggcgcattgattttccacaagcccttccaatccttttggctttcaagcagtctcgacgccattcctcgcccactgttgctctgatcagcaaagaaagcttctgatcgcgccagattgtaagccgaacgcacagagtataaacccagtttgtcatgtggccaagaagcgaagtcagcatcaccatgtctactaataggaatctgtagaatctccttagcaatgtccacagggaagagggatcttatcaaatctccatcccaacatctggcatcctcgttcatcaggcagctaacagtggcatctgttgggaagggagaaagcgttgtcaccaattgaggtcgaaacccaggtatccaattatctgaaaagattttgatggttttcccatcaccgactccccacctcactccttttgccagcagttctctcccaaacagcaagcttcgccaagtgaaagacggcgatttcggttgagcagcctcccagaaggacgagttagggaagtatcttcccttcaaaaccctcgagcacaaggaatcaggatcagtaagcagcctccagcactgtcttcctaacattgcttggttgaaagtagtgaactccctaaagcccattcccccaagaaatttaggagtagaaagccagctccaagatttccagtgcatttttttcttaccatcctcaaagccccaccaatgatcggcaatacaagtcttcatcttttcacagattgagacagggatgcggaaacaactcataacataatttggaattgcttgggccactgctttcagcattgtctccataccggcccttgacagcggccggtcagtccatccattaacccttttccaaattctttctggcagaaacttgaagaaatttgtggtagcaagcccaatttcagtaggcatcccaaggtaagagtcttgcaagacttcattatcgacttgtaagcagcttttcaccgatatcttgaccgcatcaggacatcgtttgccaaaaaagattgaagatttgtgcaggttaattttctgtcccgacgcactgcaatatgatcgcagcgtgtttttgagtgcttggacattcctgctgtcagccttagcaaagaaaatgctatcatccgcaaacaacaagtgggagatagggggtccatgcctgccatttttaattccttgtagctcacccgctacctccttcttgtgtagcaaacatgacagtccttctgtgcacaaaaggaacaggtaggggctgattgggtccccctgtcgaatgccccttgaagggaccaccggcttagtcagctctccattaattttgacggcgtatctcactgaggagacacaacgcatcacagtgttgatccaatcctgggaaaaaccaagtttcgataagcaacccgaaagataagcccactcaactctatcatatgccttcatcatatcaatcttgagtgcaaaaaaaggatttttgttgtgttgtttacggatggtatgcaaacattcatatgccactagggcactgtcagtgatgaggcgacccggcacgaaggcactttggaactcagacacaatatctgggagaaaaggcttcagccggttcgcaagaacttttgaagcaatcttgtacaggacattgcataaactgattgggcgaaattttgagaggtgactcgcattgtttaccttgggaatgaggacaacaaccgagtcacaaagaccttccgggatctcctctcctaacaagaaacctctcaccgcattacagatgtgttcctctaggataccccaatgtgtttggtagaacaaagctgggaatccatccggccccggagcctttgttgatcccatttggaacagtgctgtcttgatctcctcattagtgtactgtttgcccaattccccattgataaagtcgcctactttatttgggatagcatccaagacttcctccattgaatcacagggctccgaggaaaacagattctcatagaaaacttcagccatgcgcttgatcccttcttgggaaatacatctagagccatcatcacgaaccagctccttgattctattagtccgccttctcgccgatgccctggcatggaagaaagcagtgttgcggtccccttcacggagccaatccactcgggacctctgacgcgccataatctcctctttctcgaaaagttcacagagttgttgctcaattaacttctcttcctgaatcaccacgtcattaactggtgactgtcgcagggatttcagcttcctctccatcttgaggattttcctgcgcacagacccaaaggaagccttactccagtccttcaaagacactgcgacttgttgcaagacactccaaactcccctcagccccacgcatccagcagaagagatcctccaagaattttctaccacctccctgtaatcctccgcccgcaaccaagccgcctcaaacctgaatccctgctgaatgggaattctcctttgaccgtggttccttctcgacaagtcaatagagatggcgtagtggtctgaggatgttgttatcacattttccaccaggcagtcctcaaagtatctcgagaactcgccatttgcgacagcacgatcaagccggaccttgctattactgttagcatcctgcttattggaccatgtaaatttgggaccaacaaatcctaggtcaataagaccacaatcatccaagcaacttctgaagtgttgcatatgtggctctgatctctctcgcatccccaagtgctcatcgaggcataaaacctcgttgaagtcgccacaacacagccacggccccctccactgatcatgcaaccggcgaaggaggttccagaaaaaatgtcgaagctcacgtttgggttcaccgtacacaaaggaaattcgccaaggaggcaactcctccgtagagaccagcacatcaatgaaatgggagttgaaccccctaagagaaaccgtgtaggctgtagtccaaaacagggctaagcctccactaaggccctcgcagctcacagcaaaggagccggagaaaccaagtgaccacatcaaatttcttgcctgtttgtccctcatcttcgtttcagacaagaagacaagggagggtctcaaagacttcactaaccagcgaagttcacccactgtcgcagccgaccccaagccacgacagttccgaccccaagtcacaagcttgtttggttccatgggcagggacttatatttttttagagagggtccctctctcccaaacatctctttaggtcttagcaccgtatacaatacgactagggtcttgtttggtttcatgggctaatgtaagaatttaaacatgtgggctaattttgatctaaaatgaattagcccccctcaaaacattagcccctccaagagatgctaatggagctaattttgtgtgaggactataaaaaccagctctctctctccttctctcccctctctttctactctctctctctccaccttttagccttgaattaactcatggatccaaacatgccaccctagactaatatttagcctaccaatttatgactaaacattggctcttaaaattagccctgggctaatctttccaacaggcatagtacaatactcgtacgtatcatatgcactatcgtgcgtacgagtactcttggcgtgtcacggtcaacatagatctcactgttggcgttattgtgacaatgcacaacttttttgacgtaggggcactgtactactagtagaaatactagcgttgcccaagagattgttcacgtgccacacacatgcggcgcacccgtcgatcgaatcgaggggagtgcacggcttttgagttgtgaccacgcgtttggtcgggcctgggctgaaatcgtgaaagtttgtcgggccggatcgcgggatcgaggcggatggaggcgcgcgcggccttcgaaacgggacgaattctcgccgaccgcgtttgggccgcctgcccggatttgcagaccgttttgctcgtctgggctttcactatgttttgggccgcaaatttctggcctaatgttttcctcgtccagactccagcgacgaacgaacagtggagttgcgaacttgcgatcaagctacagcagcagcttgtctgattttattcgataaccaaaacaaaggggtttatgcatgagtagtacatacgaacgtagcggaattcacgatgccagcatcaccatggctaagaagcaaaaaaaaaaaaagtatgagcgcttcgactgttcgacacgattaagatagtgtccagcgacgtacgtgcatgcatccgtacgtaacggcatatacgtagcattattattctaggtcgtcctcctgggcacgaggcgcgcgcggagcggcttggccatgacggtggtgaactcccgcttctcggcgaactccacctcgtcgccggccacctccttccactcgaactccctcaccatgttggccacgaagtactccaggtggtgcatggcgaagctgagccccgcgcagatcctccgcccgacgccgaacggcatcatgcggatccccttgctgcccgtcacgtccaccccctcgccgtcgccgccggggaggaaccgctccgggatgaactccattggcttcgcccactcccgctcgtccctcccgatctcggccaccatgaagttcaccgtcgcgcccttggggatgaggtagccgccgacctccacgtcctccgccgccctgtgcggcagcacgaagtgccccggcgggtgcttccggaggccctccagcaccaccgccctcaggtacggcatgccgtggacgtcctcctcggtgacctccggctggtcgtcgccggtcttggacttgatctcgtcgtggagctttgactggatggatgggttcttgaccagctcggccatgatccactgcagcgcggtggacgtcgtgtccgtgccggcgttgaggaactcggagcagagcttgatgatctcgtcgtcggtgagcgcgcggttgccgtcctcggggagcttgatgtcgagcagcgtgtcgacgtacgagtgctccaacgtggtctctttgttcgtcgtcttcgtcgtctcgccgccgtgtttcttgtactcccggcgcgcgttgatcagtggcatgaagagctccctctgccggcggcggagggcgtagatcttctcgaggcggccgcggaagaggtgcttggtgatcgccgggaagtaggcgaagacggccatctggctcgtgatgtagatgagcaggtcgcgctgggcgtcctcgacggcgcgcaccgtggcctcgtcgaggcgctcgccgaagcacatattcacgaggaggcagaacatggcgtactggagcgtgtccacgacgtcgtggggtgcctggccggacgccgccagcttgtcgacgatgacgcggtgcacccagtagcgcgccggcgcgaacaggcgggcgcgcgacgggtgcagcgtctcggagacgaggttgcggcggaggaggcgccacacgggcccgtacccggcgcgcgtgatgatgttgtcgttctcgccgaggagcctgctcgccggcacgccggggcggtcggccagcgcggcgccgccctcgacgagcgccgcgtgcgcgaggcggcggtcggcgacgaagacggacactcgcgtccccatgcgcagcgacacgatggggccgtaccgagcgatcagcctctggaggagcagctccggctcgacgtcggtcagcgccttggtcagcagcacgacgctgccgagcaacggcaccgccggcgggccgggcgggaggcggcggccgcgcttgccgccattgccgcggaacagaatgaacgggacgacggcggcggcgaggattgcaccgaggatcaagtacaagttgtccatggtgaaccggagcttagctagctagtagctcaccacgtacgaacactacgagctactgagtgtgtgtttgtttgtcatggctagctctcactctcggcgccaatttatagagatctctggccgatcgatcggagacgaagagaacggacggacggttagaaattattttctacacttacctgccatactgctatgtatgacacctactttagacagttatataaaaaaatcataaaatttgataatatagactataataatataagacgctatacaaatatgcaagtctaaattcgatctacacatgaagaaacaataataataaattttatctgcattgtacgggtactatttattatttgatttttataatttttttatattatagataaaagagtaaagtgcattggcggtccttaaacttgtagggttgtgtcgtataggtcactaaactctcaaaatatatatacaggtcccagaacttgtcaaagtgtatcatctaggtcccaaattgacacatcacctctagtatcctacgtggcgatgatgtggcatgccacatggatgtgacgtgccatttttttttcttcttcgttttcttctcattcttcttttttttccctttcttctgctcgggtcacagagaaaggagtagaaagggaaaaaaagataagaaaaaaagaaaaaggaaaaatcttaaacgagacccatttgttagtcaaaatgatgacacgtcatttcgtgtggcatgccacatcaacgtcacgtaggatcctaaaggggttgtgacacactatgacaagttctgagacttggatatgcattttgagagtttatgaatctagatgacacaccactacaaatttaaggaccatccgtacactttactctatataaaatatagtcttgcacgtttgtgtatagacttatatcattataattgatgttactatactttttattttttatataattattgagtcacatggtgctatgctatgacactaggtgtggaaaagtagaaaatccttgtcccggttggttgatcttgcatacgtcggcgtaatgatgtcatgggtttttgaacgatggaacaatggtcaaggccgggaagcttccatctgggaacagtccattttgttctacgggtgcaactgtagtgtgccatcccaaaaaaagaccctaatttccgtgcccaacgtttgaccgtctgtcttatttgaaaaaaatatgaaaaaaattaaaaaagacaagtcacgtataaaatattaatcatgttttatcatctaacaacaatgaaaatacgaattataaaaaaaattcatataagatggacaatcaaaattggacacggaaacatagggtttgcctttttttttggggacggatggagtacaagtactacaacacgtgacatgcatgcgatgcagactcctgaacggtagtacagtccattttgttctacgtacgggagtagtaagtatttcatataaaacattattgcctggccaactgcttggctccacctggaggtgtgtgtcacacccaggtgttgtggtacattgtgattttttttgacgaatcaatcgagattgtcttgggcgcttggctggcttcggcagtatgtcgttgatttgcgttcgtggggttgaccggcgtttggtggggggagacggactgacggaatttagtttacctcggtcgtatcgatgtgtagctgtgctcctggagcctgatggaaatccaaagagatcctttgaagataggaatttcatgttctctccgtctacgaatataaaaatttctaaagtttagcatttctctgcagatataagtatttttaaagcatcgaaacattttaaaaattttgcgaaacacaatgaaaatacacactgaaacatgtcgttatcgcatatgaggcatcaagtgttaacggattgaaacgtatgtttttcatcagaatatagtcatgtaatgtcttgttgtaatatttaattgcaacaaatacaatggtgtgatcggatcgtagatcggataagtagtttagaagaaaaatcattttgaagatagttaaatgcatgcatgaatgaagtggagagagaggagatagagtttatgtgaattttgtgaaacatacagaagacacatcttgaaacatatcgttatcaggtatgagaatataatcacgtgatatcttgctataaagatttaattacaatcaatacaatggtaccgtatcgtagatcggataagtagtttggaaaaaaaatatttaaagttaggagaaataaaagagaaacaaactagcttgatacaatcttgcatgttggggagtgtcaggaagcctgatttttcttctctaaatcgtactgtactaccgaggctaaatattctcctcaaaattcccttgccaaaccaaatgatgcacatatttctacgatgtactctctccatttcaagatagggatacccaggctccgtttagttcttaaaatctttttttcaaatacatcatatcgaatcttttgatacatatatagagtattaaatatagataaaaacaaaaactaattgcacagttagggaggaaatcgtgagacgaatcttttgagcctaattggtccatgattagccataagtgctacagtaacccacatgtgctaatgacggcttaattaggctcaaaagattcgtctcgtggtttccaggcgagttatgaaattatttttttcattagtgtccgaaaacccattccgacatccggtcaaacgtataacgtgacacccaaaaattttctttccacgcactaaacatggcctcatttgggtaggtgaacgaaagaatttttcctagaaaaaactagtactattttcccacattgtagagaggatggacaagacacgtgcactggctgcacaaacgggtagaggtaacaagatatcaaaattttttcacaacactatctagacttcatatatttttaattttggaaaaagtacgaattacctctcgaactattgtggtagtacgatttacccccttaaactacaatactggacatttgacaccccaaacaattaaaactggataaattacccccctaactcgattcgtagtggttttcagtctacatggcacacacatggcgatacagtcagcaaaaatacaaataaaaataggtaggcccacctgtcagcgattttttttctctccttctcccccctctctctctctctctcccccccctctctctctctctcggccaacagaggctgcggctggcgggcggcgggcgggtgaggagccggcgccgacgggaggccaccgccggggatggctgcgggtggcgggcggtcgaggagccaacgccgactggcggtcggcggcggggatggctgtgggcggcgggcgggcgaggagcggagtgtgtgcgcgaacgggcgctgccgcagctcccccgtcggcgactctgtgactgcgaaggcgaacgcgttgctggcaactgcaacggcgaaggcgaaggcggcgacaagatcgaaccgcgagctccggaaggccagcgacggtggcacgagtgcgtgcagggcagcgatttcgcggtggccgaagaagggaggtgcacgagtgctcgtggggaaggcgtgnaggcgctccaggcgaccggcggccagcggcggaggcgcccgggcggctggtgacggaggcgaaggcggacctggcggccggtggcggaggagaaggtggacctggcgggcggcggcggaggcgcccaggcagccggttgcggaggcggagctcgctcgggcggccggttgcggaggcggaggcggagcgtgcgtccgatgacggaagaggagggggagcgagcggccgatgaggcaacgactgagacgttcgcacggctgcctcctcgtccattcttcctcaccgccacgacggctactgctcccagtagcagagagcgctccgcgcgaaggtggtggccctccccgccacggccttccccgcccagaccaccaccgtcactgcattgcaggaaagtagaggggaaagggagaaacggcggtggcggccttccgcgttgccgttcgccggcggaggcgcagctccatctctcccggcaacaccgtcgcagtgccctccggccgccgcccgccctcccagccacgcccgccgcgtctccagtgttagagagagaaaagagagagatgggttgaataggagtactatatgacaagtgggcccatagttttttattactttttttctgattatattgccacgttggcgccacgtgtctgccacataggagcaaaacccctccggattaagtcaaaggggtaatttgtccagtttctatagtttgaggtgacaaatgcacggttttatagttaagggggataattcataccgtcacaattgtttaggggtgtaatttgtattttttcctttattttttggtaacaagatatcaaaatttaacctgctatagattcagcactggaattttctacggtaaaaagttaagcacattatcacccctacgctgctacacacacggtgcaaagtttgcatggctgaatcgtcgttatgggaaaacaattctaaattctcgaggagatgtactatcattatttacatgtcacttaaatagttataaatttttttaaaaaagtttaacaagatagattaatatgggatagatcatctcacaaacatacaatataaaatttaagttctacatgttgtaaaaaaaataaatttgaatgtgaatatacattaagtaatggtagtttaattaatttttttgcaacttgtagaagttaagttttaacttgcatgtttgtagagtgatatatcacatgttagtaatttttattattattttttaattttgttcatgtttgaaacaaacatcaaaccatagccaagacaaatagaaataagtttaaaatccactctctcttgttatggacttgaggattgggctgtttctcacgactctgtagtttgtccaacccaaaccaaagccaagacaaatataaataagttcattttaggtccttcaatttgtcgttgagtctgaaattcatccctgaaccgaaatacatgtatagttcattcctcaacttacagtatcgtgttaatttaactttgatccttcgatagtatagttaccggttttgacttacatggtgagtggaacccacgtgaactctacatgtgagcggttaattcctctccct

SEQ ID NO: 11559 - DNA, 2747 bp, Oryza sativa
ggagtttatattaccaaataataggggaatttacaaaattgtggctaactaatacaacagaagctataaaatgactcaatcctaatgttttaaaattgtggttttactatagacttaaaccatctaacaaatctagacttgaaaactaggttaaaatattgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagttgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagctattatatttaagtatgaatgtatgaaataatagtatttgagtagagctagatctatttgcagaaagctgagaaattagaaggagaaagtctataatgtgttgaaatgcaacagtatttaataaatctggagttatatttctaaccaagatgccatagtgagtcccgatgctcaatatccgtgagcacggctattcgaatagtttcagagatactcatactgcagtagatgtacgctttacccgcaatccatgacatgctaatattcatcagcttagtcatggcaaagcttttcggttactaacatcagtggcacctgttccatgaactctcatcctcatgcgctctgaacgtaacgttatcagcagcgagaggagttctggcgttcccgaggtctttagagagaactggttgagagacccccgtcgtcccaaccaggttttcacaatacacacacagcgcgcaataatcaatatatttacccgcgcctcggtaaatattataatcgccctgctcggcgtaaatttgcctcctgcgcgaggacttaaagaagaaccactatacagaggtaccacctttgttagataacctactttgctaagtctgtccccattctagaattgcggtcgtactcgttcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatctggtttgctatatgttcaagttatgcatttaaaatcatgaatggctaatgcatggaataatagagatatagaatataggataataatgctcaaaggggtggaataataacttgccttgctccaacgcaaacaaatccgagataggcaacctgattatccgatcctcgaaacatcacaggttgccatccaaaagataatagactactaagaaatacgaagaactaaattcaataaaagccataaaataacaagaaaacgataaatggttaggacggctagggtttggttgtgtggtagtcgatgctagagcataacgactaggtttggtatcttctctagccggtgtcaacagacagcataacggttagagggataggaggtttgtgtgggtttagtggggcggaagtgttactccgacaaccgtgagtggtggcggagcggctaggatcacacagagcccgagagctaactgtgcggcgtgctgtggaggtcgagggaatagtgaagctccgaccgctgtacgcatcaaggcgtggggtgccaggagcaacacttcgaccttgggtttgggctttgccgggctttataaccaacggttcgacgtcgaggatagaaaaccacgaatgtccccatggaaggcataaagttccaaccgacggctttttagtggctaaaggggtaatttgggacaaaagaaaatatttgaaaaggcaaatataaattcaaacgatatttgaatagattcaaataaaattataaaatagcaaatttggtgtcaaaagatagggtttgaatttagataaatttaggtccaagttttattggaatcggatctacggtttaggagatatgggcttctaaagattgggttttgaattaaatctagaaaatgagaaaagtcactgtgcaggggacccacctgtcaggcttttctttttcttcttctttttctttctctccttcttcctctcgttttcctttcttcttcttccaggctcccagccgagtaacagaggagggagaggattgggcgccggtgctccggtagccggggatcggcaacgtcggtggcggattgcgttcccgaacaacgcgcatccggggaaggcagtttcaagcgaagggagttagagaggaagccggaacggcgagtggaagagcttgcctccggcggcaaaagaggtggctatggtggcttgatgaagtggttagggaagaggggaaataggtaaaatggattctccttgtcgaggcgaacccgatggtgcaagtatttggttggcaatgctccagtgagggagatcggccgatgactggtgagggcttgccatggcaggagagagagagaagcagagcttcaagctctgttgatgtgaggaaaaggagggtacctcgccggctatttataggcggcgaaggtcggttgcttatggcggttttggaggagtaggtgaaggcaaacaccatgatgc

SEQ ID NO: 11560 - DNA, 3500 bp, Oryza sativa
ccaaattgggcctgctcggcttagctgggccagcagccccaaagggaagaggaaaatagaatataaaagaattgggccaaaaggaagaaagaacggagtttcggcccgatgacaaaaaggaaaaagtctaatttgaatacttaatatgcaaaactaggttttgcaaagaatttgaattcagaaagaattcacaaaagagatttcctaatatatttgagtgcaatatttagaggtggagtttgagggaatttatttggaagcactcaaataggaagggtgagcgatatatgaataaaatttaatatgtaaataggaaggtgggaacaagatagttggagaaggataaatagggttttagcctcaaaacatatggcatgggtttcaaagaattgtttgaggctaataggaaatttgaatgacaaagatataatctattttcttagcacaagagcaattattcacaatattcgtaataatattattcttgtgccgaggaggaaatcaagccacaggaattaaattgacggctagattggaagaaggaatttggatacaaatttggaaaggggactaaggataggtttggaatcaaaggatagattgacaattaattccaataaatttggaattgcttcggttttggttcaaggatagtgttggaggatttcttggaccatgattcataaaaataaaaaggggttttcaaactaaatttgaataaaagaattttagtcaaaagaaggtttttaaattaaaacccaaaatcaagaaactccttaatttaactaaatatatttttaaaggaaagacacaaaagaaattaaataccagaaagagatttaatgcaggttaattttaggaggtctctttaattataatatcctaggtttaggaggttaataaaaacgtaagaaccggtatgatgcataattagaaaatagctaattttcagtatgttacagatacttgataagtatcatatgatactttgcaaggatcacctaaaacgtgtgtaaaatcatctgatacctgataggtatcacacctgatacctactcgggatcttcccgttagaaaatgggattccgttatatagcagccccccaaagaaaagatggatagtacgcagcgcagcgattcggaagtatgtgtacgacgaggagggcgattctcaatttcaccacatcgagaagagaaaggcggaggctggcggcggcggtggcgacgacgaccttggcagtggccgtccaaggcgatgacggcgacttggactacgccacgatggtcgcgcgcacggctcatttcctagcggtggtccgtggtcgagcgctacgcccggatggtgcacaagctagttctgggactaagttgacgagtatcatgtgtggaatgcgatcgtctcgacatggagcacccgtcggccgcggctgtcgacgatgacggtgacgaccggcctgcccccatcgccacatcgacgacgtgcggtggactgacgcggtggagcggacacggtcagagatcgaggaggcgagcgagcgcgagtgcgtcgcagtctacgagctgtggaggaaaaggtggtggcagtgtggagccgtaggtgggatttgggagaaaacaacacccaatagctgggaataccgcgttagacacttagaaaacgcggtagcaggcagccgtcgtagccgtcgaggaagacctagctcaacaaggcgtcggagacctcgtcgccgcttctgccagctacttgattccgctctagtcctggaggcgcgcgaagtcatcgcggaggcgtggctgcgtcccaacgacgggcaccgatgacacgccattcccggcgcgcgtgggagagggagaggagggagagggagaagatttagctagagacatgtggggcccaccgcccacatgggtcacactcatcgcgtcagtcgggctactatattgtcgaggaccaaagttaacacggtatggtgaatttgaggatgagttataccttttgtttcggtatagggaagaattttagactctacaacaacttaaaggacttaagtgattctttccagcaatctagcccaactggcaagctggcgggctggtcgccgtcgatgaaggcctgttcagttcccactattagggctttttcggattagaggatcttcacgtgattttcggaggaatactgtgcataggaattttttttcctttcttgtcattcagatcatgaaaactgtggttgtaggaaatccaaagaaaagtttcctttgatgctgatttcacatgaaaagtatatgaaaaatccgtccaccttaagctctttttttttattcctgcatgcaaatcccaggcaattaatttcatgttatccgaatgtcctcatttttttttattcctttgtttttcattcttatgtttcacacttagattcctttcctgtttctatactttcccaatcctatatttttcctatcctataatctgaatgaacccttaatcatgatttggaaattccgaaccctggttattttacatttcacaactaatcatgcatatctattcataatttcagaaaagattacagtaaaaagtaccaagtaataagctagtaactagttgatacccccgcgctttgcagcaaaatatgtggataaatgcatgttataccatttctataatgtataacatgcataaatccacatatctctagcaaagcacgaggtatcaactagtgggaacaatattttagctcaaataaatatggaaaaagtactacacccctgaactatcgaggtcgaccgaattacacccccgaactcaaaaaccagacattctacaccctcaactattgaaaccgggcaaattaccccccctagcactgttttaggtggttttgggatagacttgctgacgtggcagtccagtcagcattttatttttttaaaatggtgggacccacatgtcatacactctttctctcttcctccatctctctttctctctcttcgtcggccagcagcaggcagcgccgcgcacaccggcacgccatggtggagaggcgagcgccggcgaggggatgcgatgggcagcggcgcgcgggggcaggccggcggtcggcgcgaacggcggcgcgcggcgaggtggaggggatgggggagaggtgggcgccggcgtccatcgcggagaggcgggccgtcgtggcgccggccggcagcatcttgaggacaacagcgtgaggccgcggcggcggtggtccaggcggagcacgagcggggcgggcagagaggaaggaggtgaggaggccagggagcgggctgaggagggaggagaccggcgagggagcgggaggccgggagagtcgtcggagtcatcccccagccgccaccgtcgtcgtcgttcgagccgctcccgccagagtacgatgagcccagccatactcgttgctgcgacgaccacctctggcccgacgacgaccgccgtgccccgctacccttccccgacacctg

SEQ ID NO: 11561 - DNA, 7263 bp, Oryza sativa
acctcgatagtccaggggtgtaattcgtactttttccaacaaatattaaacgaagataatatcctaatgaataggacacatacagaaccaaaagatactatgccatatcgttcgtattctccattgatagctttgttatcaacatatcgtattgactgggcataaaaaatgatcatgttaaaaaaaattgctactatcagcatggagcaagatatacttagttgttgccacttaccagtatagcaggccaaacgggcggcccggcccagcacgacacggcacgccgacggcacagcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatacttaccagtgcatgcctcctgaagtgaaactattcctaccgcttcacctctgttttaaaataaaactattttttcatctatctttttatctcaatcaattataactattcttcgttcgtttcttcacctacttctacttttcagccaattatgttttttcttcattattttcacatatgttataactatcggtatccaacttcagaaatacttatttgaatctgttcgcacatttttttaagctcgatctactgatctacactcttgtataagtaagatttaccttccttaactctgttaccagacgttttatacttatgaactctttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgccatggacgcctggcagctgttcgtccccgcgatcgccatcctcatccccttgctccggctcatcctcttccgccgcggcgacgacgggagacgcggccgcctcccgccgggtcctccggccgtgccgttgctcgggagcacggtgtggctgaccaactcgttgtacgacgccgagcccgtcgtcaagcgcctgatgtcgcggcacggccccgtcgtctcccttcgcttcggctcccagctgctcgtcttcgtcgccgaccgccgcctcgcgcacgcggcgctcgtcgagagcggggcctccctggccgatcgccccagccaggccgcctcggccaggctcgtcggcgagggcgataccatgatctcgcgcgcgagctacgggcccgtgtggcgcctcctgcggcgcaacctcgtcgccgatacgctgcacccgtcgcgcgtgcgcctgttcgcgccggtgcgcgcgtgggtgcggcgcctgctcgtcgacaggctgcgggacgagcacggcgacgcggcggcgccacacgccgtcgtggagacgttccagtacgccatgttctgcctcctggtgctcatgtgcttcggcgaacagctcgacgaggacgcggtgcgcgcgatcgccgtcgcgcagcgggacgcgctcctctacctgtcgagcaagatgcccgtcttcgccttcttcccggcggtcaccaagcacctcttccgcgggcgcctccagaaggcgcacgccctccgccggcggcagacggagctgttcgtgccgctgatcaacgcgcggcgggagtacaagaaacggcagggcggcgccaacggcgagccgaagaaggagaccacgttcgagcactcgtacgtcgacaccctcctcgacatcaagctccccgacgacggcaaccgcccgctcaccgacgacgagatggtcaacctctgctccgagttcctcaaagccggcacggacagcacgtccgccgcgctgcaatggatcatggccgagctggtcaggaacccatccatccaatcaaagctctacgaggagatcaagtccaagaccggcggcggcggccagcacgaggtctccgaggaggacgtccacgacatgccgtacctgaaggcggtggtgctcgaaggcctccggaagcacccaccggcgcacatgctgctacctcacaaggcggcggaggacatggacgtcggcgggtacctcatccccaagggcaccatagtgaacttcatggtggctgagatgggcagggacgagaaagaatgggagaagccaatggagttcatgccggagcggttcctccccggcggcgacggcgagggggtggacgtgacgagcagcaaggggatccgcatgatgccgttcggcgtcgggcggcggatttgtcccgggctcggcatcgccatgcttcacctggagtacttcgtggccaacatggtgagggagttcgagtggaaggaggtggccggcgacgaggtggacttcgccgagaagcgggagttcaacaccgtcatggccaagccgctgcgcgtgcgcctcgtgccccggagtacactcgaataattaatccattcctcgattcctagagaaaataattgtgcagtatattatatagagtaaattccttgtttgctcctgaaaagttacccaatctcttacatgcccctaccgtttggaacttacttgattccttctataccccaaattttcgattgaatcctctacatacccctaccgtttgggttccgtcagatgtttgtgttcatgtgtgtgttagcttgtcagtattttcataaaatgcgaaaatgcctctgtcaaccctaggtaacacagggccacatccgatccccaaatcctccaaaatagtatagttcccacacgcacggtgccgcacatcgccagctttcagccatcgttgcacgcgcatcgccgcccttctcccacatcccggcggtggcagcggctctgcatcccgccgcggtctcggctctgcttgcggtcagcggtggcggctgggtccgcatcccatcggtggcgcggcggggtccgcatctggtgggcggcgacggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccactgctcctcgccgtcggtaatgatacgcccttgcgttgattagcaaaatgcgaatagctgctgctgctgctagtgtttcttgattgatttgtttgactttatgcaggcggatgccttgaactgttatgggcttgtgccattatgctcatgatgtaaaaagtaatatatttgtgtactgctgatggtgtatgaatgcttttagatgtattttcattttcttcctattaaatggtgctaccgatcctcttgatatgctgatgaattgcaatggtgtttgagtaaacggctaggggtactgtcttttacccccaggctgtgtcggttagtggtcatgaaagatccaatgtcatgttatatttttttataaaatactgaatgctataacaaaagaaaatgaaattaattttatgcactaattttttagtctcacggaatacatactgtgcagtcatgaatgtttcaaacccagctgccaaacatgttcttagttttcagctcctccaacctcaagggtattatagacattttcaaccaaactaaccagggaatgctgctcaatctaacggtaggggtatgtaggggatccaatcaaaaattcaagggtggaatcgagtaagtttcaggggcatgtaagggattgaataacttttcaggggcacacaaggaatttactctattatatacggtacatatacgaatgtaagggaacaaacggccaaaatcatcgcacgtagcactggcagcttcctttctttaatgaatattctgtgagaaattttacgattctcgagagataccaagagaatatcctatgtgtgtactccctccgtttcgaaatgtttgacgccgttgactttttatcacatgtttgaccattcgtcttattcaaaaaatttaaataattattaattattttcctatcatttgattcattgttacatatatttttatgtaggcatataaaaaaacatatgcacaaaattttttgaataagacgtacggtcaaatatatgctaaaaagtcagcggtgtcaaacatttcgaaacggagggagtacgttgtgagtttttcgctcagtcagattaccttgatgatcctggcatcgtctactctgcagcgttggtgtgtaaaataatgaatggtggaaactggaaagtaactcctctggcattgccggccatctgcacggcgcccccgtgtctcctgctacgcatacgatcggcccgtgcgagccttagccgtaactaattgggccgtttctcgcgaatcgcgggaagtttgcccagcccaagccttaggcgagacaatccagcccagcgtgaggtctcggcctgctgctttaattggaaaaagtatacctgagaccccttatcttgtcgacgatttatttataaaatcatccatgaaccaaaaaccatatatatgacatcagtcaacttataaaactaaatcactctaagtccataggcggttttgtttgacatgacaactgaatcagtgtggaacccacatgggcccacaggtcagtggctacttccccttctctctcccccagtcatccccttctttggcgatagttgatgggcagaagggctgacgcggcgggcgcgaccgatggccggcggggaagagcacagctggcgaagggtagggagaaccggggacagatcgatctgtgccgccgttgccctcatgtccgatcacaaccaaacggagattgctgtgcaggtgtcactaatggttgtgtttagggaggatgatgtggggaggacatggcgggcatggctcggctattccgaagggaggcgatgctggtacggtgctgtggctagcgttattagtagatgttgagaggtgaggggcaacggtgatatgacgagacgatgaaggtccacgaaggtcgccgggagaaatttttcccgagcttgggatgacgcgagtggtggaacatgtttcatgccgagccgccgggaaagaggaatgggagggtttcctatggggttgatgcgagctcatgctgaaggagacacaaagatatggacgacttgccttcttaccggggagatgatgagaggggcgagaggattcgagagagcgtgagatgggaggaggaagaagagcacagggaagaaaggggaaggtactgacaggagcaggacgtcgtcgcgcgtctccggttcttcccacccgtcgtcggccgtgctcctgcctcaccggccgccgaccatgcccctcatgcctgcccttctccacgtggcccgtgcccaagaaggagagtactagaggagagagagaagagaaagtagttactgacatatggttcccactttgacacagctgttgcgtcggacaaaactatttaaggatttagagtgactcggtttcgtgagttgaacgatgtcatatttctattttttttttcggggacgattttgtaactcggcgataagatgaagggtctcagatatacttttttcgcttaaattttcttcacatatacgactgtaaagtttgttgatccacggcattttctatgtttacacattacgccgtgtcctacaccatggtacggtactacggtgtgaactactgttgctttctccggtccgtctctcttgcctgccactggagtctacacaactagccatggagtagcattgatgccatgaaaggctagctgaaagcaacacgatgcacttgctaagatacgtcgtcttcctcacggttcggacgtctgatggtcgatctccgacccgcggacatcatgctcatgctttctgaactgcttgcgcatccgtatcaaacagcttcttttcatcacaacgaagatatgtctcatcatccgggttaagcaaccgatcgatcgccttacaacgtactacgtgcccaaacatgaatgagttagatatattgtttcatctcaattttcgcaagattcggtcaataggaacaccttaattacaccggctatttttacatttcaccactaatcatgcatctctattcagaatttcagagcatggaagtaaaaagtactgaactaagtagagaaactaattaattaagaagcatcatatccatatcactatatcgccactgatcattcagaacaaaggttattgtattgtactaggtagtgtttaattaagaactccactagagtagtaagaagcatgcatttggattgagctaagctactgaaacggtgaccctaacgcatacatacatggtgatctaggcccttctgggcacgagacgagcgcgcagcggcttcgccatgacggttgtgaactcgatcttctcggcgaagtccacctcgtcgccggcgacctccttccactcgaactcgctcaccatgttcgccacgaagtactcgacatgtagcatggcgacgccgagcccggcgcaaatcctccgcccaacgccgaacggcatcattcggatctccctgctgcctgtgacgtcgaccccctcgccgtcgccgccggcgaggaaccgctccggcatgaactccattggcttctccca

SEQ ID NO: 11562 - DNA, 1705 bp, Oryza sativa
gcacatgagcaccaggaggcagaagatggcgtactggaacgtcttcacgacggcgtgtggcgccgccgcgtctccgttctcgtcccgcagcttctcgacgagcacgcgccgcacccacgcgcgcgtccggcgcgaacagccgcacgcgcgacgggtgcagcgtctcggcgacgaggttgcgccgcaggaggcgccacacgggcccgtagctggcccgcgagatgaggttgtcgctctcgccgagcagcctcgtcgacgccatggcggggcgatcggccagggacgcccccttctcgacgagcgccgcgtgcgcgaggcggcggtcggcgacgaagacgagcagccgggacgcgacgcggagggagacgacggggccgtgccgcgcgatcaggcgccggaggaggggctcggcgtcggccagcgaattggtcagccacaccgtgctcccgagcaacggcacggccggaggacccggcgggaggcggccgcgcttcccgccgccgcggccgccgcggcgggagaggatgagccggaggaaggggatgaggacgaggattgcggcgacggcgacgtgccacgtgtccatcttcgagtgagcgcgagcaccgcgtaccgtgtggctacttcagtgggactcattttatatggttaacacgtgtcgtaattagcacgttattaggaggtttttaactgcttgtgtttaagtaaattcggttgtatttatcggtttattatgctttatgccaccgtcgcgatctcgattcgacttgcggacgaagtgaacggaagggtccacctccgctgacgtcagggatgatgatgaacaggaataaatacgaagaaaaaaaattctagaatattttcttatgcgacaccttgtttccacatgactcgtatgatccaaggtctaacgacatgttcaagaaaagagcagataaaagaaaaccaattctgaatacgatttctctctcgagaaaattgcatccaatccaacaagtcatagtttgttcagacttcaggactctaacacataataattttgaattaagatttgaaaattacatccgaacaacccgtagtttgttcagactcttaaactcataaaattatccaaactcaatcgtattcagcgttgacttgatgcgtctccctataaatgtaaagccgttttgtctcacccgacgtacaacaacgacaccaatcgacgacgacgcagatggataacctggtcatcctcgccggcgtcctcctcctcccgctcctcttcctgctccgcaatgcggcgtcgtcgaggcggcgccgcctcccgcccggcccgccggcggtgccgctgttcggcaacctgctctggctgcggcactcggccgccgacgtcgagcccctcctgctgacgctgttcaagaagtacggccccgtcgtgacgctccggatcgggtcgaggctgtccatcttcgtggcggatcggcacctggcgcacgcggcgctcatcgccgccggcgcgaagctggccgaccggccgcaggccgccaccagcacgctcctcggcgtcagcgacaacatcatcacccgcgccaactacggcgccatgtggcggctgctccgccgcaacctcgtgtcgcagacgctgcagcagtcgcgcgtcgaccagttcgcgccggcgcgcgtctgggtgcgccgcgtgctgatggagaagctgcggggctcc

SEQ ID NO: 11563 - DNA, 13334 bp, Oryza sativa
gcaggagaagctctacgccgagatcaacgccacctgcggcggcgacgacgagctcctggagcggaacgtgagggacaaggacaacaagatgccgtacctcaacgccgtggtcaaggaaggcctgcgcaagcacccgccgggccacttcgtgctgccgcacaaggcggcggaggacatggacgtcggcgggtacctcatccccaagggcgccacggtgaacttcatggtggccgagatcgggagggacgagagagaatgggagaacccaatgcagttcatgccggagaggttcttggacggcggccatggcgccggcgtcgacatgcacgggaccaagggcatcaagatgatgccgttcggcgtcgggcggaggatctgcgccgggctcaacatcgccatgctccacctcgagtacttcgtgggatccatggtgatggagttcgagtggaaggaggtggaggggcacgaggtggagttcgccgagaagcgggagttcaccaccgtcatggcgaagccgctgcgcccgcgcctcgtgcccaggaggagttagacagtgagacagagtccagaattggtttagttttgtgttcattagttagtgttagcgtatatttactcgtgattaagttatgatccaaatgtccatagtgactagaagtatataattaggtttgaattaagtgccaaaagtgtgttttgttttagcaaattttgagcagtgcgtactcgtttttatcgtgctaatttacacgttttatatatgaactcctatcgaatcccaatcaaaataagcagagaggtttggactagagacaagacagcatgacttacgcacaagaaaggaagggtgaaaggttcatcttttatctcctatatactatcagcaattcaaaggaaagagtgtttttttatctcttaccagcaaattcatatcaccaattcgaatatccaaaacaacataggtgcctatgaatttcttttaacaacaatggaagaacaactttgagcctgtgaaaaactttaacttgtttacctcctagaaattgatgcacctaaaaaacttgtttagaaacatcttacaaaactaatgtggcacaatgtgattgaatattccttttctcatacccgctataacatatcagatcactaagagagtaatagatttacactagttggagagtgttagagtatatggtagttaaagtcatattaggataggattggtttgtttggattccttctatatctgtaattcttccttatctcttccctatgtactcctatatatatcgcccccctgaggctcaatacaatgtgtccaatattcacagtatcccctcttcctgtactatccaacatggtatcagagcgggcgatctagtgccgctctcacgcttccgccaccgctgcccccgggagtagcgatctcccgagggcggccacatttttttttctttctctgaggtcgttgtcgccagagggatcgccctcgatctccttcggtggcccccgtcctgttcgtcgtcagatcgatctaaagccatcttcagatcgttcgtgcgtcttcgcgtcatcagcatgcagcagtagcagatcgcatccgcggatcccgtcgacggcgcggctctccacgtcgctgcgccgttggctcccggtcctgcctcctctgttgccgtcctctccgtcgacctctctcctctaccgaggctgctgatgccgggggacaggagccacgtcctcgccgatcatccatgccgtggatctggcggccactccaggccaccgtttcgtccgtcgccccctggtcttctccaacctccgcgccagccgtcgtcgacctcgccgcccttctcaaccccggcgcacagggggagggagtgctcatcactgtcgcttccacacggcaattttctgccggcccctgcagctctgctgctggtctccaccacacaaacctgttgacaggttgttcttctccactgtctctcggtgtctctatatgctatgatcctgtgcgtggcagccatgtgaggagagagagactagatggatggtgtgaagatatacagcctattgccttggttgacttggtggtgacttgcgtcagattcaaagggttgtgatgtgaacggctggtatggactgctgctattgtgttgctgcttgtattttttcccctttcccaatcagtgattgggtttgcgtcgcccaccgcctcgttgacatctgcgcgtctccgacatcggcatcgattctgcttcaacttcatcgttctgcctcgcgcatcttcggcttgatcacccattccagcgcccagctacaacgacttgtacaaccgatcatcatcgagcacgcgtctacgccatcaagcttcgggttgccgctgcgtcgcccccctcgggccacagtgccgctgcctgtggtccacacctccactggttgttacagtgttgagacctgagaggcaccctcctcagtgtggcctcaccaccggtggacttctcgccgctgcatcgacatcgagctgcgttggtcccactacttcgccttcgtcttcgtccagcatgattcatcgccagtgtcgccgtatcttcctcgactatacttcgctcttctccggcaactgcgtgctgctccggcaattctccctctacgccgttctcgcgccgcgaccatcctagaggccttctctgctagtctcctccgacattggcgtataatttctggtggtcccctacctagcccgcacggtattggtaacaccgttgtgcgcgtttgtcccgagtcgtccccgggtctggcaaacctggtgtgacgtcttgtccttcatggttcgactatatcggctcttcgacgtcatcttcctcaacgaccgtcgcgatcgtgtccccgtcatcatctcccgcgcgtcctcgcgcacctcggttcacaacgctctcccatgcgtccacgaccactctacggcgtcctatgtgcgctccgcggctcggctacctcgacatcatcggctccccgacttcggctacatcgaccacggctactctacgcacggcttcagcgaccacggctctcccggctccttcgctttggctacatcgactatggcacaaagggctattatccgtgttgagcactcttgccggtttattctccagtccaagtgtccgcgctgctcacgcttggactgaggggggatgttagagtatatggtagttagagtcatattaggataggattggtttgtttggatttcttccatatctgtaatatttccttatctcttccccatgtactcctatatatatcggccccctgaggctcaatacaatgtgtccaatattcgcagtatcctctctttctatactatccaacagagagtacgtaatagattgaccttaggagagtgacagattaacgatttgcgatgaacaaacttaatctctgaccctctgtatcaaaattcaagcacaagcaaccaacacatattgcaattcagtagtagagatttgattggtttatttgttaacctgtacggaattcgaataaaaaactggtgccaaatttgtcagattttgatgaacacggtctagatttaatcgctctgatttatatttaaacaaggaaaaagtacaccgaaggtccctcagcttgtcatcgagttacaaaatcatcctccaaccgtaaaatcagatatttcacatctcctaactaatcaaaaccggtcacaatcggtccctcggcggttttgatcccggttttattctacgtgactgctgagtcagcacaggacccacgtgggccccacatgtcagcgtggccacgtcagcctatctctctccccgtcttccccttcctcctctctctatctcactcattcttgtctctgtggctctaggcaggggagcaaggcggcagcggcggcgggagcaggggagcaaggcgtcggcggcggcagcggcggcgggagcaagggagcaaggcgtcggcggcctccggtctccccccaccctcttcactctgtccaaggcggcggcgacctccacgccccacttcctcaccgacgcgacgagcacctgcacgatcctcgttagcgggctgcccccggaccgctggtgcctgtacagcggcgtgccgatgaagaagctgacggcgacggccatgacgacggccgggatgccgaacccccacccccacccgacgtgcgtctgcacgtacaccagcaccgacgacgccaccagcgcgccgatgttgatcaaatgttctccatacagtaattattcagtaacctgtatagaaattgatgactactatgtgattacttaactaatagtacctgacagaagaagctcatattattagagtctgaatagatggaagtttggaggcattgcttgtcgctgttattcaaatgtctggttgctgataaataacaggaaaggaagcttagaactgctgtataaatgaagtcagtgtgtggacatcttcagtgtagaattttaaccagagaatcttataaggcttgttctgaaaaaggtgatggatgctgtcctcgacatgtattagaaccagttgaagaagctgctcttgctccgcttctccccctcgtcgttctcgtcgaactggtcgacgccgaacgacgacacacacggcttgatccctcccgttcccagcgcgatcaggtacagcgccaagaacaccacccccgtctgcgcttggtgcggactgcggagcatctcatagcgcgcggcgaggaggcgctccaatgagccgaagcgctctgtgagtcgctggtacaggtgtgtgcaggtcgcgagcagctgctgctactgctccagctctgcgaaaccttccggcgtgtgcaggtcgcgagctactgctgctgctgctgctccaggccagcgagctcgcaccgactccacccccaccgccgccgcgtcgccaagctaccccgccgcccgtcgccggccgccgtttctgcctcgccctgccagccggcccgcacgaggggggcggggaggccggcgagctcgcgccccccgagcccgcgcgccgccacctgggagtagctaagagcccccgggagccgccgtccccggccgcaccaccctccggccccgcgcgccgccatgggtgctagccctagcatcggcatccccatgccgcccgtgcgagagcagagagcgagacggaggaagaaaggagagaaacagagaaagagaaagagcggaaagaaagcaggcgctgacatggacaccctgacatgtgggacccacgtgggtcccacgctaactcagccgccacgtcggataaagccagagtcaaaaccacttaaggaactcaagtgaacggttttgtaagtttagggatgtcatatacctggttttgcggttaggggatgattttgtaactctatgacaagttgagggaccttaggtgtactttttcctttaaacaaaatgaatagagagtaagcccaacagcaaaaaacatgttagcccaaaaccaacgaactgcatcttaggcccatttaaccagtcgaacatgttatctcaggcccgtttagcccacaaaattgcaatatgaatactagcagtctagcacaactagctttggctgcgttcgtttctccaataacaatagttggatgaaattttggatactgatggtacacttttcaaactactaaacggtgcgttttgtgtgaaaacaattgctctaaaatatcagattaatccattgtcaagtttataataattacacgttattaccacctcgttttacgtgaaacacttaatatttatcctcatcttcattttcaggatatccagagaggaacacacgcttgaaaaatctgtcacgtgctagttaattagcaaaaccgaataaggtacttataaaaactaaagtgtcattccttcttactaacatatatctttagggagagctcccaccttttcgcctcaaaagggaaaataaatatgtgcgcctaagttgatcctgatgcccttaaatccaaagttcaaacatgtggggtggcttcttaagaaagaaaagaaacctaaatacttggatgtaatcataaagattcccaccgaatcttcaccgatcaattgagattaattagaaatgacgatagccgtttaagcggagaaggacggcttacattattgctggttaccattcaaaacagaaagaaaacagtggcaccagattctgcggttttctacagagcttttttcttaaaaaaaactagacacaatatatacacaaactattctaacacacgcacactcacccttataaatgtacacacgcacaccttatccttatcagcatctccagaagattaggctgtcatattttaatattgacgaagccactgcgggcgtctcgttgtcgagggatacgtcttacacatgcacacattattcttatgaacatctctggaagactaggttgtcatatcttgatgtcgatgaagtcactacgggtgcctcgttgttgagggatacgtcgtgtaccattaaaaaaaacaattagccgtaaatatgagcacatgtgtcaagcctagaatttaaacccagatggactggtttcaccataagaaacttaaccaattaagttacgctcacttcacggagccctttgtcactctcctagttgacaaataagttttcaatgactggtccatacaggaatatgttcttccattatttaattttagttgctaaacatgttttcacatactataagttgttcgtccattatccatttttctaataggcaccttgttttgcatctttgaaagcattttgaatggctgataggagataaaaaaatgacccctttttttcttcgattgtgtttttgcccttctttctgtccaagactactataggataccaattcactacgtgcagctgtcatatgtttttgataaatctaggttacctattaatttagagtaatttagaaattatacactaagttttataagtatgtgatatatttttgttggttttttttaattttgggaaggtaatatgctttgataaatatgggtctcctattaatatgagagtaatataaattttcgacatgacctgcaccaaacagtaatgtaattagagattatacatggttcttttgaaagtaagtgacatatgtatatgaatttaatttattatttggtggtggtgatatgacgataaattcttggcacctattaattttgatttaatcttgtagttatggcatatgtttaagttaatcattttgtatgcagcgagaattgcaatggatcgacgataaatgtaccatgcgtcttgttcaggcctcctttgaattggaggaaaaatataggaaaaagaaaggaattgaaatcctacactatttatgcctttgattcataggaatgagaaaaggaaaaacgtaggaaactttcgtattcctacgattctagaggaaaaacatagaaaatttaagacaaaattggttatatagcatcgaaagttcacccctttccatttttaacactttcgtcaattctcgatcgttttctatccgccttgatcgttattgactcagccactcacacgatatgacctttttacccctcattgccatgcattatacatgtacttgtgaggggtagaaacgtcatattgcgtgtgtggttatgtcaatagcgatcaaagcggatagaaaacgatcgagaattgacggaagtgttaaaaatgggaacgatgcgaactttgggtgctattatagtgagctggtatctttcggtgttataaaaccaaaaacgtgaacttttgatgctatatatctaattttgtcaaaatttaacatccactctaacctcttggaaaactttccttgagtctatctctttcatctgattcctgcagtccaatcaaacggtcatttctgtgtttacaattctctgttttacacttgcgttgaatacatttttgtttgtcaaagtttcagaaaaacaactgtaccatatattaaaaacagagatatcagaaatttgcacaaacaaatcacacttcaatgttccctattgatttactgattcatcaaaccaaatgccatttgatatcagcattcacctcatgacacgtaaaaaacctgacactgatactccaaattactccctccgtttcaagatgtttgacaccgttgactttttaatacgtgtttggccattcatcttatttaaaaaatttaagtaattatttattcttttcatattatttgattcattgttaaatatactttcatgtacacatataattttacatatttcacaaacttttttaaataagacgaacggtcaaacaagtaagtcaacggtgtcaaatattttgaaacggagggagcaaatgagcagtgagactctgattagtgcctgactcctcctgggcacaaggcgcggacgcagcggcttcgccatggcggtggtgaactcgagcttctcggcgaactccacctcgtcgccggccacctccttccactcgaactccatcaccatggatcccacgaagtactcgaggtgcatcacgccgacgttgagcccggcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacgtctatgtcctccgccgccttgtgcggcagcagggtgtggctcggtgggtgcttgcgcaggccttccatgaccacggggttgaggtacggcatcttgttgtccttgtccctcacgctccgctccaggagctcgccgtcgtcgccgcaggtggcattgatctcggcgtggagcttctcctgcacggccgggttcttgactagctcggccatgatccattgtagcccggtggaggtggtgtcggtgccggcgttgaggaactcggagcagagcgtgacgatctcgccgtcggtgagcgagcggttgccctcctcggggatcttgacgtcgaggagcgtgtcgacgtacgagtgctggaacgtcgtctccctcgccggcgggaggccctggctggcgagcttcttgtactcccggcgagcctcgatcagcggcacgaagagctccttctgccgccgcagaagggcgtgcccggcctcgaggcggccgcggaagaggtgcttggtgatccacgggaggaagaagaagacgctcgtcttcttcgagatgtagagcagccacgcgcgctcggcgtcctcgatgtcgcgcacggcgtgctcgtggagccgctcgccgaagcacatgagcaggaggaggcagaacacggcgtgctggaacgcctccgttacgttgggcggcgcgtcgccgccgccgccgctgacgccggacgtcgtctcacgcagcttctccatgaggacgcggcgcgcccagacgcgcgccggcgtgaactggtcgacgcgcgactgctgcagcgtctgcgacacgaggttgcggcggagcagccgccacatggcgccgtagttggagcgcgtgatgattctcgctgacgccgaggagcatgctggtggccgtccgcggccggtcggccagcgtggcgccggcgccgacgagcgccgcgtgcgccaggtgccgatccgccacgaagatggagaggcgccacccgatccggagcgtcacgacggggccgtacttgtcgaacagcttcagcagcaaaggctccaattcggccaccaagttccgcagccacagcaggttgccgaacagcggcacggccggcgggccaggcgggaggcggcggcgccgcctcgaggtgacatcgcgcaggaagacgaggagcgggaggagaaggacgccggtgaggatggccaaattatccatcagcgttggcagctgttttcgcttgcgttggttgtcggacgaggctaaactgttgtgtacccatacattttataggtcttcggctcaagtcagtagcagtagactcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctattcattcttcttggaacctttaaaaattgaattttatagtttttagagtttattgtcacattgggtttcgtttttataatttgtagatgtctcgtcaaacgttgtcattatactcctctaccgcccgtccactgtttcttctttttattgtcattgaaattttaaaaatcaaagataattatcatttgggtttatttttactttctagaagtcccgccaaaccgtcagcggctttgccattgtactcctctacagctcacccgcagcctccgttctttattgtcattgagattttaaaatagaacatgattatcattgtttcttttttactttttggaagttccgaaccttaaaaaattagacttgtagttttattatttttataatttttagaagtcccatcaaacgatgccactatgcccctttacagcccgtccgccgcctactctttattgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttctagaagtcccggcaaccgccttacttgtttgcttcacggcctgtctgatgtccctccttttaatcgtcattaggattatatttggtgttttattaataatttttatatgtcgtatcaaccgccaccactctactcctttctaggctgttacttaatttatctcgtcatgtgttgtagatggtcttttctttcaatagtctttatttttatcacaaattttagttatttataaattgtatttctaattgaaatcttatttttctttttctaatttcagaatttatttttttttaaaaaaatagttaataccgtattgtgttcctttaatgtttttatttttattttcaatttcagttgtttgaaaattgtattcctacttaaattctcttttaatttttctaattttggatattattttatttttttaattcgaaattttaattattcttgtattgggttcttatatggattcttctttcaatattgcttattttttattccgaattttatctaattttcaattgtattcctactttaactcttcttttattttcttttgctaactttggatttattttattttaattcgaattttaattaatctcatattgggttcttatatggactcttctctttaatattccttatttttaattccgaatttcaggtatttttaaattatattcctacgtggactctcctttccttttctaattttggattttattttatttttattccgaattttaattaatttcgtattgggttcttatatggactcttctctttaatattccttatttttaatttcgaatttcagctatttttaaattgtattcctacttggactctcctttccttttctaattttggattttattttaattgtattcctacttgaactctcttttattttttctaattttggttattattttattttttattctaaattttaattaatctcgtattgggttcttatatggattcttcttttaatattgcttatttttaattcctaattccagctaattttaaattatattcctacttgaactcttcttttattttcttttgctaattttggatttatttttatttttattccgaattttaattaatctcgttctggattattatatggactcttcttttaatattccttatttttaatttcgaatttcagctatttttaaattgtattcctacttggactctcctttccttttctaattttggattttattttatttttatttcgaattttgattaatctcgtattgggttcttatatgaaaatttctttcaatattgcttatttttaatttcgaatttcagcttttttttagattgtattcctacttggactcatctttcctttttctaattttggattttattttatttttatttcgaattttaattaatctcgtgttgggttcttatatagaaacttatttcaatattacttatttttaattccgaatttcagctctttttagattgtattcctacttggactctccttttctttttttttctttttctccgattaatgtgggaatttctagcctccacagcgaacgtggtgtcttcttttcgagctgtcttaataatataatagattttagaacatgttctgtacatacggttttgctaactagcatatgatgcatgttttaagcagccttcctgtttagtttttctttttgactgtcagaacttaggtttacattcgtgctgtggctggaattttatttagaattgatctcaacaccttgggctcgttcttttccacaactaaagactgcaacttagttctttttcattagcatgcttctcgaaccgttaaacgatgtgtattgtaaaaatattaccgtttgaggctaatccatttttctctgtgtcaggttgtgttagctatccaagcgaattggtgtttcaagcgcatagcaatgggagatagaagattgagcttatatggaatagcaattgtgttcgcacatctgaaaaaggggggatgtagcctagtggttgcagtgacctgagtaacaccctaaggttctgagttaaaatcttcatatgagcgaatttcaaattgagttatttgcagtgctaagttctcaatttaaattgttgcatatatccatttggatgtagatgctggataaaaaaaactattctctaacaaaagttgtgttcgccgaatccactttctgctgaacactcatggatgtaaatgtgttatcacacgtgggattaagaccttgtccagcaccacatggcgggcagccctaatgggctatcgatcgcccgccaatgggggtag

SEQ ID NO: 11564 - DNA, 12752 bp, Oryza sativa
ttagcatttccgccacatggcatctcagtgtcgccaccgtcgatgagggagatgggcatacatgcatggtatatcggtttgcactttttatttcagcgaaaatttctgtagcaccaaaatacgaaatttcatgatttttggcattttagaccaaaattatttgaaatttcgactgaatttgaatagactttgatcaaacttaacaaaaaaaatttgacatattttaaaattccggtcgatataatgacttgtcggtggggttcgaaatttcagaattttccgaaattttgaaccaaaatcgctatcactagtcatgcgagcacgaagaattagggaacaattcaatatgaattcgggttaaacccatttatgcccaaaaataccagtccaatccaaacccttttttcttttttttttttgcctcagtccaaaccgctccggtccgttagctcactcaacccatctccacccaaataaagcccacccgtagtgaaaagggtaaaatccagaagaacaccacgcacaagcacaaccttgaaaatctgaagagcacacgaagccctaattaaccaaaacctccgccgccgccgccatggccgccgcggtcgccgcctccccggcgcaatcccgcaagacggagacctacaccgacaccaagcgccgcgacgacgtccgcggcctcaacattgccgcggggcgcgccgtcgccgtcgacgcgcgcaccttcctcggcccacgcggcatggacaagatgatctcctccagctcctccggcggcgaccaggccgtcatcatcaccaacgacggcgccaccatcctctcccgcatgcccctcctccagccggccgcccgcatgctcgccgacctctcccgctcccaggacgccgccgccggggacggcaccaccaccgtcgtcgtcctcgccgggtccctcctccgccgcgcccagtccctgctctccgccggcgcccaccccaccgcggccgccgacgccctccacctcctcgccgcgcgcgccgtggaggtcctccacggcatggccatccccgtcgagctctccgaccgcgacgccctcgtcaagtcggcatccaccgccctcaactccaaggtcgtctcccagtactccaccctcctctccccgctcgccgtcgacgccgccctcgccgtcgtcgacccggcccacccgtatctcctcgacctccgcgacatccgcgtggtgaagaagctcggctgcacggtcgacgacaccgagctcatccgcggcctcgtcctcaacaagaaggccagccatgtcgccggagggccaactcggatcggggacgccaagatcgccgtgatccagttccaggtctcgcctcccaagacggacatcgagcacagcgtcgtcgtgtcggattacgcgcagatggatcgaatcctccgcgaggagcggaattacatccttggcatggtgaagaagatcaaggcatccggatgcaacgtcctgctcatccagaaaagcatcctgcgtgattcagtcaccgatctgtcgctccattatctcgcaaaggccaagatcatggtcgtgaaggatgtcgagagggacgagatcgagttcatcaccaagaccctcaactgcatgccaattgctagcatcgaacatctccgcgaggacaagcttggtcatgcacatctggttgaggaaatctcggttggtgatggtaacaataacaagattgtcaagatcactggcatcaagaacatgggaagaacagcaactgttcttgtccggggatccaaccagatggtgatcgacgaagctcagcgcagcctccacgacgcattctgtgtgatcaggtgcttggtgaacaagaggtttctgatcgctggtggtggtgctcctgagatcgagatgtcgatgcagctggctgcttgggcgaaggagctgagagggatggagagttactgcgtcagggagttcgccgaggcgctcgaggtcatcccttacacgttggcagagaatgcagggctcgatcccatctccactgtcaccgagctccggaatcgccatgccaagggcgagaagaacgccgggatcaacgtgaggaagggtcggatcacgaacatcctggaggagaatgtcgtgcagccactgctggtgagcacgagcgccgtcacgctggcctgcgagtgtgttaggatgatactgaagattgatgatattgtcaccgtgaggtaaggttaattaattatgtggtggctgaccgtgctggcctctgctctattttgtctgtcatgttatttaggagatttgatattttgacaccttctaaagtggcacgctttcgttgattcagatggttcgaaatatcatgcattctcacaactgtcaataaaatcaaattggtacaaataaagtgtcaaaccatcaaatttgggttttacaattttatttgtttgcgtgccttttctgtctagatgttctgagcgtatgtatttgacgtctgtggaagagaattatatgttgtatttgcctctacctggatgaaactgaagtgtagactgccggaaacgccagttagcgagcaacccaattcggcgagacgcagtccaaattctcaccgcgcgagccggtttggatgggccgaggtcggcttggattaggcccatttaggcatttagtgaacatattagatacagtctattttgcctccctcaaagtgtagccctagcttgatttatttcactcgaccgcagaaccggatatagagcctctctcaagtctcaagtctcaactctcaactctaaaaacctgttcaatttaactccttaatatggcatctatgtaaactacagataaaagtaaaaataaaaattcaattggaccacatgctagtgtcataagtaaccccctctctcacaactatttcttccttttcactctactgtggtgtgtgtgagagggccagcgagccgaaggcggatcgaacgtggaaggcatcggcggcccaaggccttacgtggctggcgagctgaagacggattgagagaaggaggcatcggcagcccaaggccttacggggccggtgagctggggctaatagagctaggaaggtggcgacccttcgaactagggaggcatcgacgacccaaggttttatggggctggtgagctggaggcagataaagcaagggaggtggtgacgcttcagagcttcgtgacctaacgtagtgtgacatggttagtgttgtcgatgaaaaggcctcacggagtatgacggggacgagtcgacggtggtgctccgtccagctagcaacgacgctcttgtggactcacagatcgagttgttagcatgagttgactaggtcaacatgccacataaaacaaaagcaatatccaaaccaccaaacctctaaataagacaaattgaacaggttatgagagttgagagattctctatatctgattttacgattgagagatatggatcaatagttgagggaggtaaaacatatttttttttccaacacataatcgaattaagctaaccagcccacatagggctcattattacatagaaaactaaatttcgttaaacccgtttaattcatcctcctgcgcacgagctgagcgcgaagtggctttgccatgacggtggtgaactccaacttctcggcaaagtccacctcttcgccggcgatctccctccactcgaactccctgaccatattggccacgaagtactccaggtgcagcatggcggtgttgagccccgcgcaaatcctccgcccgacgccgaacggcatcatgcggatccccttgctgcccgtcacgtccaccccctcgccgtcgccgccggggaggaacctctccggcatgaactccattggattctcccattctttctcgtctcttcccatctcggccaccatgaagttcaccgtggcgcccttggggatgaggtacccgccgacctccatgtcctccgccgccttgtgtggcagcgcgaagtggcccggcggatgcttccggagaccctcgaggatgacggccttcaggtatggcatcttctgggtgtcctcctcggtgatctcgtcgtggtcgtcgctggtcttggacttgatctcgtcgtggagcttggattggatggatgggttcttgaccagctcggccatgatccattgcagcgtggttgacatcgtgtccgtgcctgcgtcgaggaactcggagcagagcctgaccatctcgtcgtcggtgagagcgcggtcgccgccgtcctcagggagcttgatgtcgagcagcgtgtcgacgtacgagtgctcgaacgtcgtcgtctccttctccggcaccgcgcgttccgcgagttggttcttgcgctctcgccgcgcgctgatgagcggcatgaagagctccttctgccgccgccgcagagcgaggctcgtctggatgcgcccacggaagatgtgcttggtgaccgccgggcagaacgcgaagaccttcatcttcgtcgcgtagtgcaggagccagccgtgctgcgcgtcgccgatggcgcgcaccgcggcctcgtcgagccactcgccgaagcacatgagcacgaggaggcagaacatggcgtgccggaacgcgtccgccagcacggcgccgccgcccaccaacccgtcgacgagcgcgcggcgagcccaggagcgcgcgggggcgaaggccgcgcgggcgcgcgacgggtgcagcgtctcggcgacgaggttgcgccgcaggaggcgccacgtcggcccgtagttgccgcgcgagatggtgttgccgttctcgccgaggagcgcgcgcgtgacctccggccggtccgcgagcgcggcgccgcgctccaccagcgcggcgtgcgcgacgcggcggtcggcgacgaagatggacaggtgggatcccacgcgcagcgacacgacggggccgtacaccgcgatgaggcgccggagcaggggctccaggtcggcggaggagtggctcagccagagcaggttgccgaggacaggcacggcgagcgggcccgggggcacgcggctgcggccgccgcattttcgcagcgagaggaggatgaagagtgcgactaggaaggcgaggaggagcatgagccactgtgatgcgtcgacgttggccatggcgatgacgtctcgctccttgcgttgtcaagatgctcatgctccgcttcacttgtgggtggagttgattggttcgatgtccatggcacacgggcctcaaatccattctagtgggggaaaaaacaaaaaatagtatgtatactttaatagtattaacctcaaatccattctacatagtgaggaaaaaaccaaaatattgacaaaattataaatatttttttctacagctaaaatgtaataaatttgaggttaagattttatacgtaggtacaatactattgaaaatacatgtacatatttttctcgatttttttgtgatatttgtttgttgatgtgcatggtgtgtatatgtgatatgtttcctttatggttaggtctatcttctaaaatttaatcagcaaatatcattgaaactgcatctggagaagcttctataaataaatattattaaaatgcgccagcagattttgaaaatttaacggcacgtgtttaagatctctaatttttttctcggctaacctagctaaggacctgttagttccaaaaacaaaaactttcacgctgtcacatccaatgtttggacatatatatgtatggattattaaatatagaaaaaaataaactaattacacagattacgtgtaaattgcaagaccaatcttttaagtctaattgtgccatgatttaacaatgtggtgctacagtcaacatttgctaatgacggattaattaggcttaataaattcgtctcgcagtttcctagcggaatctgtaatttgttttgttattagactacgtttaatacttcaaatgtgtagccgtatatccgatgtgataaccaaactcaacaattttcaccaactaaacaaggcctaaaccatactacagcccaccaaaacaagcttgatcggtcattagcttgccgatgaaggagacattctaactctccttaggggtagggattttctagtcaggttagtttgctaagcactaagcagagctaatttttgtagtaatttgctaagccgtttggtttaaaaaaacactcaattagtttattagtattaattaagagtgaactattaaaagcttcgtaaatggattttctttggattcttagaaaactattctaatgatttttttttaaaaaaaaaacctgcatggtttagcggcatgaaaagtatgaccgttataaggagcggccaataagacttccttagaattaacactggtaaggctgcgttcgggaggtgatgttaggcccgcgcacacaaaacaaagccatgcattttatcatgattaattaagtatttatattttttaaaaaatagattaatatgatttttttaaagcaactttcgtatagaaactttttttaaaacaccgtttagtaatttaaaaagcgtgcgagagaaaaatgagggaggtgagttgggaaagttgtggaaagaacacaacttaaatcatggtaggtagatgtataacactttaaattgattaatatgtatataacttaaagtacaattgtatcatggcaatcctaatcttccatctcagctagttttcatagcattaaatatattgctatataagaaaaaactaaggtggcaaagagagttaatgaggagaaataaaaaaaaaaagatgaacaaaccagctccatataggatccgagaataaaaaataagaggattagtggatgaaaggagagagaactgaggtgattggatgatgatttattttaaagaaaccacccattagatactccctctattgagcattgtcaattgattatcatataacctttttagttattcccaaattatcatcatattaatatcaattctctaatctattcgttatctatgcatgaaaggcaatggatattggtgcatgcatctatgcacataactcttcacaataacatgcaatgtctttatttatcattggctagaaaatggtgcatgcatcgaatttgttatcggaataaatatagtataagagggtcattgtcttttgttagtcttggtgtgaataaagtctgtcatatttgttaaaaaaatgtaatatgatgatcaattggaaacaaatggagtttacagtttcaatacctaatacataacgtttgtatgatatggtatgtatggaaattagtcgataatatttttccagtataaaaaaaaacaatgagctgccgaaaatggcatcgctataaaaggataagtcatttcattgtccacttgcgattttgtgatagtgtaccgtatagtatcgtgcggatcacagtatccttaaaacgtcaaattgctacggacagaaatagtactatattactatcatgaccgcagagaaagtagtactgtagaaagtagggagtggattctaatccttcaaggggatatcccctcgtatacctttttcttttaaattcgatgtaaatagttgtgaaaaattctgaaaaaatttgacaatatagagcataatgatacctactagtccactgaaattcatgttcaaattcgatctacacatcgagaaacaaaaaaacaaatttagatataaacagtacactactattcatacgctgaatttgtcttttttatatctcaatgtgtgagttgagtttggacttaagattttgtggatttgtatatatgtgttgtatgaatgttgtcaaatttttttagaatttttcataaccgtttagatggtttttaagcaaacgatggaacatcccctcgaaggattagaatagtttcccgtacaaagtaccgcagtaagccagtaacgttctcctccgtcgttgactcatatatactccctcctccctccttctcaaaaaaaaaaaaaaactctagccatgtataataaggcctatatagcacaggatcctttgatcgtcgtaggaaatttagggctacttttgaaaacgagactgaaaaaacgttcgaatagtaaaaatataagatttttgatatgaataaaagtgtaaaatagaatattacaaaacataaaaataatcgtttaattggatcgcatcaaaaacgcaaaaattagatgagagagaaaaactcaaaaggaaaattctctgagttctacctcgttaaattttctccaaaacttgtatgataaaagatattcctaggaatttcataagattcatttgtattcatttcttttgattcaaaaggactgtaaaaaaaattctatagaaatgaaattctccaaaattcatacaacttcctttgaattaaaggggagcattttttttcctctactttaagaacgatgcagatatgcaattaaccaaagaaggagtgagataatcagagattaaccaaaatgattgtttgactagataagaaataatggatgtcgtgtaatcatcactactgattttgctatgttccaacaaccagccccagtgtttcacttattaatatgcttattcgaatcatttattagcaaataaaaagcacatgccgtaaaaaaactacgatgaaaaaaaaatcaaattcaaaatgaatttttggcttataagcataagcataagccaaaatagagacccatttctatccataattcctaagttatatatgtatatattctccgtttgttttgtacatgaattcatgcgttttgtagtattcctatattttcctttgaatgttttaggtttcttacgttctaaacaggccgactatcattcacaacaagggtggcgtccgcatgttctaaggctgagcgcaggaggataaaagaaagttggtgaagtgctgtctctctagcagttggtgtggatcgttgtctgcagatgcagggtcccatagtgtgggaatttactctgttttttagctttttgctgttgcatcgtgtaggattgggtgttgtaggaaccccagaaaatgcaagttgtaagacctgttggtgtcattttcttaatgaaatgggagaggttattctctctttctaaaaatctatatccatctcgtacaataaaaggcacgagagatttgtgaaagaaagtccagcagaaaatcaatcggcatggcgggacgaatacaggttggccatatcaatgcagttgcaggctcatttatgtagtaatccgtagtactattacaaatggtctgatcaggcacgtaaacgcattcgcctttgacatgcaatttcgcacaacacgcacgcctagtgtcagtgcttttgcaaacacgcaaaagaattacacgtcaatataattgcaaaaggattatacgtcaatatattagaagaaaaagagtttttatttcacaacgcaatcacctcgtgccactgctaatgcctctgtctcaaaatatacaaaaattggggttaaaaatgggtactaacaaagttcatagaattaaataggagaatatagtaattagttgataagagacatatatatatatatatatatatatatatatatatatatatatatatatatatatatatatatatatatatatatatatatatataaaattaaatggtgaaaaatatgattagttgggaaagaatatgacgaagaagttattgtatttttaaacaaattttaaagggaaattgttatattttgggagcgagtgacgcaatccggattctcacgggggcccttagtaaaaatgttacacgtatgagagtttattttgattcccttaacatagtaccctcatagacatcgtccccaacctcgactcctacaacacctttattctcatagacactgaaaatgtattttaatgttttaagaggatatcccatcgttaaaaattataaaaaaataaaaaaattaacatgtgatatatcaccctataaatatgtaagtttaaattcattctctacgagttataaccaaaataacatatttaagtagaacaatcacaatcatatttttttcaacttatagaggtgaaatttaaacctagatatttgtgaagtggtatattacattttaatctatcttcataaaaaagttgaggaatgtgttataccggttttgtggctaagggatacgattcgacaaagggcaagagcatagggacgcatgatagacttattcctttagtaaacacatactttaattaactaattaaagtgtccacattaggcccattatttgtaccgagtactaaaaacttgattaaaagcccgtttaatcgacgctcctgagcaccagctgcgcgcggagtggcttcgccatgacggtggtgaactcaacttctcggcgaagtccaccttgtcgccgaccaccgccttccactcgaactctctcaccatgttggccacgaagtactccaggtgcaacatggcggtgttgatccccgcgcacatcctccgcccgacgccgaacggcatcatgcggatcctcttgctgcccgtcatgtccactccctcgccgtcgccgccgggtaggaacctctccggcatgaactgcatcgggttctcccattctctctcgtctcttcccatctcggccaccatgaagttcaccgtggcgcccttggggatgaggtacccgccgacgtccatgtcctccgccgccttgtgcggcagcgcgaagtggcccagcggatgcttccggagaccctcgaggatgacggcctttaggtatggcatcttctgggtgtcctcctcggtgatctcgtcgtggtcgtcgcttaccgtggccttgatctcctcgtagagctttgcttggatggatgggttcttgaccagctcggccatgatccatggcagtgtggttgacatcgtgtctgcgccggagtcgagggagctcagagcataggcataccatcgctttgtcggtgagagcgcggtcgccgtcctcaggtagcctcaggtcgagcagtgtgtcgacgtacgagtgctcgaatgtcgtgtcattctccggcaccgttgctggtcgtttgcgctaaaactaatctgcagttagaaaacaatccgactactaaacggcaaagccaataatattgaaaattaaatcgatgaaatcgccgagattaatcccttcggctggattgaatccgagacgaaaaaaaaacatgcttgacgaaatcggtaacgtcggagattggttccatcgcactcatcgacaggaaactcgacagccccctacctggcgcgccaactgtcgaaacaagatttcggcaatataaacgaggtagcgcacgagacctaaaagtagaaggacgcgaagacaagaattttagagggactgactatccatttgtcgggtgatttttaacaagaaatcacctaatttttttctacccttagatttacatctaacaaactacaaaaagaaaataaaaaatacatatttacttacacatcattgttatcaaaattacaatgcacttgcatgccatatcaactgaatttacaaatgtaattttagttatataggactgtaattttacaatttaaagaaaataacaaatacatatttacttatatatcattgttatcaaaattacagtgcacttaaatgtcatatcaactaaatttacaaatgtaattttagttatatataactgtaattttacattttaaagaaaatacaaatacatatttacttacatatcattgttatcaaaattacagtgcatttacatgtcatatcaactaaatttataaatgtaattttagttatatatgactgtaattttacattttagagaaaatacaaatacatttttacttacatatgattgttataaaaattacagtgcatttacatgtcatatcaactaaattacaaatgtaattttagttatataggattataattttgtattttggtttcaaacgagagagaaggagagagaacaacacgcatgtcaatttttcagagcgtaaaaaaagcgagactgaccgatcgacgctggtacacgcggcccaacagaatcctatgcgggttcgcgcttcccagcccaatatatgcgcacgaattttggcacacattgaatggcctaaaaaatgacaaatctgagagaaaaaatcacacgacaaatctatagcaaaatcgcgggactgactatccatttgtcgggtgatttttaacaagaaatcacctaatttttttctacccttagatttacatccaacgaactacaaaaagaaaataaaaaatgcatatttacttacacatcattgttatcaaaattacaatgcacttacatgccatatcaactgaatttacaaatgtaattttatttatatatgactctaattttacaatttgaagaaaataacaaatacatatttacttatataccattgttatcaaaattacagtgcacttaaacgtcatatcaactaaatttacaaatgtaattttagttatatataactgtaatattacattttaaagaaaatacaaatacatatttacttacatatcattgttatcaaaattacagtgcatttacatgtcatatcaactaaatttacaaatgtaattttagttatatatgactgtaattttatattttagagaaaatacaaatacatttttacttacatatgattgttataaaaattacagtgcatttacatgtcatattaacttaattacaaatggtattttagctttataggat

SEQ ID NO: 11565 - DNA, 4408 bp, Oryza sativa
tgttataaaaattacagggcatttacatgtcatatcaactaaattacaaatgtaattttagttatataggattgtaattttgtattttggtttcaaacgagagagaaggagagagaacaacacgcatgtcaatttttcagagcgtaaaaaaagcgagactgaccgatcgacgctggtacacgcggcccaacagaatcctatgcgggttcgcgcttcccagcccaatatatgcgcacgaattttggcacacattgaatggcctaaaaaatgacaaatctgagagaaaaaatcacacgacaaatctatagcaaaatcgaattttagataggttcaaaccctctcgataagagttcataccctactggcctgtttgggggcttgaatccgtcaggtgcagtattaatctgacgatcaggttgtgaatcctctatcctagagggcttcctacccgccttatataggatggggggcaagattacaagatagaaaccttaatcaatacggtatcggtttactaaatctactttacaatattatcaaactaagactttatgccgttctataatatacaaggaaacgtaatactcaagtcatgatccgtacatattccatagatataagttatcccctataactagttggataaccatgtcgtgtgggtatggggtacctataatcttcacacacctgtgtgctggcgacgctagcagagtccgggacaagctctctgaattccaatgatcatgtcagtcatttttgcaccaatagttcgataactagatttggttctgtaggtgtttgtgagcgactagttcttgaactgggacacggagaaccggatcaaagtccgtatcatctcagccagggcgtaccactcacatgtaagtgaagctgtgccacctcgccgaggaattcctcggtcacggcaggcgcgcgagggacgagcggcggcgtttctcccagcagaaacggcgtgcgtgcgtcccgcgcaccgcctgacctcattgacaccacctccgcactcgaccactcgttgctcgttggtcatggcgggcgtgcgagggatgagcggtgccgctcctcctccaagcactaccggcatgcgtgcggttaaagatggagtcgtcggtgcaaaggcaggggcgggagaggatgagctcgagtagggtagaggcaccggagtgaggggagacgacgggactccacaaggcggccaggcgggcggcgagcagggacgttaagcggtggtcggggtggaaggctggagagtcggccacggccgtgaggagtggaggtcgagcgccgccagacatgggtggtggcacgcgcagcggaggatgcagaggagaaggggagcgccaagaaagggatcggcggtgggaggtgggagacggcaagcaagcagacaggatgtgcggttgcagagaaagggatagagtaaagaggggatagatgatggaagaagatgggaatttacaggtggatcccgctattttttttttctgattgtgatgacacgtactccctccgtttcacgatgtaagtcattctaacattttccacattcatattgatatgaatgaatctatacatatatatctatctaaattcattaacatcaatataaatatgagaaatgctagaatgacttacattatgaaacggaggaagtagctgtcatgttggataaagaccgggtcaatgtaccacgtaggacgaaaccgtcatttaaatcgctcgaggaggtaaattgatccggtttttgaggatcctctatatccggtttcatagttgagggatacgatttgaacctgtgcaatagttaaggaaggtaatatagacttattgcttagtaaacacactctccaataaaccaactggtcacattgggccaattatttgtacagagtactaaaactcattaagcccatttaatcgacgctcctgagcaccagctgcgcgcggagtggcttcgccatgacggtggtgaactcaacttctcggcgaagtccaccttgtcgccgaccaccgccttccactcgaactctctcaccatgttggccacgaagtactacaggtgcagcatggcggtgttgagccctgcgcacatcctccgcccgacgccgaacggcatcatgcggatcctcttgctgcccgtcatgtccactccctcgccgtcgccgccggggaggaacctctccggcatgaactgcatcgggttctcccattctctctcgtctcttcccatctcggccaccatgaagttcaccgtcgcgcccttggggatgaggtacccgccaacttcaatgtcctccgccgccttgtgcgccagcacgaagtgtcccggcggatgcttccggagaccctcgaggatgacggcttttaggtatggcatcttctgggtgtcgtcctcggtgatctcgtcgtggtcgtcgcttaccgtggccttgatctcgtcgtagagcttggattagatggatgggttcttgaccagctcggccatgatccactgcagcgcggtggacatcgtgtccgtgccggcgtcgaggaactcggagcagaggcttaccatctctttgtcggtgagagcgcggttccggtcctggggtagcctagggtcgaccagtgtgtcaacgtacgagtgctcgacggttgtgccattctccggcaaggttggctgtgtcctggtcttgcgctctcgccgcgcgttgatgagcggcacaaatagctccttctgccgccgcctcagagctagggccatcttgatgcgcccacggaagagatgcttggtgatcgtcgagcagaacgcgaacaccctcatcttcgtcgcgaagtacacgatccagtcgtgctgcgccgtggcgatggcgcgcacgtcggcctcgtcgagccgctcgccgaagcacatgaccacgaggaggcagaacatggcgtactggagcgtgtccatgacgccgtggggagcctggccggacgccgcggccagcttgccgacgagcacgcggcgcgcccaggagcgcgcgggcgcgaacacgcgggcgcgcgtcgtcgacgggtgcagcgtcccggagacgaggccgcggcgcaggaggcgccacgtcggcccgtagctggcgcgcgtgatggtgttgccgttctcgccgaggagagcgcgcgtgacctccgggcggtcggcgagcgcggcgccgcgctccaccagtgcggcgtgcgcgacgcggcggtcggccacgaagatggagaggcgggagcccacgcccagcgacacgacggggccgtggcgcgcgatcaggcgccgcaggagaggctccaggtcggccggcgagtgccacagccagagcaggttgccgaggacaggcacggcgagcgggcccggcgggacacggcagccgccgccacgcccacctcccttcccgtcgctgcgcagcgaacggaggacgaagaacgggaagaggaaggcgacgaggagcaggagccacggtgatgcgtcgatggtcatggcgatcgagatcgagttcgctccgcttggtcagttgacgttaagctagtttagcttcactgccttgtggctggagatgatggatcgaattccgtggcattccacagattatatatggatcgatcagcatttgcgataaaagtactccacagatttttcacgtgatcaatgaacagttcactcacaaggggttccataacctattaatagatgcaattgcgggaaactattttgatccctcgaggggatatcccctcgttatttacatgttattcaaatggttatgaaaaaaattaaaaaaaaattgagaagatgtattaacatgcaatatattactccacaaacatgtaagttcaaattcaacttctacgtctcacaacgaaaaaaacaaattaaactacagctagttaacatatatttacagtcaaaagaattttttcgttacgagatgtggaagttgaatttcaacttgcatatttgtggagtgatataccacatgttaatacatcttcttaaattttttcaaattattttataactatttgagttatatgcaaacaacgagaggacatcccctcgagggatcaaaatccagtcccaaatgaaattgctagtctactttagaacaagtataaaagtaggctgtaagccgactaaatgttgaggtggaggagagaagagaggagaagcggctgtaaacttacagtcggcttggacataagaatcaagaaaatttatgagagacaactgggtcctatataattgtaaagagctaactattatatgggtaggctgagagaaggctgtaaagaaccttatagctaacaagtcagctgtattattagccttggtcttaattgtatgtgtctagttctttttcttaaggaaaaagtacaaattaccccccccccc

SEQ ID NO: 11566 - DNA, 10021 bp, Oryza sativa
ccgctatagttcggggggggggggtaattcgtactttttccttttcttaattattttttatagagggttctcctttggttatccaacatgtttttctatcgtaacagaggataagggagtattttctccatcccataaaaacaaaattagtatgacacgtgatgcatgctagtactataactctggacatgtgcatgtaaatgtttatatttaaagcataccccaaatttcagatattgtacattatatttgtgcttggattccaatttttcttgatcaatgtgtggatctctagttctttggagcgaatatgatcgcttctttttccacaaatttattaagttaataatagatatatgggaaaaaaaggcatgctctcgtatatttgtttttgaagaaaaggcaaaagctttgccttatgtatattaatagagcaggagaaaaataaacataagcaagtgtatatacagggttagtcgaggaaaaagactagcccgcaaaaaaggaatcgagctaagtgatatctcctaggattccaaactcctgcagagttgttgccccttctttgacccatgctctcagatattgacacgttgatttgctctataacgttccggtttcttcagaaaacatgcttgggtgcagtactgaattcgacttcagaaaatgaatagcggttctattccacacttgtgacttcagaaaatctgaaaatgaatacaagaagtttggccaaaatatagatatcattgcacgttcagttgtactgtgccacacgatgaattgctccttgcaatttgggaagcacgttcctagctccttgaccagttgacgacggaccacactcccgtctctgtacgtacgtacgtacgttcctctttggtctgctgttccctaggaacgcggtgggtgacaccgtcggtgcgaccgtgcgggtgcgacactgcgacggaacaaggaacattagtcaatatatattgaagtataggcttcagcaatcatagttatgcatagcagaataaaatttaaaaatatattgttcattaatctttctttcagaaatatactggatgtggtttgattagcataaatataccatcaaaatcgcagttagaaagcgtgataccgaggttcgctacgggaaagcacgatatcaccacggtatcgcattaccaatacgcgagagcgtgacggtcttgcgcgtcaaatgggcgaggagatttgagctagcggtgtcgcttcttggttatacgatatcgacgcggtatcgcgtttccactgagcgagagcgccacgtcgtaccgatttgggagtaacagctggagtggtgccatcggtctcgcttattggcagcgcgagaatgggatcgctaccaggtttagacgcgcgagagcgcgggcccgcggtctcgcacggccgaatcgcaagagcacactcggtatcgctctttcaaagcacgatagcggctgtggagtgggtcccactgggttttttttagttgggagatcgggcagccgcggtttcgcacagtgggagcgcaatatcgctcggagggggggtgttctcgcgcgttggtttcgcgagaccgaagctgacatgacactgacaccctcccggccgtcaagcatgcactcacgcattatcaatacgcattatcacactagcaaaataatggaacaagtcaatagtaaactgcatccgaaaaagtttttcaattaagcagtgtacgaagattgtcgtgaaataagctgcacaccccttaattactaattgctcacgcgtgattaatttattttttatacgaagtttcctatgtaattaacttaggctgtgtttagttgagggagaagtttggattttggttgaaattgaagatgatgtgactgaaaaattgtgtgtatgacaggttgatgtgatggaaaaggactgaagtttggatccaaaatttggatctaaacacagcattaaccttaacaccattaggcgcgcagtgaggctcacctaaccgctctcgcgttcctctagcgcgagaccgcgccgtcgcagtcagggggcccaccgctctcgtgttcctgtagcgtgagaccgcgtgggtcgcggtcgcaacagttgtggggcccactggctcgctctcgcacttttagagtgcgacaccgtgcgctctcgctattcggcaaagcgatatcgttgcaccgcctaggccaccgcgtgcgctccgtcctcgctgactgaacgagcggtaccggcagtatatttttgcaaatcttcacgcgttcggtattttcttgcaaattctacagaaatacgtatatttctaaaaaaatttcatgcatagcaaagctaatgaactgtcatgcttttggttgggtcttgcaaccatgcaattataccgccgtttagacagaaaatgactaataaaacgttaataacggaatttatgtcctcgtaaacaactaatgtagacaacatagctctgcttctgtgtgtctggaggttgaaggaggaggaattttttttatttataattttttttattaaaagttttacaaaaaataattttccattttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcaagggggggcatggaattttgcaggcggcccccttgccgccctccgctagggcgattttgtactgtgggggggccgcctgcaaatgggcggcgagggggcatggaattttgcaggcggcccccttgccgccctggggaagggcgatttttgcctctcccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttctcggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagaaggaagattcggataatgaggaagcggacgacgatgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcatgaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgtcgacaccgatggatctcggtatggcataatgacaaccaatttggcagaggtatacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatatatcgcaagcaagccgtgcaggaatgtgtcttgaaggcggatggtggatgtacctgcagttgtatgaagccgaagcttcatcaccttccttgctcatacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggccaggcaagtgatggtaggcgaccacctggtgaaggaacaacaagcagcgcgcaaggccaaggcgtcgtcgcgcagcaggcgattccatggtgtaacaatgctttcgatttaggaaataaaatactgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgggggattgacaggaaccaccgctcgttcctgtcagcagtcgagggtgcacagctcggcaccttccgtccacgcacgtcgcgcgagtggttgcgtgtcgacctccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggatgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttctggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcaaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccaatacaaccacggcctcgcgcgcctaccgtcggagcaggacctcgacctacggcacctgtttcgcacggtactgctcagcccagaggtttcttaagttttgtttctgtttttctacgaaaacatcaccccgtcgtaacttgatgttccatcctcgcaggacctcgtttgccttcgagcgcccctagcttcggagcagtgcgacctacaacaccggtttcgcacggtacagttcagcccacatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgtccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggaactccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcttgttgacataaagtgaatcacgcccacgcgtgatcgtcttgtcacatctaatgaataatgtatctcattgagttcacatatattgcagtgaaaacgacgctatataattgacaatctgaacgcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcccccagggcggcaagggggccgactgaaaaattccatgccc

SEQ ID NO: 11567 - DNA, 554 bp, Oryza sativa
  unsure (1)..(554): unsure at all n locations
cgatttagccgatgtttccaaaggagaaaaggtagatgagatcccgaggatcatttcccctctatcaattcggccggagaaggaaaggagcggccggatttggaagggaacggcggcggcggcgcgctagggttccgggcggcggccgacgcgaggaagacgacgacctgacaggcgggccccacctgtcagcgggcggacgcgcgcgcgcggcggactgggccggctgggccgaggagagagagaagagaggttttgggccgactttcggcccaaagccaaaagaagacttttaaaacctttttcaatttaaattatttcttaaatgcaattccattttttaaaaatacttccttagctcaaataaatcccagaaaaatctaggaattatagaattaagcagaggattgaatgaannnnnnnnnnnnnnnnnnncgaactcgaatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11568 - DNA, 167 bp, Oryza sativa
gaaaacagaggttttctggtccaaacgactgctatctccataatccactaccttcaaagctaacaccaaatgctggctattgacatttccaacttccatattcaaggggttcttgttccatatatttatgggctggttgtcagcgcaacacttaaaaaagggtggct

SEQ ID NO: 11569 - DNA, 633 bp, Oryza sativa
acatcctcaaatacaaagcacttccctagttagatgtaggttagactagccgggcgagaaactctaccttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactatt

SEQ ID NO: 11570 - DNA, 591 bp, Oryza sativa
aacctgctcgacatcaacctcccggaggacggcaaccgcgcgctcaccgacgacgagctggttatgctctgctccgagttcctcgtagccggcacggacagcacgtccgccgcgctgcaatggatcatggccgagctggtcaggaacccatccatccaatcaaagctctacgaggagatcaagtccaagaccggcggcggcggccagcacgaggtctccgaggaggacgtccacgacatgccgtacctgaaggcggtggtgctcgaaggcctccggaagcacccaccggcgcacatgctgctacctcacaaggcggcggaggacatggacgtcggcgggtacctcatccccaagggcaccatagtgaacttcatggtggctgagatgggcagggacgagaaagaatgggagaagccaatggagttcatgccggagcggttcctccccggcggcgacggcaaaggggtggacgtgacgagcagcaaggggatccgcatgatgccgttcggcgtcgggcggcggatttgtccccggctcggcatcgccatgctttacctggagtacttcgtggccaacatggtgagggagttc

SEQ ID NO: 11571 - DNA, 659 bp, Oryza sativa
  unsure (1)..(659): unsure at all n locations
cagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgtccacacggtactttactttttattactactgttaaatacttgtacgaaactgatggtccttgtccagcaggatttgcagccgggatcttcggtactggggcctcttcgtctcacgccggtagggagatttcctcaaccagatgtgcatgaacccaaaggnccccctgtcctcgcggagatgttcgatgctagcaattggcatgcagttgagggtcttggtgatgaactcgatctcgtccctctcgacatccttcacgaccaggagcttggcctttgcgagataatggancgacagatcggtgactgaatcacgcaggatgcttttctggatgagcaggacgttgcatccggatgccttgatcttcttcaccatgccaaggatgtaattccgctcctcgcggaggattcgatccatctgcgcgtaatccgacacgacgacgctgtgctcgatgtccgtcttgggaggcgagacctggaact

SEQ ID NO: 11572 - DNA, 3595 bp, Oryza sativa
  unsure (1)..(3595): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaataacgacttacacaaacttgtaccttgtttcaaaagtttatattttcatttcttagagtacagtttgagtctgagtcggtggaaactcgggcacatcttctaaagaacccagaagtacatctttctcattgtcagcagtaagtctaaaaggttagtcgatgcttctttcaagtggcataggaaagtgcatactgggtaacattttctagatatttttccaattccttttctccactctcaagagtctcccaaagtgatttcctcaattcctcgtttccttgactttttgtaacaaggtcataagcatagcgcataacatggctgcagtatgcagcttcatcatccatacattcttgataggatgattcatattgctttggattaaaaacacacttcttagcacctttggtccacctcttcagtatataggtttctggaatactgcacacattcttgatgctaagagctttaagagcatgtggacaaagcaaacccattgtttcaaacttactacagctgcaattgagttgcattgtcatcatatcaaaatgaactgtgcagactcttgatcctcgcccttgcattgtcatctcaaattgatatctgttattgtcttcgcaatgaagctccttgaattttgtggctccacatccatcaagaaaatacgtctcaaacaacttgtagattctgtatgtataaacttttgctgcatgattcaaaatatcactgtgctttataatacaagcaggaggcttttggctgcaccgcgtgtcttcatcgatctctttttcacgccaatcttcagtcaacttgttcacaacaacaacaattgtagacggagaggtaaatttctcggcaatgcagttaaagatgttactcagactgtcacattgtggctcatattcaaccccaccatcaaaagtgtgtttgttgagagcaccacaccacttctgcttgagtttataaagtttcttaagccatttgttatcctccaacttaaactctctgagcatcccagcccatgtttcctcaaactcagcttctgagtcacatccctgcatacacttggtgaacagcttattaaatgctttggaaccattaagtgtaccaagacgagaagcagcattcttttgtatgtgccagcgagagatgcgatggcatgtatttggaaatacttcctcaattgcctttgacataacttgatcttgattggtaaaaatagagcgaggatgccgattgcccattgcctccaagaaagatttaaatagccacacaaaagatgacatagactcgtcagctaatagagcacagccatacatggtgttctgccaatggtggttcacaccaacaaacggagcacatatcaaattatgtttgtttaagcgataagttgcatcaaacacaacaacatcaccaaaacagtcaaagtcaatcctgctcctgccatcacgccagaaaaaattagtcatccgaccgcctcggtctatttgaacatcccaatagaacataccatcttcatttgccctgctcttaaggtgtcttacaaggttctgcaaatctgcattccctatggcaagtgtccttgccatactaatgtagcatgagagtgaatcttgctttgacgtctctacagaacttgacctccctgctataagtgatcttgcagaccgtaaaagatgtcgttcttcaggtcttgccaagttgtggttgtgatcagagaccagccggataaccttccactccccgtggttattcactctgaagcgaaccatggccttgcaattcgtcctagtatgtgggtcattgaagtttgcatcagtaagcctctccccttccttcaggccctccttggagcagaagtaatccttggtcctgatccttttcgtgccagtaaagtaggactgcttcccctttcggatactgaaccccatgcggtgcccatagtcacagtacagcttgtacgccgcctcctcgctgtacactaccttgcggagtagttcctcggtgccctccttgctgccatgaaccgttgctgcctcttcagtctcggcttcatcaccatacgccctcatccccatttcatcaccagagttagtaaccgccccttgtccttccatgaccctgtcgccaccagcatcgtcatgctgcgacccaattccttgatctacaccaacgcccgtctcaactgcgacgatagcattatcgtcaacacacatcggatctccacccccgccttcacagccaccttcaccgtcagtgttcaccatcactgcaaaaccccgagataattgggatcaatgtgtcaaagccacatcataaggcaagtgtaacaacgacacacctatcatcattcctatatatcaaccgaaaaaatcccaaaccctcacatagatagaaataaaataaagaaatgcagcaccttcctaacggacatagtggcggatctaacataggacatggggggttcagtttttgggaaaccatcaaactgttagtagtattaaggttaaggcaaaatttctagaacagaagttagggttaacgcaaattcgagaaaacaaaagtgcgtgggtagagagagagatgggagcgtaagcgtaacggatgcggcggaagcagtgggacgagcgacggcgaccctgctcgctcgctcgctggctggtgcgacggatggggatcggcgcaggcggcggtggcggaggacgtgctcaccaggatggatgcggcggaagcagctggacgaacgacggcgccccctgctcgctcggcgggatggatggggatcgccggagccggagccggaggcggcagcggtgggcaagggcaaactgacgaggaggcctctgtcaggattactccactcacgctgtcacgcaagcacgacagaggcgtcgaaatggcgagggtaacgtagtaatttcgcctagcactcaatccacccggattgcttgcacaccccaccaccactctacccaaacggtgaaaatatgaaaaataaaaataacggaattgctaaacttcaatcgacagaaaacctacctccaaatcttgcaaattttgcttcactagatatgcttcacgattcgtgctccagctgcttcttatccaactccgacgaactcctcttcttgtctggtgccggcgacaacccaatctccgacgaattagggtcctggggtgagatggggtgggagggggaggggaagaaaggggagttcgccgggcttagagggatggtcgtgggaggcggcggcccggcggtgggcggcagaacgggtgggcggcgagcgtcggcgccggtggcggagccgtcgggatcgaggagggtggtggccggtgttggtggcggggggcatagcgagcttgtatcttg

SEQ ID NO: 11573 - DNA, 5659 bp, Oryza sativa
gggggagggggagtgggaggagcccggcccgggggggtgggcctcgtcggcgccgttcacaccttccggccagctggcgaggccggacagcggcacgctggggcggcggtggaggcggcgcgctcgcgctagggagagtggcgatgtgaggaggaatcgggagatgaggtgatgttttagggtttggttgcctgcacgaatcttaaagcaatcggatggtctaaaatttgcaagatttctaagggggttttctatcaaatgatctatagacagtcccaaaaaaaaaaaaaagagtgtccatcagtcctaatcccaaattttcaaatgaagcctctggagtcttgactggctcttatgaggcgtggctttttattttaatttttatagggttgatatgataggtaaatataataggtacggttggatactgctcgattaggcatggctcatcaaacagaccgtgccctgttggcctacatgctttaggttggagctcaggcatgacctagtgagatgttgagttatgtcatttggcctgacacgatgtcacaccctgaaaattcaaaatatataaattgttgtttaaatggaattttttagaatttattttttaaaagtcttgaagagaagatctaattttaattaataaattccaatataaaatggggccagataaaatttcattaaatactttgcttaattctataattcctagatttttctgggatttatttgagctaaggaagtatttttaaaaaatggaattgcatttaagaaataatttaaattgaaaaaggttttaaaagtcttcttttggctttgggccgaaagtcggcccaaaacctctcttctctctctcctcggcccagccggcccagtccgccgcgcgcgcgcgtccgcccgctgacaggtggggcccgcctgtcaggtcgtcgtcttcctcgcgtcggccgccgcccggaaccctagcgcgccgccgccgccgttcccttccaaatccggccgctcctttccttctccggccgaattgatagaggggaaatgatcctcgggatctcctctaccttttctcctttggaaacatcggctaaatcggtttggaatgtgtttgattcgagttcgaatcagatcggtctctttccttcaaaccccgatctttccttctcgtcgccggccgccgtgggccttcgccgccgcctcctagcccctttaaaaggctccccggtgtctcctctacccgccgccaccctcgccttcgcctctcgtcgtcggaagcgccctagcgccgtgtgccctagcgccgccgtcgccgccgtcgctccagccgtgcgccgccgccgttccagtcgtcgccgtcgctcgggaaggtcgtcatcgtggtcgccaagtcgccgccgtcctcgtccgccgcttcgccaccgtcggagaccgccggagcatcgtcgccgtcgtcaagccgaagaccgccgccgtttcaacctcgtcgccgtcgccgtccgttggtcttccgccgtcgctttggtcgccggtgagttcgccgcgtcgcgctctacccgttggtgccctccgttcgtgccgaagcgccgccgttcgccggcgagcatgcgcgcccgagccgccgagccgccgccgccggtggtgacgtcaccgctgacgtcatcgggaccgtccgccgtgagccggtcgtggaccaatcgatctcggccgtccgttttggatcaagtcgatctcggccgtccgttcgcgtgaaccgccgccgtgcgcccggtccaccgcaaaccctagcccgctgacgcaataaatccctttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgcttttgctcttttctgcttagattccgtcgtttccggagagtccgttttcgccggagaagagtttgaagagttccaaggccagcaaggcaagtcacacagatcccaaacaactctttgagcatgttgatcccgtttaaagctattgtttcttttcaactattgcatttattttcgaatgtcattgggtggaattaacctattgtttgttatggcccttttgttcttgattaccttattccttgataccttgggttattataacttgactggttgagctctatatattggttcaactagatattagatataattgcttagccctgcttagaaacattagcacactattgggataacttatgactcactattatttaatgatggcttaatgatagttcacgatggtcaatcgtgattagttaattaattcatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtagtacacctctgatcagagtaaaactattcgaatagccgtgcccgcggttatgggcgggtctaacaatgtctttcgtgattagtctcacacttctcaccatagtaaatgatgctataattggtaataatttgtttagctcctggtttggaatggtacattcctggtttggagatagaactgtgcagccgggatggttgttcagaatggttgggcctatacaacagggtatgttgtatagcgttggattaatattgtttaatacttaactgttttactaaattctcaaatgtttgctaaatgctgcttttgcgaatgcaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatctttattgtttgagaggaactatctacctctgtaatgacattttattcgcttattaattagagtaataattgtactctattatcaatttgttattgtgtgcctcggctgattcctggacgagggtttacacacatgtaagcgtttggaattttggatagaaattccgggcgtgacacacgattaggttacgttggctacgtggaggttggttagcccaaatttgatatataccaagaaaaaaatgtgaacatagtctgttgcatcctgctgcacaaacttcgatgaagctttagcgaggctctccgctcaccgatagcacattcctcttcctcatcaagaaccaccatggcccttcacttcctacttccttcgtcccgagccggtgagctcccaattgctgacatgcttagtggttgtgctcgtgaatagggttggccacaccacaatgctactatgcaggcctacgccaatgagcgttcatcattacttcctctttcctgatcccctagcttcctcgattctttagttctcatttccccctatctcctgctcgcgacatgcacttgtcgtgttggcatgctgggccggtaacaacccaagcacaacgtggctagatgggctatgccaacacaacccacagctaaatgaaatgtgttgttcttgggctgtgagttgcacatgcgtgcctgggtggacacagaaagacccaacacatttgacaacatataggaggatttggtaaacgcataaccattcttatgtttctacgtatgagatcaattaagacacctcagtcgcacctaattaatttgattagtgtcaaattaaaggaaaactattctttaaagatgttctcttccattatactccctccatctacttttgattgtcatatttccaaatctgaaaaatttatttttgattggcatatttcaattcaacaacctatcatcttaattactttctcggatttaatgcatgactctccatttttccacacaagattggctacatggatattgagaaatgtaaatattaatgaatcgcttgtttatgagggatgattagtagcatgtttaaatgaatgataagtagaattacttatccttggtctgtgtgtcaagatgaaatatgactattaaaagtagatggagggagtagcgattacgctccaactaacactaaaaaaataacactctttttcccaaaataacatgcaagcacaatataatctagaaaacatatccattttcttcttgtttttattagatcaatttcaactatgtgtccagaggcaaaaaaattatttcaatacgtggaatgaggttaaacagatctcatgcatatatacacatttgtgttgcttatctcgttggtgaaaagaaaaaatattgtctccctaaataaacacttgtcaagaaataaggtttattccacaagctatatacaaccttgctatcttaaccatccaaccattacaaaggcactggagagcctatttggtagtaataatttacggtgttaacatatcacaagataaaaaaaaagaacaggataaaagaaaaggaagacccaaggcaacaacagaaagttaaaagctacaaagacaaactaataacgaaaaggatgcgacatctcatcacccccacaactaccacaaagtacaaacatgcacaaaaacaccctcttgccggcaacagcaaagcttgaactcaacatcttatcagctcttctgcaagtcacagctggcatgggcttgcttcacctgcttggtgtactcgtcctcgctatcgccttcctcgccctcctcctcatccctgtctccctcgtcgtcgtcgggattcttaccgtcctcctgctcttcttcctcggtccaaccgaaaccggccactggagtcgacgatggaggtggtgtctttgcctcttgtacaatcttcatgatctcgtcgacggtctgatccgagaatgtacgggcactgttgtccttcttgtagtacttcgcttgcgccgcttctgtaagctcccgcggcaagttcttcataaaccaagggtggtttctgatctctcttattgttattctctgcatgacatggtggaaatggtattatgttaaatggaacataatggaacatggattgaagttccgcgaggttcacctttgcaggattcgcgacaaagattcgagagaggagttgtctacaatcttgggatatatggacgtactctggtattttgtactgaattgatacgattctctgcaaaataaaaatgtgagcataatatatttgtacattcgtgtggcgtttgaagttgga

SEQ ID NO: 11574 - DNA, 23131 bp, Oryza sativa
  unsure (1)..(23131): unsure at all n locations
cagcaaaggcaaccaatcttgcatgctagaaagaaattcaattggtagtttggcatggtatcccaaaaaagtatgaaataaagtgcaatagcaattggtcaaataacatcaatattaaccagacaaactacagatggcaaaatgaaacgcccaaaaaaaaggatgaagaaaaacagtcccaaaggaccacaggttaccaaccagatgttcagtctaagatggctacatgaaaagatcaggtctgagggcccctattgtacacatcaacatgatggaaatacggtccagaaaaggacataaagcatgatgaatgggaacacaattcgattcatggaacatgtccacggggcctccccacgatacatagatcatcacgcgcaaccatttcaaatctgttcatgcttttttttttctatgtactacctctgaagaaataactacattattgtttttggaactccacaatttttttaggcaatatgaatcctatctgtttgctggtcaaggattcaccacacaacaaagcacacagcgattttgtttttattaatcctcactatcaagcagatcattaagcatgataacaagatctccatcaacagaatctggtgctcttatctatcaaatctaactttctttttggatcatcacatcaacaacaccatgcgagacaagacttcaccatgtataccaactgtgaaccagatcaagggaacaattaaagcaggcacgcacccggagggggcagagatcaccatcaagcatgctgtgattactactccatccgttccaaaataagtacagttttacactattcatgtccaaacgttgaccgntcnncttatttgaaatttttttgattagtatttttattgttattagatgataaaacatgaattgtactttatgggtgactatgtttttttaattttttcataaatctttcaaataagacgaacggtcaaacgttggacacggatccccacgactacacttattttaggacggaggtagtaaaaagaaaaatgtcccagcgacaacatcgggaacatttcggtaggatatctcttcccccctctttgctcctttgacaaaattgtcaacacaaataattggaggagcacttggaagttggagcttggaaaactggaatccccaccccacagaggtaaggacaaagaaaaacactggcaattggggtcaggtccattccctgtctacttgacctcagaacaaaattccaagaatgtaaaaccactgattagagaggtgcccccatgataccatgagcctggtctacaaggcatatatgtctgctacgtttgggttcacatactaaaactccagtcctggcattcacatgaaaagttcagactacgtttgggttggggccggagggactgcagcaagctagcacaagcataggtgacccacacaaggttaatttcaccatccttaaaaaattacaatacattttctagtgtgaaacttcttagttaccttgggatattaaaattttgcgtgtaaaattcaggtgccttaagataacacaaggattgagcacacaccaaaaaaggaaagaaaagaaaaggattaagcacaaagtctccagctgccctggacacaactggagagacaggcaagctagaggagcaagatgactgagactgaccttgccgtcatactcccggcgagagagcacctccggagcgatgtacgcgggagtcccgaccgtcgacttcggctttgagtgcagcagtgatgactgaccacaaaaacattcgcaaaaagaacggtcttagtacgcgtaagtaacccactatagagctaaattaaagagcaataaatacgatattttcgtaagtctaagtgttctttttgccatcagttagttcgagtgatgtccctcttttatgtacgtgaagaaactaaaggattgcttgataacatcatccgataaaaaagactgagaaaaaaaaagggcgcaaagtttgattctcaatagcggcacgagtttaataaggataatgaggatagcgacccagtttcgtgtcaaaatttttgtcctcccaacatgccaagttcaacaaggaaggcttctttccgtatacctttctaccaaaaaacatgcacggtatgaaagaacataaaaatcttccttttttttaaaaaaaaagagagagaagaaattgttaccttggagtagccaaagtcgcagatcttgaggcgcggcgcagggctgccatccagcagcgtgttctccagcttcaaatcccggtggcaaatttgctgcgagatcaaacaaaacacgcaatcctcatcagcttaacattttgaaaaatttatacttaaagctttttttatattaacagaaaaataacaaattattgatgtcctcaccatgaagtggcagtagctgacgccgcaaattagttgctggaagaaatacctcgactagaacagtagcaatccacacgtcccccaatttgaaaacacaaaattaaaattagcacgcaaacctcacgaatttttgagggggcaaaaaaaaagagggaaaagacttgggacccgtctaattcgaggagattagatgatcacctcgtcctcgctgaatctcccggcgctgcagatccggtcgaacagctcgccgccggcggcgtactccatgacgatcgcgaggtgggtaggcgtgagcacgacctaaacaaaacaaaattcccccaaaattacgaactaaattttcaaaaagaaaataaaaataccgagcaagaaccgcgaatttctcagaaatcccgcgaattccgcggccggcctcacctccttgaaccggatgatgtttgggtgccgcagcgagcggtggtttatgatctccctcgccacattctcgtcaatctgcaaaaaaccacccgcaaaccccgctaaaaaccagccaagaaaacgagaaattaagaagaagaaaccctagctcgcttcgaatcacgcacgcaccttgaggccacgcggtatgtacttcatggcgacgagctccttggtctccctgttccgcatcagccgcgccacaccgaagttgcccgacccgatgtccttgagcagctcgtacttctccatggcggcgcgggatcccggacccgtcctgcctgctccgatcgaattcggcgccttccttgcttgctcctgctggttcttggtcttggagaggagaggagaggaaggagggaatggaagaggattcgaagcttaacgaggaggcttctgttttatactcctatttattagtagcggtttctctctcctcctgctcctgtgtgaaattgatttctctcattttatggtgggatttggccatttgggtgtgattagaagttcttttatttttggaattttctaagcatgatttaacatgtacaaatggtttgatatgaactctttagttaatacttacatatcactaaattattcaatatataattgctgagataaccattttagctccatataataatttttttaataaatgctaagagtcgactctgagccgttatcgtgcgtaaaagcaaataagtctctatgtgtaaaaacaaatattgtcctctgacttgatcactgatacgtggatctgtcacgtgtgtgacttacatgaaggtgcctacaaatcaggcgctcgatttttcccaaaaagtctggcgttgtttcaccctttataaaaataatgttttagcacttagcgaaagaatgattcaattcttaaaaaaatgtgaaacatagtgagatcgctaaatgaaacaatttggttcaacgtatgtaacaaaacgatttaagccattgaagcacttaaaccccatgtacatctaaacaaaccccgtgtacatcgagatgaaaatattaaatactatttaaaatccactgtaacatttgatccacccacaaagaaacatcacgagtatattagctgaaacattgcttttgaaccattgaaacatcaacaaacccgtatgtcaaaaatagaaatatggaacactgtccaaatatctattgcaacatttgatccaaacacaaagaacatcacgagtacactagctgaaatacacaaaaaaaaacacagaacctggtctagactgcatcttcctcctctccgacgaacacagggttgcccgcgtcggtcttctccacggcccccatcaccggatctggaggaggagaagggggaggatggcggagatgaggagggagtgctcccaggagagaaagagggagccgacgagcctcctccaccaccactgccgccaccaccgcttcgctgctcgtgcgtcgtcctccgcgtcggccgccaccacggggacgaagacgctgtcaacgtcaaggaagacgaaaagcggcggaggatccgacggagaaggcgacgtgggcgaggttgacgggagagaggaggcagcgcgggtgaggttggcggggggaggcgggaggaagcagcgtgggcgagggagctcgtggaagaggaggcggcatcgacggggagaggaggcgacgtgagcgagggagcgtgcccgatatttttctctttcatcgggcgcccgtgaataaggattttcagacttacatgttagtcacttaaagttaaatggtagtactacaaatgatctgtattaaagttgtttctttttcacgtcactaagagttagatcatctccaataggttagccatcccactctccaagctaaaaattagcaaacatagcaagaaaatgaggtccaacagcctctccatttggatggctaagccatctcgctggccaaatgaccagctcaggtggccaaatctagcaagctagtttggctggccaaacacagcatcaatggctagtagctgcaatctcattcgcctctcccccatcgacgtcgagttccttctccagccgcctacgatccggccgccaactcccctccagccgcctcccccttgccggccgccgcctcctcccgggcgccgtcgacggcaagggagggagggctcgatggcgagggatggaaggcatggcggcgagggagagcaagggaggccggcgaggagcaaatccacgctccagtcgccgtcgccatccccatcccgagctccccccaagccgatgtcgccatccccaccctgagcttcgtcgccgcccctcccaagctgatgtccctgtcgcttgcggactccctgcgccacctcctgcctccccacgccgttggcatctgcgtggtcgatgggaaggaaggaaaggggaaaagaagaaaagagaaggaagaaaggggagagagagagagggaggaagaagagtacatactgttgttgtgggtccattgttaatttagagaggatcaatagagagtctgttaaagtgagcatctagtttgactagccaaattagatagaatccgatttaaagaagctagtgaagatgctcttacatgcaccataacgaagagagcacgtcaatataaatctttgtacatgcaatccgagtgattattgttaacgttgatctgagtgattaggattagcatatgcggtgattagtcgacgtgtattggcgaattttgtagaagtgttggaaacttggaatggtacggcagttgaaaccgcctttgtctccatagatatagacaacatcacattactgatagataagttcaaaataaattctcttgtacagtactgcaccgttcgaagatatatggcgtccttttttgcagagtcaacgaataaaagttttaactagtaaccaaacttacaaatatatgtatttagtgttatgtagtatgtagtgtcactgaatttatatttaaaaatatttttatatatattaattttgtagttgttgataatatattacatattatggtatctcgtttcatttaacatcaggtttagagcccattctaattgcagaaataaaaaaacataggattagaaaaagcataggattccataagattcacctaaaaatcatatataaatgaaatcccccaaaattcttatgattttcttttgaatcaaaggaggccttactacatactttcactttactacatgctagattaaaataagtttcactttacactaaattgtgtcatataattgaaggaaaaatcttgtgaatctaagcgaacattatcaaactttttcaatttagaccacattttatgaaatgttgttcaaatttcatgaaatttatataggttttatggtgtactctgatgttaagtaaaacttattttaatgtactctggtgtaaagtgaaagtacatgctaaatctgatacttgtacaatgtaaaacaagttacaattaacttggtgaaaattacaatttactatgtattataggataaatcaatagttatatactccccccgtcccaaaaagactcaatttctgggttttcatgtctaacgtttgaccgtccgtcttatatgaatttttttattattagtattttcattattattagatgataaaacaagaataatactttatgtttgacttatctttttaaactttttcatatttttttaaataagacggacggtcaaacattagacacggaaacccagaaattgaatttttttgggatggagggagtagtatctaatacaccttgtatttctcaaggagaggaggtaaaatctgaaatgaattggttcgatatttgtgctttaagtcgtcctttcggggaaaaaaaaccagttgtctactcatttttcccatctcttctctcttcaccttaggaaatatatatatatatatatatatatatatataatataattcattccgttatttgaaataaaagaagctatagccaattattacagtgaattacctaacaatagtttgaattacaaaatcacaatttaattaaaaactaaaaaaatatttagaacaccaaactaatgacagagataacactaataacttctacctatggttgttgaggaattgcataaccgttgtatcttcagtagtacgttgtaagaagacattgtctttctcaaattaggaaatataatctccaaaatcagtggccaatcattgcactggtcgaatttcactcacatcaccgccgacaactgatatcgaacaaatgtggaagatatcgtcggagaataactttagtgcaaatcaatagctcgcccaaatcttaccacactgccatagccattaaagccactgagctgacgtaggttcccaacaatgaccattgccgcacaaagaaggtcctccaaagcgacgcctcagaggaggacacgacgtgagatgccgctaccactctaccaggaccaaagcaaaaggttttacctgaaggccaatgtggagggatgggaagaagtgaggatgcctccaagaagaaaaacgatgctcgaaagcatcaccgtcatcgaagctagctagaatctagcaaggctttcaccattcgacaactccctcatcacacataaccagcctacatgccaaatagtaacattgtcatccgcaaaagccaaagttgaaaccacagcaacatcgtaccaccggcaacccagcccctcgaagctccccacaacctagccaggaggccaaggaggagtagtgatggagccaagaaagcttgcaaagaaagaaactcactatcgtcatctgtcgttgtgtggctaaatccggacgtagaagccctagatccactggctcttatccctagagtcttcactatcgcactagggaaaattggaaagaggaagccccgccaccatcatccttgccattgcgtggctagtaattagctcaagtggcagcaaggcggaggagaggacaaatataaccaacagcgttgtctgttgatcgccacccgtgtcacttacgagcgacgtggtaggcgggggggagggggggtgaaatccgactagttggttagtatgcatatcttttgacttgttggggaggtaccaaagtctatgcattggtttcaattaacgcgtaaataatttaagttactagtacaatggaagtaaacatcgacacatcgtagcaatagaaccatattcgaaattttgaacatcccctcgatcaagagaaccatgccattcaaaaactatgagttatacaatcaagagaatcacttaaagtttaacattccatctcataagttttttttttgaaaaacccataggcaattttgttgtaaatgcccacccctatttagttttattgaaaaaaaaacaccccccaatatgcacgtgcttaactgaatcacatgttttcataaattgtgagttatcaatgtgatttttaccaaaattaaatacttctaagattataatcttaacaattttcttggagatttcataaataaaattattgataagaacttaaacattgtcaaactaagtttcactatatgcacacaaaaattcagtgaaacatgagaataagtctaataagtatttggataagattgacttgactagcttagcttagggtggctcacattggtgataacggactgattcggttaagcatgtgtataatggggattttttttcttaacaagactgagtagggatgggtacttgtaacaaaataacttataatgtcgaatgccaacctttaagagacttatggggtgttttgcaattttcctaaaaaaacatcagtcacaaacatttcctacatggcaatcctaaacatacataatcatatcgttgatgcctaaaaatacatatttttgtgttgtcaatgagagccggtcttctaataagttaaacacaagtaagtgatcgacaaacagattttcctcccggacaacgcataagatattatgacggttccaaattgatatgagatccacaaagatacgattttcatggccaaattgcataaaccatagggcacgtctctctgagatagctgatcaacgaaggcgtaacgaccaacgagagaaacacctaattctgtaccatttgattacctcggtaattaatttaggcaataataatattaatttgcataaggtcagtcttaattaaggtggcatgagggggccacgtgggaggggggcgaccggacgagcgtgtgtgatgatcatgtacgatgtatatatgtgtcagctaccaagcacttgtttgacttgtttgaggctggggttgatggtgatggcacacctacataatctctcttctccttctctccacacgacaagaaaacacgggctgtgtttagtttcaaatttttttcttcaaactttcaacttttccgtcacatcaaatattcggacacatgcatgaagcattaaatgtggacgaaaaaaaaccaattgtacagtttgcatataaatcgcgagacgaatcttttgagcctaattacaccatgatttgacaatatggttgtcagggttatggataccacatacctaatagtagttgactaaatctcggcaggacccaccacataccatgtcttatacggaaactgacttcacgtatggagggagttccggataaggaaagacaaccagagttctacatagaaacgacatgaactactcggattatatctatattggtttttctagttctacttggataaggggacacctatgggtataaatacaaggccccctaggaggagagagacccacaatcaacatacacaaaacaatagatcaagacagaagatcaacatacaagccaacatataccaagacaagacgccggatatcgacttcagggataagcacggctagtcccctacggtgtctccgggtactgtcaggagagacgaaagcgctatctctgatctcgccgggcacggattcgaggaggaagactaccctgttgtcgactacgagtcagaccttcagaccgtcatgtcgacaacagttagataggctaccgcaaatattgtactggtgtgattatggtgaataagagcaatatcggcttcagccaacaggatgtagggttattactgacaattaaggggcccgaacctatataaaaatccccgtctctgtctcttttacctcagtctcgcgtatatcctagtaccaacgatcctcatactatgcaaataccggaatcgcgacatcaaatgtcgacagttgcgcgccaggtaggggatcttttggtgcttcaaggtttcgatgagatgggtttaagagatggattctccgacaacgagctactcgacgacttcagctgagggggagatccaacctaaccagatcggacccatcttcgtcattacgaacatgatccattgagatcatccaagcctcgagcgccgcggcgcaccaaaagatgtcagatcgcagtgatatctctctcagtacgcagctaaggtgattggtacattggtcttctaagtcgacctgctaagttcgtagatacatccggcatgtatctacaaaggtacgcaatatttgatctgcaatttatcgtacctattcagatcatacaacattgttagatctatgatttattatgtttacctagagcatgttttttatacaatatctgttgcgcgagtgtccccgatgttaattgactacggtttaatgctgggggctcgctctgttttcttctgtataaatcatgcttgtttacggtttacataatgcctgatatttacatctgctcgttatgtcctgataatgctagaagatccatgcagtcttttgagtacatactcgatattctctgctatatgtcttgccttctagaaaatattcttcaggaacaattgagcacccgagtaggttgtggtcgagtacaccacattatcgagaatgatctcgacaaatgcagagtcgtcgagcccaacctgccaaggaagaccgacgacctatctcatagcaccggccatggctggactactcgagaaaaggttattaatggataattcctcgcgaacgtcgtcggcttgatcacccgatatgattgcgaacggacatccggatatgctataagttgggtatgtgagttatgctggccacatgatatgcacatataataaaccaactttagcgcccctataggtgataaagagactcctactcctggttcaatctctctcgccttacttctagtggtcgagttacgactactacctggtcctcgaccagcggtgtagcgattctcccactatttccacttctaagtggtcgagtttagactactacctggtccttgaccagcggagtaacgatcctcccattacctctactccaacaaagttgatattaggtatacaatatcgccaagtgttttacctagagatcccttaccacgatgacacctagcgttgaaacctatcctcatgtccctttacgccgtcttgacaagacctctgaggaacctaagggaacttcggctggggacgcccagagccgataaggccttgtcgaatcctgtagagacaaaagactgtgtaagatctggtcgtgtaagagttctcgcagtgcgtattaaccaagccatgtaatcggaaattgggttttccaacttcacggctgggggctaggatcagtgcttgttcaatcgaggcaggtcaaaggtccaagagccttatctcccgagaataattctccgatgacaaggctgggagctaaggagagtgtatgactcaacaaactgactgatcgaagtcggtaaaagagaagacgctcatacacaaaacattggtctgtaaatttaattcatttttagtttccatatatattataacatgtcaccctttgagcgtttgctcgggggctatttctatctgatattttttttctgagtgttgatttcaggaaaattctattcgacattgacgaagactccatgtctctatggttctacaccaagatcgactaaggcgagtacgacaaatgttgacaaggctccgtcgtagattctgcgccttctcaatcactcgagaatggttggtggatctcgacaaggaatacggaatgaagagatggtgtacccgccgagataaaatttcttgacttcaatccaaattctcgattacagcaagacgggagacttagtcgtctgttctgtactttcttggtcgacgtcggagattgactcagacaaaccctttaggtgcccgcacgaggctgataaaggaagtctaacgttatctccgaactcatcgagaacggtcacgtgagctcgataacagttactccaaggcctgcacgcggttgagaatatgaattcgttcatttgcatcgaagtcgggggctactgtcagggttatggataccacatacctaatagtagttgactaactctcggtaggacccaccacataccatgtcttatacggaaactgacttcacgtatggagggagttccggataaggaaagacaaccagagttctacatggaaacgacatggactactcggattgtatccatattggttttcctatttctacttggccaaagggatacctatgggtataaatacaaggccccctaggaggagagagacccacaatcaacatacacaaaacaatagataaagacagaagatcaacatacaagccaacatacgccaagacaagacgccggatatcgacttcagggataagcacggctagtcccctacggtgtctccgggtactgtcaggagagacgaaagcgctatctctgatctcgccgggcacggattcgaggaggaagactaccctattgtcgactacgagtcagaccttcagaccgctatgtcgacaacagttagataggctaccccaaatattgtactggtgtgattatggtgaataagagcaataccggcttcggccaacaggatgtagtgttattacctgacaattcaggggcccgaacctgtataaaaatccccgtctccgtctcttttacctcagtctcgcgtatatcctagtaccaacgatcctcatactatgcaaataccggaatcgcgacatcaaacgtcgacagtggtgctatagtaaacatttgctaatgatggattaattaggcttaatagattcgtctcgcaatttacaggcggaatctgtaatttattttgttattagtctatatttaatacttcaaatgtgtgtctgtatacttaaaaaaattttagtacacgaactaaacacagccacgattaagttacatttgatccgtggtaaggttaagttctcaatttctttttatcagattattatcggccgcagttaaaatctattttttttttaaaaaaaaaaggttgatatttttgagaaaaaaaagttgagtttgacagttattttgtaataatctacttttagcatagttttgaaacctctaataatgtagatgtgaaaaattagcctataaattcgccgttcaaaaaaattagcctataaatttgtttattttttcacagtttatcaaccggagcccaaacgatcgaagtagatcgattgaccctataatattttagtaatatttctaaagttatgcaattattataagtttcttaatttttaatgtagaattgacctaaaaccgaaagatgccaacctggatgaatatcatgtccaatggcttttagccgagaggatatgttagagacagttattgctacttatgtgtagtttgtacaagtagtaagttcttatggtactccaagttcgcattcggagcatgaaaattattttccatttcagccgaaataaactagtactcgaatataatgatttctacgttgtttatcaattcctaattaaggtaaaaaaaatttaagtcatttcagttattgattttaaaatttttatttacttggatttcctttgaggcatccgattggctttagaatcattgaaataatgataatcatgagaaacagcgcgcaattctttatattatggtataaaatttaaattgcaaaaattatcatattttggaacgcatggagtacttccctatggtattccatggaaactttcatactactacaatattcgcataaatatctttttgaactgtcgtaaatggtggttatgtacaaagatagagcctaatatgtacagttagataatacatatttatttagcggatatacctctacaatagttgacataacaaaggttctaatcattaaactaaacaaaataccacttcctccgttttttaatagatgacgccgttgaattttaaacacatttctgaaccattcgtcttattaaaagattttacgcaaatgtataagatataaatcatgcttaaagtatatatgtatgataaaaacaactcacaacaaaataaattagaattatgtaatttttttaataagatgagtgatcaaacgtgtgacaaaaagtcaacggtcatctattaaaaacagaggtagtactattttattactgttatttcctttttcgcaccctagtaaagccaagcaccctagtaaagccaagcttccattttatagagagcaaataatcgttgttgttaactgtagaaatgatgtttttcctttcttctttctatctcttccattttagtaaagattcataatcaatagtctcattaattaccattgtacacaccctaaggccccaaccattggtatatgccgaagggaatacttcggcgacaaagggaatttcggcattatgtaacgtacaaattcacaaagaatgtgtaggattctttatatccaaatattgtcccatttgaacgaactgctgggcaaatgcttcatacgacgagcactctgtagtggaatagtgccatttttattctgggaccaaaagattctctactgtactaggttatctcggccccgcctgtttgtggattactcctactaatcaaaaacaattttagagacgacaaaatgactaattttaaaataaatttctggcaaaacttaaaatcagcttcgaacaaccagcagcattgccagcgtccgtccattgccagttgccacgatgtcaccgcaatggcaaagaatgatcaaagcaagcgacctgacaagacacgagtgaccaaaatgccaactgccacggcacacgtggtcaccaggctgcagccccaccgtgtgtgacagttacaccaaacagaggtcttaacatccactgtgtgcggtagcagttgacacatcaaccacgcggttatcatcatcaattacagtacatgcagtagagtgtatgaaatgctatcacactccaaatcttcgtcgcaatgcgtgcagcatggaaaaaatcttgagccaaaaacaaggccattccagaattcatcccctgtttttttcaaagccataaattaaagccgatagagacaacttgcatggcgtgccatcttcacagtttgatcaggccacaatgacatagtttctgaatatttggccaatcaaccaaactatccaacggagaaagaggcgaggctgtacaggaaggcggcatgataatctcaggccagcttaacaaatggaacatatcagtctaagacatcacagagaaggcaaagcgattaaacggtgtatccagtctaacctaatgttttcaccagtgctttggttcagaaaggaattgagctacaaatgcaaaggggggcaaagaatagatggtatctacgtggccctatttacatttcaaaagtaaactaagcgcacaaaagtcctagggcgttattatagcaaggaatttaccatgttaggctggcttctggctggctggtggattcaccttgctagccccgttcaccgctgtgttggcccggttgttggctggtgttacggtgccaggcgccacattcttgggcactaacaagttgccctttgagctcatgctttgctgcttctggacagtactttgggtgcctgtggtagcaggagcaggtgccttccctcctaatgatctattcagcacgccaactatgccgctagacatcccaccctgtggaactggagctttggtctttttcgcagttgctggaggtccagcaaatacagggttgcttttgccaactgtgggcagcgtcttcagctgttttttctggctgccaataacgctttgagcttctggagcaatcttggcagccttgctcttatccacattatccttatttaagcatccttgggccacaaagcgatcaaattctaacatgtctgcatccttggggtctatggcctcctcaatcttgggatcttgaacatcttcctgcttcacatcctcagggaacaagtcctccattgtgactgcaaaataattagagttgtcatctatttccattttgtcagaagatccagacactggtgtggtgttcagtgctttcttagtttctgataaatgcactccagcggattgtcccagaggattaaccccagcgacttctgaaacattatgaacttgttcagttgcatgtgcagtcaaaacttgagatggaccaccagtactttgtaattctaggtgttgatcactgccaagctgtgtcccaggttcaccagccacagtaggtgttttagatcccgtagaagattttgaagatcctgttcctcgagatcttatgtgcacagcttttgtggactgtgcagcttttaaaaaattggtggcaacacttggttcggcaattcgcccaccagcagcaagagctgcctcttgtatcgacaaagggccattcacaggaattgattgggcaacttgtttcttagaattatttcgtgacttatttgaagcatttgatacttttggaggtggaggtgcagattgcgcaggtgcttgatgcaactgaggtggtggtaactgcacttgtactggttgcactggaacaggcaccggaacaacatgcaccggtaccggcaatggtgaaggtgctgtaacagatttcacctcaggattcgtagtagtaaccattggattgtgatgtggcacacctcctgcatgaacagttcatataagcacaaaaagtatcagcaaagaccaccccgaagatcacatgggaaaaaaaatgccagttgcgatacctggtcttaatgtagacgatctggtcgtcccaatggccaatgaaaatgctttttgtgctgcctttagttcctccgacataacattgggtattttaggggtagcaggcttggttgacccctgacgcttgcaaataagcgcccatctctgaaaaaaaaacatacattatcttattagactacagctgtctacatgaggaaaatgggggaatatcaaccatggttatcagttatcagcagtcacaactgccagatgcacgattacacaaaagaactcaactaggatgggtgaaaactctaatataggcttagatgaaaagcgatcaaacgattgcaacagcagcacacctaattttttaaatacttgcactgtgtgcaaggaggtgccgactctttcattatagaattgttgcaatgcatgtaaccataagttgggcgacttcaggaatggtaatcccatataggcgaataagaatgaacaaagcacaatgatgggtgctggtatgcaattgacaaggtgatcttacctgttgaagttgaagatgcgtccttgaactatcaaatttatatttatgcagaatttccatccaatttccttcaccatgcttctgtacacctgctcctagttccatgtcctcctctctggaccatggtttaggcttctttttctttttgggatgtccattagggtccaaaggatcaggagatgagcctgtgtgggagggctgctttgagctggaaaccggacctgtaccgtttgttagacggtgaccaggcacaagctgtttatcagatggaacacgcactatcttttcatttggagtgtttagcgcagcagcttctgagttgacacgttgaccagaggtttgttcacgtgaagatccggtgataatagtctgaaattgcatgacaggatcaggtgccattacacagaaccacaggcctcaaaagaataccatgcaaaattaccaaagaaactagaggttaggtggttttgtgcatcacattccatacgacaatcttttccataaactaaaattgattacccttttatagtctttctagacacatgtaattcaagactgcctgcaagcactataagtgtgccactacacacaattttaacttgtaaattattagatggcagggaaggccacacactgaaaaaagagaacatttttcccatgcattttcacatccacaaaggaactttttattgccctatttgtagtgaaaaacacacggagcactatcttccagttgataatgaagcaccaatcaagctatgaacactgccagtattgagcatcaataatagcctttgaatatgtttgcccatattctgtctatctcaaactatacacactagcataactactaagttattcaacaacctatgttagtgtcaaagcataaactgtgcttgcggaagccaacaataatagaaacactacacattatcagatagatactgaacggtgataaaataggagatcacgaccataatcaaataatatgtgcaacaactgcctcgtatgaacccaaaatgacacacgcacacacacaagaactacataatcacacagaaaaaaaaaggtgcgaaaataaggggaaatcaaccagttttagcatcttatactcgaaagaagcatccacgctatacgaaattataggcttcggttgtacaagataatggtctttccagaaagtgataccttggcaaacgatgtggcctcagctaatgcttcattacccggagcagggacaatctcaatctcacattctagatcactcccatcgtcctacgaattatcggtcacagcagcacagcaccatcagagaaacgaacaaccaacactgaaaacaagctgagatctacttctactactgtataaaatctcaacaatttcccgaatatatataaaaaagtaacagaaatctcggcgagtggcgaaccagcggcagggaggcgggctcgacgctctcgacgaactcgtggccgtaggcgaggtggcgccacagcatctggtactcgcgcgcggaggtgatcccggtgctcgtcctccgcaccagcgccctccagtcgatccccttccccgcgcccacctgcttccccatctcctgcagcatcgtcaggatcgtcgccggctggtacctgcgaggttcgggggggggggggggggggcagcccctccccggtgaaacgaaaccctagaaacgacccgccgcctccgccgcggggcgagagaacggaaagagagagagatgggggagatggatttacctgtgcaggatgaggtaggcgtcgtcctcggagaagctgcgcttccgttttgccgccccgcccccgccggccgccgccgcgtccatctcggagtgtaaccgactcgtcggcgcttggccggggaactcctttttcatctccttttctgttattatattattttttctccccttcttttttttttctcgatttgcttgttgatgagagcgaagaggggatgaagaattgaagatagtcacataggtgaggtgaggaagcgctgatgggctttttgtgctgctcatcccctcttctccatccccctcttaagatcctataaacaagttggggcctcctttgcttttgcaaatggcaaattatagaatctgagtgtttgctcaattgtaaaacttctcaaaaagtttagtatttcagaagaaaggtgttctctttataatgttatggtacggacacctagttagtttcataagaatttcagaagattgcattcttaaagttttattcttatatgattcaatggattcgatagtttggtaatatacatcctatagaatgattttccagccctttttttcaagaggaaaataagcatgaggcaagagcctctacagtgtgaacgaaaaatcgattttacggtaggagaatcgaatcatgcacagtgtcgttgttgaacgtcgtaggtgtcaaaacaaatcgaactcacattggagtcgaacagaaggagtaaaatactatttattgtgcatgcatgcataaaaggtacaccaatgattgggtgattctcttttacaggtcctacaaaacaaaacgatttgaatactatagctactgacctgaaattttgttcaactcttcgattagattggccgaactaaacactacagatgccttaagagttcgtgatttgtcttcctgtgagaagtcctctgtttatttctctctacttcctctatcacccaagagtgattcctataaaattcatgtgatttatttcccgaggaccatcaggcactagctcaaatatttctatttttaaaatctaacaatattccaaagagcacaacgtcccattcagtggcagagccagtatttgaacatgagggggcagcttactaaatgataattaatacggaaaaatagcatgacaattaatatttttgtcttctaaaagcctcacacggataatgtgtacatatgttttggcaacacaagagaattaattttagccttattatacgttgccaaaatatataagaacatcgttgcagttcaaaaggaacacataaaattacacaagtatattaattgaatttaacctcagcggttagctatttactattgcaggattgctgcatgcaaagctaagcagccaacacatactacggctagttggccaaggactaacccaaatcgcaacctagtatccatgcatatggtttgttcatggggggcctaatacactgatgaataattttttagataaatatgtgattatttgtactacttaacaccccccaagcagagattccatttatacgttgtttttcttatttctatgtcttttagaaggaaccggctcctctaatgttcaagacgcatgtcaccgcgtaacattgctcacacatatgttgtccaaattaatcggacgcacctggtgattctttcgcaaaacagtttctcgtaagcaatcgttttagagagggcttagcttagtcgctaatacatgagattacttcttctctctctaccttcgagcagatcgtagtgtggcaaagaaaaagctaaggaccaagggacgaaaaaaatccttgctaacacacaaagagcacaaatctccgatgtctttctattgaaaaatcaggggaatgtggtttgaaagttgtggtatagggaagagtatcatataggatggttgatttgccggttttccattgccgctatatatatgatgctgttgtatttttttagaacttaggacttaggagatggtattgtgagtcaggtgatcagtacaccaaaggtccagagcgccgttgcgtgtcgtggaccaaagcattggcgtgctgttaccggtgagtagcgcgtgtagccagaggcattcctattctgtgggtatgtggcaagttccttttttgatagagaagaacaaactaaagattaattcaaggattagcggaggaagacgatatccctatagagctaggccgtccgattaatttggacgacatatgcacaagctacgttaggtggtggcgtgcctcttaaacgttagaggagccgattcccttctgaaatctggttttctaaaggagccctaagtatactagataataaattagtgacctaacatcctctaaaaaaactagtaatttagtacaaggcaaagtggcacagagaaagagttaggataacaccagtagaatatagagattgcatagtgggttaaaaaaaactaatttaagattaatattttgtaaaaggggatttgatgattttccactctttactctttaaattggggaacatttgatgatttgtcattcaagtcattgactttagaggacactgcatgtcattgtctcggtagcaataacctttcttctcacaatataaaaagttcacaagtcgtgttttaaaaatgtatactcaagtatgtcttgtgtgtagcatataactatgtcttagatatttatctattattagttgaggccaaaacaaaacgacggacataggttaggatgcatgacaacatggcttatattaagcattaactttcacccctgtttcattttgaagatgttgtattggtaataccaagatggaaacaaaagaccatcgtttgcatccctcataggaagtttagccgcgagagaagatttgaaacatcgatgtaaaaaaatatatgctacgaataaataatgaatctaacggtttgaaaatcagaaatggttccatagtgtagtggttagcactccagactttgaatctggcgacctgggttcgaatcccggtgggaccttttttttcttttgtttcttttctttgtgatttagcagctcatgcatgaacaggcgatgcattgggtggttcaatcttagcacgaagtgcagctttttattcacctgtttcttttttcgtttcttttctttgcgatttaacagctcaagcatgaacaggcgatgcattgggatcttttgcgtttcttttctttgcgatttagcagctcatgcatgaacaggcgatgcattgggtgattcagtcgtagcacgaagtgcagcttagctttttattcacctgtttcttagtccaggggataggcaagctccatgttcttcattcatcagcagtctacatgcccgattggttcgtttcgttttttttttaattacaggttctgaatgcctgggtttttcttttcacaatccagattacacattttgcagataagtattgctgcaattctgcaattgtactctgagcaatctctcttttgttaccagtacaacttaccactggtaaagctatgtcactgactgcttctctgaaccatctgaagctgcataactgatatttccagcctacagaagaacatctctcctggctcctcattcttcttgccatgtctcatttattgcgtaagttagttatcagtctatcagtcactaagccataaaattatgagcatgacaaggatccatccacgttacagtttatcagtttcccattgaggttcatacttgacagcaattagtgattaagcataaaacagaagcgactagcaaatgatgtgattgctattgttttagtcagcttatagaggtaatttatggcctccgcgcaagctctacatataggaaactaaagctcacaa

SEQ ID NO: 11575 - DNA, 867 bp, Oryza sativa
gcaaaaccctggttagagttcgtcttgagcgaaatcaacttgaaggagatatctccgagatgggccttcatccaaaccttgtctatattgacatgagctcaaataaactatatggacaattatctcatcgctggggtgagtgcgccaaacttaccactctacgtgcatcaaataatcgtattactggagtcataccatcgagcatggggaaattgtctcagttagggagacttgatgtttcatcgaatgaaattgaaggacacattccaccagaaattggtaacgtagtgtctctattcaatttgagccttgcaaacaacatgctccagggaaccataccaaaggaagtaggttctctacaaaatttggagtatttagacttgtcatcaaacaacctaagtggacagatacatggatcgattgagaactgtttgaaacttagattactaaggctaggccataatcgcctcgatggaagcattcctgttaaactagggatgttggtaagcctccaagaattgttggatctaagtgacaattcattttctgggatcataccaagtcagctgggtgctttgagcatgctcgaagctctgaatctttcacacaacacactgaacggcagcataccatcatcatttcagggtatgatcagtctctcatccctggatgtatcatataataatttggaagggccagtgccacatattaacttcttggaagaagctccgattgagtggttcatgcacaataaaaagttgtgtggtacagtcaaagctttacccccttgcgaccttaatcagaaaggtggccagggaaagaaattcaaatccattttacttggtatagttggtgctgctggcatgt

SEQ ID NO: 11576 - DNA, 1314 bp, Oryza sativa
  unsure (1)..(1314): unsure at all n locations
ttcatggtaccaagggctgaagaacaatttgtgaaagcctcgaggtccacttcattgaggaggggatgcatctttcctacttaatcatcaagacttacatgcttcgacaatatctttaagcttatattttggttttaggtttagttgtaccttccaaatgcattgttgtatacacattgcatttgagtgggggtgttaaagggtatatgtgtcttttcatctctacaggagctgggttcttatttgctttgacatactcccatcaagctatgccctctcatgtcatccatgaaagagggttcgctccgatgaattagcaacgatatgaactcgatatgttaaagaggatatgtgtctgttcatctgtggtacacattatatgtggtccttgaccntaagtcaatagtacatagtaaattccccaaatttatctatcactgtaagagtagataggtaagtttggtgcactcaccccaccgaggagataattgtccaaacagtttatttgagctcatgtcaatatagacaaggtttggatgaaggcccaactcggagatatctccttcaagttgatttcgctcaagacgaactctaactagggttttgcagtttagtaagcttgttggcaatggtccaacaaggctgttgtgatcagcagtgaaattttgtagccgacttgctgcgcatagtcctgatggtaactcaccagagagattattaagactgatttccaaaaactctagattcactaagttgccaagttcttgaggaataaatccaaaaagttggttagatacaagatttatggaatagagtttattcaaattccctaagctgttcgggatggaacctgtgagattgttatcagcaagtgataagttatttaggttcaccaggttacctagttctttaggaatgtgtctagaaagtttattgctccaaagcaacaagttggagagtttagtcaaattccctaagctgtttggaatggaaccaatgagcatgtttttggaaagatttaaattctctaaattcacaagcttacctagttcttgagaaatatgcccagaaagttgattgtgccaaagaaacaagtgggagagtttagacagattccctaagctactcgggatcaaacctatgaggttgtttaaataaagcgataagttttttaagttcaccaggtaacctatttcttgaggaatgtgtccagaaagttggttttcaaaaaagtgacaactcaatgagtttagtcaaattccctaatctggttggaatggaacctgtgaaaatgtttttggaaaggtctaaatt

SEQ ID NO: 11577 - DNA, 7065 bp, Oryza sativa
  unsure (1)..(7065): unsure at all n locations
attggttttcaaaaagtgctaagtcaataagtttagtcaaattccctaagcagtttggaatggaacctgtgagcatgttaaaggaaagatctaatttctctaaattcaccaacttacatagttcttgagaaatatgccctgaaagttgattgtgccaaagaaacaagtgggagagtttagacaaattccctaagctactcgggatcaaacttgtgaggttgtttgaataaagcgaaaaagttctttaagttcaccaggtaacctagttcttgaggaatgtgtccataaagttggttttcaaaaagtgacaagtcaatgagtttagtcaaattccctaagttgtttggaatagaacctgtgagcatgtttttgaaaagttctaaattctctaaattcactagcttacctagttcttgagaaatatgaccagaaaattggttttcaaaaagtgctaagtcagtgagtttagtcaaattccctaagcagtttggaatggaacctgtgagcatgttaaaggaaagatctaatttctctaaattcactagcttacatagtttttgagaaatatgcccagaaagttgtttgtgccaaagaaacaagtgggagagtttagacagattccctaagctacgtgggatcaaacctgtgaagttgtttgaataaagcgataagttctttaagttcacaaggtaacctagttcttgaggaatgtgtccagaaagttggtttttataaagtgataagacagtgagtttagtcaaattctctaagttgtttggaatggaacttgagagcatgttgtcacaaagccttaggccctttaagttcaccaggtaacctagttcttgaggaatgtgctcagaaagttggttgtgacaaagatccaagagcgagagtttagtcaaattccctaagttgtttggaatgtgcccggaaagttgattgccccaaagaatcaacacagagagcttagccaagttcccaatactgtttgaaatggaacttgaaagtttgtttatgccaagcctcaagtcttctaagatcgctaagttcccaacttcttgaggaatgcacccagaaagtgtattatatagaggtataaggtagtgattttagtcaggttccctaaattatttggaatggtacctaataatctattggaattaagtttcatggacctcaacttcaccaaatttccaatctgctcaggaatatatccagagaggttattatctgaaagatccaaggacttgagctctgttaacatattgatattgatcgttctgcaggagcagggatctgagctctttgagggacgcaccactccaagggatcctccccgtaagcttattgtgtgagagatcgacgcttgtcagcatcgtcagtgcagagaagttgaggacctcaagtgagcctctcagcctcattccacgcagagaaatcttggtgatcacaaatttcccttgtcgagcaccgcacccaatgccacgccagctgtggcatggccatgccttgcgatcccaggactgcaggggttcctgggtttgcagggtggccttccaggcgatcagcgctccagcttgctcttcgatggatggcatggcaatggcaggaggggcaaggagtgaggacagtagtatagctaatggcaggaccaaatttaggggagataagggatccatggcttgggtagagtagaggactttgctcaagctaaggttggtctgtgttgttcttatactggacagtgttgactgctactgtccatgatcagcttgtaagtctatatggtacagtgcttactaccgtaccacatttagttgcacattggacttggaaaaaaaaattcaacgatcgtaagataagtgaaagcaacatggatggaacacttacatgattagttctctggtctaatccaaacaaggttggagtcgagactcgaaacatgagattctcaagtcaattaagcaaatatggaagtcatcacctttctaaatcaacgtacccagggggcaagtagatatggaagaatggagccttgttcagattctcaagtcaagtagccttcctcccttactggttgactagttgttggagaaaaaaattgaaaatatattatttatttttctttttctcagaaatatcggggatttaatcttatttgtgtaaatagctgggagaccgagcggtcggtctagcttgctcaaccagcgagaccgacagcacacacacccttgccactaattagtgattaattatcttgactagccgtcaccggtacgttgcacggctatttatcgacacgtgtcatgaacatcaattaatttagttatatgttgaatgtgttttcttactatggcttacatgaaaagaataatccaaattaatcattattcgtgggttgtcttaagtttttcaattaaggctgtgtgtgtttagttcccttcaaattttcaaaaattctgtcacatcatatgtttggacacatccatggagtattaaatgtggacgaaaataaccaattacacagtttgcatgtaaattgcgagacgaatcttttgagtctaattacgtcatgatttgacaatgtggtggtacagtaaatatttgctatgacggattaattaggcttaataaattcgtctcacagtttacaggcggaatctataatttgttttgttattagtctatgtttaatacttcaaatgtgtgttcgtatacttcagcaaaaaattagttgtgaggctgtgtttagttccctttaaacttccaacttttccgtcccatcaaatatttggacacatgcatggagcattaaatgtggaaaaaaaaccaattaaacagtttgcatgtaaattgtgagacggatcttttgagcctaattatgcatgatttgacaatgtggtgctacagtaagcatttactaatgacggattaattaggcttaatagattcgtctcgtagtttacaggcggaatcaataatttattttgttattagtctacgtttaatagtcaaataggtgtccgtatacgaaattttttttttaccaaaacaactaaacacggcctaagctaataataaaataaatattgaaaagtctaagatggatacgacttcatatttaaatttagtaattattagatattacaaatctaaacctacaaaatccatgatatttccaacggtatgttttacttgtaaagtatatagccggtccctaaacttgtacgattatgtcatttaggtctcaaactataaaaatacatatccagatctcaaaacttattaaattgtgtcaatccgatcccaaactgccatgccatctccaggatcttacctggcatgccacaccggatgatgatgtggcagcatcacaaatcctacaccaactggcaagtgggcccttctttccttttttttcccatcctctcatttctccgtttctcttctttttcctctgttcttcccactgcatcgaccgtaaccatgccctctggtcgagctgtcacctcggtgacacgaacagcgcagcgtccacaggcaagaaggcaacggcgcggcagccgcgtcgacagaaggcgcgccatcgcgtgggcagtgacgttcccgcccaagccgagaacaccgcgaccaccaagtcgacgccctgatgctcctaggcagctgtgctcagtcggaagttctgacggagcgccgctgcttcgcacgccatcgccgcttgtacgacggaacaagatagaaaattggagaagacaaagtgaaaaaaaaaaaaaaagaggaaagggcaaaaagagaaaaaaagagagtttttttttaatgtgggtcccatttgtcagccaaagtagaggtattgataataccacatcagcgtctatgtgacataccacgtcagcaccatgtaagatgccggaacggtgatggctatgttggaccggaatgtcacactttggcaagttccagggtttgaatatgcatttttagggttcggggacctagatgacacaacgattcaagtttagagaccgggtctgtagtttactcttttacttaacataaacattaaaatattacatagctactatcgtagatattaacattaattgtattattccttcaacttttacaagcttaaagatttacaaattatattgctaattatatttttatgtggaatcacatattggtcggcacatattaaaaaatttatatgaacaatatgttgataacacgtgcaaatatgtgcccaaagccatcaataagaaatttttatcgtcgaattttttattggattgtgactccatgccaatatcaaacacaactcactattctcgctattgatttgttgtcgaattaaaaattattaaatggtgaaaaaaatataattaagactctctcttgatacttagtaattcataatttctaaactaaattaataaaaaaactccaaaaaaaacaacagtaaggctttagcgtgaattaaaatcagaatacaaagaaaaacataatgcttataaaattaatagcaatagcccgtgcaacgcatgggttgtcggctagtataattagcaatagattgggagcccatacattcccgattactcgttgttcttcttgcatcggcggtggaccttcccgattactctaggagcaggtacaatagaattgttttattagatgcaaaaataccatgttagattgtttggtgctttcaaagagagaagagagagaaggaatgcaggccacaaaataagcgccaactacaacacattcctccacacctggtgagcctcattccatgctcagctcttcgtgattggtgaaaccgtgctagcctgcgcacaggataggaggggagagagaaaaggtaggaaggagagaggaggttagacccactttatagtaaattatttttatagtcaagagattagggccatgtttctttcagcttgggattattataatctagattattgagtcagattattataagctagattgttataatctatagtagaataagcggttagttgtttctttcctagattattagagcagattattggtttgcaagtctaaagagggagtggggtggcatggtgggtaatttttcacccaataatctggaaaaagctcacctaaatgagcttatcagattataataagctgggctccagattataatatgctacttcaataagttgtctgtttctttcagcttactcccaataatctggattataataatctcaagctgaaagaaacagggccctagatctatctactcccttcatctcttaatataagggattttgacattttgcttggactgtttgatcattcgtcttattcaaaaaatttagaattattttttttgacttactttattatccaaagtactttaagcacaacttttcattttttatatttgcacaaattttttgaataagacgagtggtcaaacagtgcaagcaaaatatcaaaatcccttatattatggcacggagggagtattatagaaattacgggtctgtttggtacaactccagctcctagattcannnnnnnnnnnnnnnnnnnnnnnccaaacggttcagattcgccaaaaactggatcggaacggggtggatcgctccaaaatattgtattgaggtggagcggcgaaaatgtagctccacggctccactccgaaaataattacagcactacccattccttttcactgaagttataggaaaatgccaccactctacccccttcgattccctcccgcattgggcgagcgacgcattcccaaccccttcctcgcccttctctcgcgacggtggaagagaaatcgtcgcacggcggtagcggctgcgcacgtcggtagtggcggcgcacggctgcagctcccttcctcacccttctctcacaacgacggcggcagaagcaactccctccctctctcggctggggcggcacgcggtaattgaggcggtgcatgacggttggaatggctccgtggctgcgcgatgcacagcggcgggtgtggcacactggggcgacggcgctcatggcggcggggttgaagcacctctaaaactatctatagatgacatgtataaactatttatagattacagcttacagctgtctatactattaaacttgctctaatggcaccgatcagagctgcttcctcggcgatcgtgccaaaaacgcgagttccttttggatttcttttttgaccaatgataaccgttgcattgtcatcccttagagggtattgttaaaagatcctcgattcctaatgcaattgatgtagtagtggcttgatggaagcccagtgtttttatttgatccagtatatgggtggtggtgaacctctcattcaccttcggtactctccgaactgtgcgggatggtttcccatcacacggctcaccaccaccacaagtagagaatcccaatgtgctttttactaggaagatgaggatgctattctttaaagaaccgagcttgacaagcatttcccatccatctttccccttcttgatgagcgcactacgactcattcaaaagagagagtaaaaggaagaatttcccatgccaaaggatcagaactgatcaggtctcaatccatttgtacttgcaatttcatcatgatccttatcaacacaactaatcgatacatttataagaaatgaaccgcagcgaaccctcagatgacccgtcttgccaaatcagttactggtcctaaagaatttgtatagctcatggtatgatatttgtctggagtttatggtgatgagaggtgtaattggtgtggtttgatcatctctcagttcaccgattcatccatccggtgtgatggacgactctccagtagaagatgtgacatcgtcgcctaataaccagaagaagcactccttcattgggcgtcatggaggtgccagtgctcacggatttttggagttctagagagcatggatgacctttgcagtttgcaacatcaacttcattgagatggatgatatgagttgcatcagtttcaacattgatgagttgttcggtcagatttga

SEQ ID NO: 11578 - DNA, 1026 bp, Oryza sativa
tcaaaaaatgataaaaccaaaccgttttaagcagctactacttatcatcactgaaacataccaacacaaggagagcagagacaaaagatgcatctgaaaactttgatactaaacatacaattatacagtatttgctagaataggagaacaagaagcctcattgccatgtagtcagagaaaatggtagccatgtataccatccatcataaatcttagagattcgtattacaatttacaacaaagcagattgatcaaacaaggtagcatagtaagcacaagaacatcaccagcaacacgtattagggtcgtgtacaaaatgcaggtatgtttgacaaccacgcaattaacaccaacgaagtagagagaacacaaatcatcatacaagtgatgctttataatacttgacaagttgacattaacaggtgcaatagactgacctacctatggtgtgaattgccacattcttgtggggaaaaaaccctgagcaacatgagaaacagcaattttctgacaacattcactggtagtacgcagggatgattatgtcaacatgtagatggtcaggattgctaggtccttcagctgtagaaaacatccgagttacatgttgcattgttggacgacgtgatgggttggggtccaagcactggacagcagccatgatcactctaaatatttcacttgctgtctcagctttaggaagtgggatccgggcgtccaacaaatccttcaatgttgtactttccttggccatggagaaggacaaaaggaaatcaccaggatgatgccccatgaacagctcaaagacaagcactccgaagctataaacatcgcatttctctgtcacccttgttgtgtatgcaagctctgccatgtaaaaatttaagactttgtttcaacaaatttgcatatgtaaatagtatagaaggcattcgatgctatttttacaaaatgagatgcaaatttgcctaattgtatctaatatactactatgaatcaaagatatactagtaagacgaatacttt

SEQ ID NO: 11579 - DNA, 674 bp, Oryza sativa
agagagaagggggtagtaattgatcattaattaatatttcatggcttgtcaacccttggaaggtaaccacttaaccttaatcatccagaaaatggagaaaatggagagaggttattaggatagcatcttgtgttggacactgtttgcaactgttttgagtccatttctgctaatgccatttatgatcagacatgtgcaagacaagagtgtgcaactagtgttaatagctcaagaacccaaggagcagaagcaagctgaagagtgaagaggaggacagccaagaaagcagcagaggcaagcaagcaagcaggtggtgtgcctgccatggcggccgccgcgctgctagctagctgatggttagttgccgccgccgccgctgcagaggtcgaggagcttcttcctcccctcggcgacctcgtcgaataggtcgtcgatcagggcgatgacgtcctcgcacccggacctcagcgcgtcggcgcgcagggcgacctccgccgccgccgccgcgacgtcgccggccctgtccacggcgtccctggcctgctccaccgccgccctggcgcgccggaactcgtgcatcatcgcgcctccccctgcgtcgacgacggagggcgacaccgccgccgccgccgccgcggcgcgctgctgcgcgcgggcgagcgccgacgcgaacg

SEQ ID NO: 11580 - DNA, 12000 bp, Oryza sativa
ctcgttacctgcacccacagatcgatcgtcacgacgacggcggcggaggcggcggcggcggcgtgtgagtgactgacctctaaggagaggtgggaggagcggagggcggaggcgaggcgggaggcggagtcggagtagccctcgagggaggcggcgccgaggcggagggcgcggcaggcgtcgcagaggcgggaggtctcgtccatgtactcgtcgagccaggcggcgccgccggggaggtggagcgagccgacgagccgggcgagccccgcgtgcgccgcgcggatcagcgccagcgcggcccgcagcgacgccgcagacacgaactcagccggcgccgacgacgccgccagcgaccgctccagctcgtccagccccctcgccagcgtcccgtagaacgccgccaccgtcgacggcgacggcttcatggccagagatgatatctccgagatctcgagagaggttagctagctatagctatagctacagcttatggtggtagctagctagcaatatggagggagagcaataatggcgcgagcgaacgaacgaacgagtgcaactgtgcaaccgtgcgggatggatatatggagttggggttggatggcgaccttgttcttactcccaagcccaacaaggctctactagctagtagtaggtatagctaggctagccttctttgcaactctactgcaagcaacaatggcctctctctctctctctagagatctctctcatgtggccatggctgctggtagctggtgaggaagagacttggatggatggatggatgtatggaaggaagaagatgggagggaaagggggctcctttgtgctgtgtgttatatagggccagggcacttctccaggggggctacatgcctttaggctttagctatgtactgctctttctgccacacctactgccagtcaaagcctagagaattttcattgatttggggtgaatttttcagggactggcaaaaataactgtggatatatatggtaaccagaaatttgttcaaataaactttaaacaataaggaccattttggttttgattccaaaatatatatatgtcctaccaaattgttggtactttgaatagaattttagctagtgttcggtttgctatcaaaatatgcccaataacacatataagttgctaaaaaaatggcactactaaaatttatctatattttggcattgtcaacattttaacatgacagtaaaccaaacaagccttaatttcttttatcttctgttgtcaaagatgtcacgatgtatggaaaaaaacatgaaattttgagagattttgagggaaagctagcatatttactctttttcttgatttgatccactagtaactagtaccaaattaaaatacctgaaactcaagagagatcgatttgaaattccaaatcgtgctaccaccgagcagacaacatgtcaattacacccaaagttgatagtgcgagctatcatcaataataacaatcatcatcatcatcatctcatgagaggtagggtggaccgtggacttaattccctacgagatcgagtgattgatcgaccggatatatatgttcatgggtcacctttttatttcccttccttataattagctcgctcgcttttctgaaagatacttgtcagtagactgtgtttttttttttgacacagtgatgatgtggagttgtggatgccctagctagagagagacagttgatggagatctactgcatttggcactagtgttcactggccggtcagctgatccatgcaagcaagctatccctttttcttcttttcttttttttttctttttgaaaagattgtatgcaagatacttcgtccgtttcatattataagactttctagtattgttcacattcatacatatgttaatgaatctacacatttacgtgtatctagattcattaacatctatatgaatatgagcagtgttataaagttttataacctgaaacggaggtagtacttgttaagagtatttattctgatatggatataccgaagggtgagaaaggagacaacttatatgtatgcacaaatcatttgtatgcatgttctcatgtcattctactcaatctcctttttttttgtttttttttaccatcgtgtgtcattctactcttgactgaaattagttatcatcaaacaaaaactctaaactatgagcacacttttttttttgacatgatgagcacaatgttttaggggtattggatccaagtagagaaatcaatagacaaattaggaaggtagggaattccctttgttttgtgggttttacccatcacaaatacattggcaccgtgtttagttacaaagtttttcttcaaaatttcaacttttccataacatcaaaactttcctgcacacacaaactttcaacttttccatcacatcattctaatttcaaccaaacttccaattttggtaggaactaaacacagcctagctctacttattcttgtgattgtgcatattaatgctctacaccaatatccaaaaaagatatagttcccaatttttcttttggcaattgggcttttgtaaggttgtggtctatgtggccatgacaaccccaccctagaaagcgaggatgcaaccaactaaaggatggcgatgagagtcggaggatgagtggtgtggtatggatatcggatggaatcactagagagaagtgaaaaggatggaggggaaacgagctagcgattgatgaggaaaaccgacgagcaccataagggttgaaggtgtcaaattagagtggagaatacaagaaatatatatactttggaagttagttttgtttttattggtgggcttgggcaatggtggagcataattgtcgactatacacaatcacgatttatgccttcttgctctctctatcataatatccaatacagaggtagtcatgattcaatacattttcatggccaataacatttaaccaaaatactccatgtgcaaaccttgttcccatagtaacctttttatcccctaggattcaccgttaatgtttgcagtagctaccttttttttagttctctatagagatatactttggtcctcaaatttgtgttctaatgcacttattagggtctgatttgtgatgcgatcagatcctccacttgtgtaggggtgactagctaactgcagaagatccgatgtgagcaaagattacaggtgagactaatccgaatctgaaaatttgactgatgacttgacccgaatctttcctccaaaacggtcatcacagtggggtttgggccccctcattgccatgaaagtaagaaaaaaaaatcaccaaggctacttaattgctactagtattagtttcaaaaacttaataattactattagctactaattagtactataaactagtacctttctctacaaaagtaaatccttccattcctgaatattagtagagtaaggtgatcgtatttagttggatataatgttctttatttagacgtcgccgaactagtactatacattcgattcctctcctttttcatttcgaataaaatgtcttttttccccttgtgatggggcatggacatctgcataaagttgttattatatctttattatgctgtgctaattattacctcatatgtgacaatgcaagatatggcaagaagaaatattatttttttttcttctccttttatcatgagctttccatcttgggtggacacttggtgccactaggagtaggaagctgtaattgagagatctccttgcccttgtgaatatatgtggtactagtattgctacattgaagctaggtgagcttgcttttgttttgggggaaactggaccaagatttcttaatcttgtgaagtgatggtgatggtggtagtagtggtggtaggctagaaaggccattgattgactcatgtgcttacaggaccccatttcataagcaatatatgcaaatgattacaatgtatctatgccctcctactattttatatagcacggttttgtttcaccgtgaaatatcgaatcaaatcaaactttgaccattaatttctcttacaataacattttatttacccaatatcgtataattgtacaacttttgtaccactaaaacatagtatatttttaagatcacaataatgttctctgccacttggcatacaataaaaagtgttctaataataaaagtctactaaacatatgctatctctgtattttcaatatatatgacactattatctttatttgatcaaattaaactttcaaaactttgaccatcgatagctctcctcaaaatatttagtttgaaaacatataaatcatatagattggtttttctttataagttctttgtgatattataattccgttagatattatccttatattctaatagtaaaataatgcacattagagaccgaataaagtcaatagtgctacacatttaaatgtgatggcagtatgttgggctaatatgtgatcgaagtcaagtgagtactgtacacggtgccaggggcggaggcaaagtatattagtggtcaagacaactttttattaagcaaactcaatataaacttaggcactcggccgtatcagcttaaactcaatgtaaagtagagtaaattaagcaaatgacacccattcctgtttcgttctaggttcaaccttgcacggtgcgcagatccatttcactcacttgcatccatggattcaattcacaatccattcttgcccatgcattgcatatgccaccatcatcgatggcaataatatgctgaacccgtcgtgccatcgacggtgggtttcttagctcccagcctccctcctgttaccgagaagagggctaatcatctcctccttgttccaaggctaactgcattggaactctaatctctcaccatgtgactgaccatgctgctgccctcttcctttcctcgagccatctgtagatatcagagaaattcatcatgcggcagatgacctcgaatcgaatccatcgagtagcttagcttgtagctagggttcctttggttaatttgctccaatggcattgctttggttgctcagaaaagaaaagaaaaactctaatttcatggggtttggttaattcctaggggagggggggggggaatggggatgatgatgcatcatcccgcatatatgtttgcaccaaatccatatctcgaacccccactatatgtctatgttggtaatgcagagatcttcttttcagattctctcacttggcccaagctttaattctcccttttgttttttcctcggctgcatcttgctggaattaatcctcctcctttttatatatatagcgccttttgctttgggattcgatttttcttttaatttcagagtgtaattaaaagaattgtaaaaagtttccactgaaaacattatgtaacaaaattcgtgaaactatattaccataatttctagggttacgcgctgcatgccaaactacttgtggttttgtgcaacatagagcataatacccaggattttatgatattcactccaaaaaagattgtaaaaattcgccactgaaaacatgaggtaagctttttttttctttttctttgtaggaaatagagcatgttgttagtgagaaattcagaggaattgatttatttgcttttgtacttactactacttattttatgatgtttttttgtttgtgctgcactagttcagtgaaaatttgtagccatgctaattgcagaatttatatatatttatgggttggtgttcgtgggttgttggagaatgtgatgctcttggactcggaggaaggtatgttggtcctgcttctccatgcagatctcgttggctaattaaaaagccttgccttcagctcactttcagaacacttttcagctggctcaagactcgattatcttctgtctatgttcttccaagtggaaattaaagaaagaaaatatcttttgtatcagaggttttctatggtcgttgaagttgcatatgtatttttagcgttaattaggaggtatatgtacctatcaatacctctcgaaagaccattaaaaaaaaacctgtaccagcaaggaaaactttaacactgagagtattttatttctgtgctctagttctaggtttgctttttctctgctcttctcatgactcttgatttgatttcaagttacgccatgtgaccacttctcattttatatgccatcttaatcaaagtatcctattgtaaggtgttggcttgtcttaactatagaaaaataagggggttaaagtccccattcttagtttctcaccaatatgattatgaatcttgatctcttaatctataccttaaacctcaagtcatgccccccggaccacttccctctattaagttccaaatcctatggataatagataatcagttatctcaatgctgtaataatagcaaattagccatatggttgacggcaatgaaaaggtttataggatagggttgtcaactattcttcttttttccttttcttcattcagtgttcatttccaattgcatcaattatttgtcaacatttaagagcagacaatatagcatgccttgcttggattgtttgtctggaaaggctcaaacaagacctacatattctgagctttaacaaaatggggcccaaacaattctatgtggagttcctgatgcatataggtcatattcccttttacttggcaaaaaaacatattttctttacgacttctgaagccactgccttggccattttggttttcagttttcagccgaaattggtagctggtcatcttcatcaaacctcatctcatcttcttgtcgaggaaaaaacagtgatagataaatataatgttgatgatacatttatggctcttattttctagctaattgtagatgaaaagggggaattccaaattttacaggattttcattggcatcaattctgatggaggccttagccttttattagcttccacataaacacagatggtaatttacacctttttgcagatcctgaaaattggtttctttggaaaaaagaacattggtaacattgtgcacactgcaaaatatggtataatcacttatgcggaaaaatatgtatgacattagagtatgtatccaatttcttccatgagaatatgatatctaagatgaaccttgctcagcaatactgagcaggattctagtcgtactgccgaagcatctctccctgttgtgtcctacttttttcttgcatcagattactcaagaaagatgaggcgagtggcgatacgcgtgtgagtgattcccattgcaaatcttcatagatgaactcgcatgaataatatatccccctgatcggcacagttcatcgtggccccgcttgtcggtgactgttcacgggcattttcgtttcgcagagagaatttttctagcttctaatccacagagttgaagaggactaccatgatggttatggttttacatgtgcaaaatctaggacaggataggccaacaaaatgcttttaggaattaattcttactgaatacttcctaatcatacacaattccttttttatgcatatgtagcagccaacccaaatgatgtgttatatgtgatctcaagagtgttccttttttctttcctttctttcttttttcttcaattggccacctgaagaaaagattggctccacacatttgaactgtgcccttttctgatgcttttgcatgataggtcactctcattgttcacaccaaagctcaactaaattattagtttaatggagatcaactaaattaaactagcttttctctttgcttttgatcttgctttggacacgagccaggagatcttaccgaaatctagagcggccgaatccaccaccatcaccactgattagtttggaatctgcaagcttaagctagcattgtacaataattctccaaagccctaatcatggcgtccacacccagcatgaacccctctacccttctacccttaagaggggcccctgaaaacagcgtgaagacgggttttcagtgacggtgaccggtacggtctccggaccaccatggtcgtcatcgtcttcgcaccctttttattttttcggttgggtgataaggtgatgatcaggggggagattggagaagattgtgctacaaaagtggcagcttcactttgtgtcgctggaggaggcatggcaccctggggtctaatcagccatcattccatcctcaatttttcttaagttgggagcattttgcatcactcttttgagcttttgggtggaaaaaggaggagaaaggagaggggaggaggaaattcacctttgtttatgtcaaccctcctgttgcgtaatcgcgccttcctgcactgttttaaggatggatgaatagatcagttgtttctaagaaaagatagaagaaaaccgagcgaaagaaaaggcgaaaaagggagtctctttgagcaaatggtttggtcatggattttcaaaagatggatgtatggtttatttcttgccaggtgagtgtagatactcactcctccccaaggggaatcacccaatgattgacagaatgatcattgataggcaaagcagaaagaatgaggggcacaatcccatcggattggcatcatataaagcaatcttgatcttttttatgaatgccattatgagcccatgattagatctcaacttaacaaagaaaactttgtagaacaaatggtacactcatattccaaaggacaagtggttctctttattcttgtacaggtgtatgtatgtacaaactagaattacatgatcagcagctttacaacgtgcaatgtacattagggtctttttgttgcagaagcttgatgcacacacagttgcaagggggcagtttccatcagatgccagcacccattatctcccaaaaattcctgctatttctctgcaatactgaaacatccgaatgctagattcaaatgctacagtccacatacttcttgcaaagaagggctgaagatcttgacttaagatgtcccttctgatttattgttcctgtcaaccagtaataaacagccaggttaagagcttgttcactttgttattaccattttcgaccttaccaacatttggtagtaccaaattttggcatattttaatgttactaaattttggtagtgtccgaagcgtttagtttaaagatttaccaaatatgggtagtgtttttaagagtggaagcttccaaattttccaaaatgtggtatggtagcaatggcaagaatttgtttggtatgttgccctaccaaaatttggtagggttgaaaatggtaataaagtgaacaaaccttaaatttgataactggtgttactatgtctatgtgatatgcagaaaagttctgatgcactagtaattattctcgttgcatgagaaacttgagctgaattccatgtataatatacagatatcgcacaataagatgtaaacttatttgggtacatatgaaaatcgagtgtcatacacagaacaaactaagggtttctaaaagcacccagaaaaactccattttagctatcttgtccgaattaatttaaataaacaaaacttttgaatataccagaaagaacacagtaataatgtcattttaatcaggacataggatctaactttcaaatgataacaaagtttcaaaatgatactggtttcccaatccttaacctgtctagaatggtgcctaaggaagtccataacacctgcttagagaacacatgtatttgcactttcaggtgctaaaaactttgatttttttcaaaggattgtaacactcattagaatgacaagaaaaataacgaggactcagagacgcttgcataactctaatttctgcaaataaaatagtggaaacatgacacaacacatttatattagacagtccaactttctggtgattcattgcattgggggtagacagacttcaccatccacattgggctcagcacggaatgttagatgcaggaattccggaatcacagtgccattgaatgcgatacatgaggacacaaataaccaggaaacattgtattctgctcccctgctcccccctagtgattcccaaggtgtaaagcaaatttattttggatgcacaaatataacatagtgcttcctattcacttgtgaagtttgggtaataaacaaaagtacatagaaattttgtgcttctgtattagcaacacaagtttagacttcaggccaccctaaggagcactgcttgagcagagcattctgctaacttacacacacaattgacggaagtggaaagcagatagcttaagcttaattagtcccatcacgattcaactacaaccaaagcatagatattatcccattcctcataaagaacaatgggtaaatcaaggtcaccatgccaactcgctgcagggataacagaggagcctgcagtctgggtaaatcaaggtcaccatgccaactcgctgcagcgataacagaggagtctgcagtctggaagctttgcaggagcacaaatggagctttaagttcgaaacaatgtcttggtcatgaaattttgtactgagtaaaagtctttattgtttcttttcttcaatttaatatttttggctttgatatacatctgcgtactttgagcctcgttcattgcccttaattcaaatgcgcattctctaaaaacaaaataaataaaatagaaccacgaacatcaacaatcaacatacaactaaccaaatcagacaatctgctggccgttcagtagcttaatatctacaattaagtgcacaagcacacgtaagaattaattcttaaccggatgaaataatcaggtaattctggacatccagatggaggaggaggagatttgtggcaatggaggtttcacctctcgcccagggaccggtagaacctggcgaagcggccgcgctccttgggcttgggcttgacgggcttcttccggcggagcccggcgatctcctgcaccagcgggacgtgcaccagcaccgtcctccacgccacgtaccagcctgcgacccgccgccgccgcgagcagcgaacgaaagaatcagggaaacccctcgagccaaaagccgaagcgagaggaggagagggcggccgtactgagggcgatgatggagaggacgaaggcgaaggcgaggaggggccggaggacgaagacgacggcgatctcccacgccgccgccgccagcgcggctcctcctcctcctcctccggccatggcgccgcggcgacgcttcgtcggcagaagggggaaggtaaggagacgtggggaatcggcgggttagtccatgacatgtggggcccacgaaagcttagaggagcaaagctaaatcgttgcgtagaagtttgtgttactagcttgtgccttgtggcaggggtagacggatctggaattcgagaggtgtttcataacttgccctttaatgcaaacggatttgttatgtttcaccaaatgaaattcgatgtttcatcagtgtgaatgaaatgtctcagtcgtgatttgaatgtgttttaatattttaacaaggtgaaatatttttttaacagtaaaacattttatctggtagagcgcccgatttgtaagttccctgcctgaatttggcccaggtgtgcgcacaattggccgagtgcatgtaaatttggcccacttgcgcgttttataatttcatcccatctatggtcaaattcggcctgaatgtttacgatcagttttaagggtacagagacgattgccaatcaacacatactagcaattaatcttcagagtccccagggtaacataacatcttctaccctataattcaccaactacactcatgcaaacctcattcatcaaatccgacggtccagaatcgtcgaattcaacggctcgactccgcacccatgcctgcccgcgttcctcctctcccgtttcacccgcccatcgcgccgccgccggtttccaccacgccccc

SEQ ID NO: 11581 - DNA, 11359 bp, Oryza sativa
ccccccccccccccccgaccatccctccccctccccaatcccgcaccgccggcttccactgctctcctggccatctctcccacgccaccatcgtcgccgtatccccgtcgccgccgctacaccatcgccgagaatccccttcgccgccgtctgcgggccgcgagctcctcccctccccctcagccgccgccgatgcgacggcctctggcttccaacacgcttcgaagcctctgcttccgtcaccacgcggcctgcccgtccgccggcatgaatcaaccgcgatctcagccctagaagggcgtgcaatgaagcagccgctgctgcttggcgcacatatcggcccgtacgcttgcactacaccggtgcccgcactaggtaagatcctctttgagatttccttatggtacgaatcctgctgaggagtttagaaccattttaagcctcttaatcattttatctgctcaaatcctctcttttgtttggaagatcaatgtggtttatttttgctatgttggaacaattaagcgaatgaaatctacttgttggtactatggcattaacctgctgtttgtaccgtttttatttctggttgaatcttgtgattttgctgaaatcttatcacctaacgtgaatgtatgctttcagtccattcagttgaaaatctatttaatatcattttctttttagtcttggtagcacggttgacaataattatcggtcagtccttggttttgtggtgatgagtcgtgagtcaaatagcatctataaaaggattctacctaataattttcagagtgatgccctgctctaatatttacccccatttttttttatctcaggtttgacctctgtatttcagtgccgtctataattcattaagctacttttgcttacccttgtctgtctcttttcattgctgaaagttgatgtcttttttaaggctaagaaagagctcattctatcttctgtaaattttacaggctcactgaatgatgccaagatatatgacaaggtatggtctctaagtggcttcctgaatttacaactgaaccctgtccacatctctccattaactgagtcagtctaatgggatagaagcactacaatactgtattggtgatggacgtcctgcaggccctggtaaacaaggcaatctcagctggcgccatgtgcgggatgggaggcaggctgcggccaccagcgatttctttgtatgcaaaacttcttcggcatggcgttacggcttaaatggttggcaaagagaggagagcatcgcgacagaccttggacaaccattgagactaagcagccgaaggagttacaggacctgttcttctcagccacacggcaagtgttgggagatgggggaaaacacaaagttttggcttgcggattggctgccaattgggagcataaaggcgagatttccgttaatcttcagtcatgtggagcgcaagggtttgacagtggcgagaggactacagaaccataggtgggtgcgcgacatcaaaggagctccatccaaccgagccattggggagtactttcaaatttgggatgcgatccagaaggtgcagctgcgaggaggggaagaggatgagacaatatggaagtgggcctcgaatggaagatttaccccttcctctgcctatgacatgttttttatggcaaacacagaggcgcgttgtggcaatctagtttggcacacgagaacaccgacaaaggttaagttctttatgtggttggcagaaaaaggccgttgcctaacggccgacaacctgagcaagcgcggatggccacaccatcaaacattctcactatgcaccagcagcgacgaggactgtgagcatctctttgtttcctgcccatacaccaccagagtatggaggatgatcaagggttgggctggaattggcatccaactgccggctgaagcagggttggaactaggggaatggtggctcttggcgtggcaaggagttcagactagctgcaggggcgcttttgacacgctagttttgcttgtctgttggatggtttggaaggagagaaacgcacgtgttttccagagtcagagccggacagcgggtagcctctttgctttgattaaagaggaggttgtggtctggaaagaagccggggttttcaaagttttaggagagtaacaacagcatgatgtaattgttttttctttcgggaagttgcccttgtgacaacatccttttacttcgacagcctcttgtcgaagttggaaccttgtaaatatgtacatacccctttcttaagtaaatttggtccgcctatcttaggccggcccggctaaaaaaataatgtgtggagagtggagactatgaatcttaaaagttttgattttttattttttctatggagggcatactaccatttgtgtaatgtgtaatgtgtaaagaactactgataatgcattaggggatttggctaggatttggagaagctggttcttgcgagtatttggtttttcctttgaatctggtgaaatgtgataagagatttggctttctatttgaatctattgatatgttatggagattttgctaggatttacactgatcttctccttttgaaatgcctctgctcaaatcctccccccgctgactaaaaccatgcaatcttggacatgcgcttcctcgtcgatattaggtagtgcatatcaatcgttgctatattttaataataggctgtaatttcactatgaattaaaatatacgtacttgcctaaatattatttatgatatttcgttacttcttttcttagaaggcttaattattttttgtgcatcaaagacatgaatattctatgcgggagttcataaactctcaaaatatgctctcagattatgtcatacttattgaccttcactgatgaaatgggtacatcttatctgatttgggaacacagacacactatttgattgtcatttgtatatagctgatagtatgccccgcatatactaattaacttttttgtggatgggtgcataaccgcagtctacaggtcatcagccgatgtatcaacaaggggagtctgccctaatgtcttaacgggcacctcaagctgcattcaatggcctctgaaaaccttaaaccttcaaggacaggaaggtaactgaccttccaaaataagaggatgctccatgttgttacgctgtgatgatgggaatattgcacaagggctttgagtaattcatggtttgtttctgactgatgtgatgagattaagctatatgtattgtcctttctgatggctatcaacaactcaactacttttgccattgtgagctctagcatcaatcattcatctttgttcttgttgtttttgatgcacactgcctaaggccttgattagctgtatttgttatacttagattatatgtcagataatgggaacctcttcattccctgtcttgccaatgaggatcgtggattattttactataaaagtattccctgatttctcgatgtactgtaaaatagtatcacttgtgtactattttgtgaggaaacatttatctatttgttacgctggtattacttgacccctactgaaaacaagcaatctgctttagcattcactttcgaattgtatatatatgcaaatgtatgtataactctctgtacaagtttgaggtcttcagacataaaccatagcgtgtatttgtgtcatataaggctgtgttagggaactaatccctccaacctgcaaaacagaatgattcgttagcgcttgattaattaagtattagcctttttcgaaaatggattaatatgactttttttaaacaactttcgtatagtaaatttttgaaaaaactaatcgtttaatagcttgggaagcgtgcgcacgaaaaacgagagaagtgagttgagaaagaagggggaagaacacggcctaagaccctgttcagatgggactaaaacttttaagtccctatcacatcagatgtttggatattaattataaatattaaacatagattattaataaaacccatccataattttggactaattcacgagacgaatctattaagtctaattaatccatgattagcctatgtgatgctacagtaaacattctctaattatgggttaattaggcttaaaaaatttatctcacaaattagctttcatttatgtaattagttttgtaaataatctatatttttaatactctaaattagtgtctaaatacagggactaaagttaagtccctggatccaaacaccacctaagtaatataaggtttcatggtcgtttggaacttaaattaaacactaaacactatagagaacttggataaattgatcactcagtataaacactatagagaatttggataaattaaacactccaaatcaaaatgagaaaaaaaacacgtacttaccttcctcgccacatattaaagttttctaaagtttgttgattttacattattctatgcttagttgtcaaaacatgtattatcttttgacatcaatatagtcgtagcgttagcacgtgcatattactagttaaaataactttaaaaacaagagagaaatggtgctggtagaaaagcacgtgcatattactagttaaaataactttaaaaacaagagagaaatggtgctggtagaaaagggatgaactcataggggattcctgctatttcccttagatataagcagatggttaattcaaataaacagcgcacaaattaatagcgtagggatgagttctaacaatggtaagatatcctgcaatgttcaggagactcatttaccataataatcttccaatgcaaaacaacctagagaccagaaagtctgtcggcaagaattaaatttgggcacttctcaaaaccatggtaggtagctggtacaggatagaatacgaaatcacagcctgcaaaccacaaaaaaatgaaacagatatgagcgctaaagaacaacttgaactttttcttttttatcagcttctcaacaaaataccagttttctgaatgtgctcctctatcgtggatgtgcccacagcagtccgtacctactcggcatttgaacgcctcgttgtaaggtactaaccaccaaagcatcataaaggtatggaacaccaagctacatgatgttaaaaagaagttaagaaaaaagaactgttgtgttgtagatgctaggaagaaaatgattattataaaagaatccagtgaaattgaaaaattattcagatcctatcactgcttttcaaaatccttcatttgaattaacattgctctcaactcttgagtagtgttacctaaattgtttcagaaacttattttcatttgcatcaataaccaatctttggtttataatcgctttgtaaacaggccatgcaagccgttttatataaatgaagacagtaagcgcaatgcaaaatactactccctccttcccaaattgatcattaagcccttgagactcttaacatcaacagatgtgcccttgagactcttaacatcaagcccacaaaagaggcaacttctataagttcataaaaaaaaatgaaaacaattccaatccacaccacacagggccagtgtgatttattctcatgccaacagccttagctacacgacagcaccattatagggatacaacatctaccaagcatgtctcgtgcaacataacaatatctatttattggcaattatacagatgagatcactaatttgttgccaacaactttaaactttgctatgtcaaaatcagtgggcattcatgcatataacaagacaaaattaaaattgaagattttgaacaatatctttgacaagcaggccaagtcaacaaagtctcaggaaaaaagctatcaatgtttcaaaaaagtcagaataaatgactcgacattcctatgtcactaggccataacccagaagttgctaaggctataacccagaagttgctaacaagcatttttaatgtaatcaatattcaatataccttgaattggatcctactaccacgagagttgccattgtgttctaagaacaattctgaaatgtggaaacatttatcagaactttgtgccactgagattatagaaatcccaggaccatatatgttaatgatccatcgtcaaatcaaatattttactcgatgtaacgtagagcagaatgtagtgcaaactggttaaataatttgatatccccgcaataaataacacaactttagttagtgaatgtcaaacatgttatggttactgaaacaaaaccgcgtgtaaagtcaaccttggcattgtctctacatgtgatatttcttgtcatgttttgacattgtttccactacgcttccttttagtaggtttcgtggaagtgtttgtagtttcagcaaccatgagtttttgagcagacagctggccaataaagagaacattctgtgcccaaccagcatagttcccaaatttagcaacaaatgcatcggcaacagcaacactaagttttggggttaagctcttgccagctagctccggcatcagatattgtgtagcaacctgcattaaatccatataggaagggcttaaaaacaaaatacaattgtttgtaggtcatataaaactcatgtgaaaaaacctccttcacaagacttcccatcaactttaattgtttttatgtctagagagtgaagtcaattgtgaatacattgaatactatttcccattcaaatgatgaaagtcccaccctcacccaactaaaaaaaatgaaaaagggcaaaccttgttatgcagagcttatggttcaacaaaaattggaagtaaatatgatcagggtagaatgtgcaaaacaggttcccattcaaatagtaagaatgtgtaaaatgatagtgagggaactgacatggatgtgaattaattaattttatcaacaatttttcatggaaaagtctatgcatactaaaattttcttacaaaattcttacaaactctaatgtggtaagccgtgagtaaatctagatttgttgcaacttccatctagttaaatcaaacggttgagacatttgttagtataagagttttgtaagaaaattttattatgtgtagcagtactcattttcataccttccagacatgtgtgtcaacaggaatagcatggttctgatcgagtgagaacaaagcaacacaggctgcaacttttggcccaacacctggaagggtgcaaagagcctcaatcacctccgggagttcccttgtacgcaatgaggcaagccatttctcgcctccaccaggcttggcctgtaatattttagcagtgccgacgatgtactttgccctgttcatttattagaacacagcatttgctcaaatcagtgtgctattgactagtatctcaaatcaaatgtagtatacataatatgatagaactgagttatgattcaagcaatccaaacaagtgttacgcctgattcaaaatgttatttccccaaagctgaaacctcaccacacaaatgtgaagttgagattctctacatattcatcgtataaacagtaatggtaggatcatcgttttatcgtctacgagctctgctattatcagcacattgatatagcacgcgaatttagtcacccattatgtctgaattataattaacacaagatctagatcctaccaatgccaaatgggttaattggaaaatacaaagtaagcatcaaaatgaacctatagatgcttcaaccaatactactccaacataagtaacaatgactatagatgaaaatcctttgtgaactgacctgtacccgaacccggcatcccggagctcttgctccgacacgcgcgcgagccgctcgatcgtggggaattggtggaattggtatcctccaacctcgccgagccgctccccgtagccggccagcgcccacaccatcttctcgatccgcgcgatgttgttgttggaggagcagaggaactggaacacgcactcgacggggtcctgcctgagcacccgggcgccgccgcccccgagccgcgcggagacctccgcgaaccgcgcgtccgcggcggcgaaccggcgccagaggtcggcgagcggcacggcggcgttgaggtagtcggagagcgcggcgcgggccgccgcggggacggaggaggaggaggagccgccgttgttgtggaggaggaaggcgaggcggccgtcggaggacgggaggtgggagagggagacgaggtgaggccccacggcgccggtgaagcggagcggggagagagacgtgcggcgccacaggaaggtctgccccgtggggagggtgagcgggagggacaggtcggcggcggagagcggcagggggtgccactctccgtcctcctcctcgacggcggcggcggagaccagggggaggcggcggcgggcgggaggagggcggcggtcggcggcctcggatttgggggtgcccacgggcggggttggcggtggtgttgcggtggtggaagagaggaggggaggggagggtgggagcggcggccggactcggcggcggcggcgaggtggcatcccggcggcggcggcggcggcaacggtcggaaggggaggatgacaccccatgaacagctcaaagacgagcactccaaagctgtaaacatcgcacttctccgtcacccttgttgtatatgctagctctgccacatcaatattaagaccttgtttcaataaatttgtatagaaggaattctattctattttgtacaatctaagatgcatctttgcgaggttgactataataactattatcagaaaatactaatgagatgaatgcctaagctgttagctcaaatacttgtcaaaatgttaacaaaaaatacaagaggataaagtaactgatacattataaaattttacctggagcaagataaccttttgtcccagcaagctttgtgcagttcgatgcctctacatctagaattttggcgataccaaaatcagatatgcaagctctgaattccagatcaagcaaaatgttgttgcttgttatatctcgatggactatgggtgcaaagcaatcatgatgtatgtaagacaaagcattatcaacatcctttacaatatttatccttcgcatccaatccaactcaattgcagtgttatggttctccaaatatcttgacaagcttcctctatccatgtattcatagacaagaaatttgacgtgaactgcagaacagtacccaaagagcttcacaatatttcgatgccgaatactcatcaaagcatctatttctcgcttaaatattagctcgtcatcttccgtcatatgaattttctttactgcaaatatctcacctgttggcaactgagctctgtagacagatccatttcccccaattccaatgcagtgagtttcgttgaaatattttgttgtttcaaaaatctgcctgcatgcatctcctccctcaaagttccagactgaaaacacttttgtgtttccaactccattttcactttgctccccatatttcatctttctgcgttgccatgtcactagtgacatgataaacacaatagatatgccagcagcagcaactataccaagtaaaatgggtctgaatttctttcctttgccacctttctgaataaggttgcaaggtggtaaagctttgactgtaccacacaagtgtttattatgcacgaaccactcaactggagcttcttccaagaacttaatgtgtggcactggcccttccaaattattgtaagacacatccatggatgagaggctgatcatacccttaaatgatggtggtatgctgccatttaatgtgttgtgtgaaagattgagggcttcaagcatgttcaaaccactcagctgacttggtatgatcccggcaaatgaattgtcacttaaatccaacaattcttgaaggtatgtcagcatccctagtttaataggtatgcttcctccgaggtgattatgtcccagccttagtgattgaagtttcaaacagttctcaattgatccctgtattggtccgcttaggttgttcaatgataaatccaaatactcgagattctgtagagaacctagttcctctggtatgtttccatggagcaagttgttcgcgaggctcaaattgaatagagacaccatactaccaatttctggtggaatgtgcccttcaattttatttgatgaaatatcaaaactccctaaccaagacaatttccccaagcttgacggtaggactccggttatgcgattgtttgatacatgtagatgttaaagggtatatgtgtcttttcatctcttgtatacattatatgtggtccttgaccataagtcaatagtacatagtaaattccccaaatttatctatcactgtaagatggtatcagagctcatgggctgaaccctagccctcgatccccgttgtccgccggcgctccggcttgccggcggcggctccctatcgggcaaatcttcttcacgtcctcctcgtccggatcagcagcgggattcacagcaagtcagtgtgattcgtccgtcaagcgtgagtgcatcgctcattgcagccgctcgtcacgcggttgctccgctcagccgttgttgctgctcttccactactgctgccgctgtgtgctgctggtgctaattcaggagacaatacatcaagtcctgtaagcaagtctctgtccagtcaatttgtcaaattttcttctgctggtcttgatggcaacatccgacccctttcttggaggtggagctctgctctccacggacattaagctaaatggtcaaaattatcaagaatgagaactttcagctcgtatgcttttgaggtcgattggtcaagcatctcacctcacagatgatcctcctgatgagaaaacggatgcaactaaaattaaggcgtggaaaacagcagatgatcgtgttatgggattcatattcatgagtgtagaggtgcctattcggatgagtttcagggatcacactaccgctaaagagatgtgggactacctcaaacagaggtacactcaagaaagcggagctttgcgtttttccttgctgcagaatttgcacaacttacaacaacaagatcagtccattgaagaattttataatgcctttactcggttgtctggacagcttgaggcacagactccaaaaggtgcttcaggttgtgcacaatgcaaggcgagagagaagcatgatcaagaaaatctagtgtatcaatttgtcatgagactttcctctcaatttgagtccattagagttcagttgcttggacgtcctacacgtcctactatggcggaggctcttgcagatctaatcgctgaggagacacgtctttgttccttggacactactcctactcctg

SEQ ID NO: 11582 - DNA, 13633 bp, Oryza sativa
  unsure (1)..(13633): unsure at all n locations
aaccctcatggttttgcattagttaatcattcaaagttttgagatttgattgcacgcattctactattattactactagtatatatatgtaagaaaaggagatagtaactgtgaagtgttcataaatcctaatgtctggagctatgtagatgtaggtctgttttgcttttgcagagattgaccaaccctctcactggtcactgcacattcctaatccttttcaggaccaccaaaagacaccccaaaaatctttgcacaagtcaattcccagacaggttatgagccagcactactgtagtacaatcctagcaaagtgcaattttccactcctttctttaagcatttgcaaggaaaaagatgcagcaagcttttgagcaggtagagggagatctctccaagtctgggtacagtttgattctaggacactagaacaggagatgaatagaacaaatggagggataaagtagggtagggacccccccccccccctcttccctcccctatcacacacagagagcagagtacggcagaatcagaactgaaagtgtgtgtaggagcagcagctgagccttttggcagacaatccacacttgttgactctggggctgggagcaacagcagtacaggtaggaactgagccaccctgccctgcagccaagatcacaggcaaggctgccatggaaagatctccacagcccatccagccagccatgaccacaacaccccatccatcatctatcacaagccccataacctgactgactgacagtcacacactcttctctatctctttcactaaaacaagttgaccccagagagcaggcaaggtactcctcagtaaccagaagtagacaagaaatgcaggaactttctgtgccttattgaccacatgtgtgagtgtgtgcccaaaggtgagcaaagaactcacttttgttcaggcaagcaggggcagagtttgatgctgcagagcaagcaggagggcatggttgcagggttggttggtctctcaccagtgctagcttccagctttcatggccccgctcatctcatcagttcaggcagccaagggagtactccacctccactacttgtacgctcctctggtgtgacagtaaccatggagatactgtaaaagttcagaactgtaaacagaagctgtggagacggatgactgcagttacatacaagaatgttagtagtactttgtaatacaaacatgatgagatattgagatagatgggtgctgagaatgcagtcagagaatagtgtaaagatagatggcgatgcaagaatgagatgtgagtatgtgtgagatcaagaatgagatgtaaagaccagtagttgcgggcagggcttagagaccataattacacgagacaaggtgtgcatacaccacagtcaacaagagaggggaaggtgaggtgaggggggatgcancaagcaaagcaagcaggcaggcaggcatccaatgcccccacacacttggtttctctcttgccctgatccatgcaaccagcagacagccctgcgtgtgccatgatattggctaatttggtgctttgctcgtgtgaggtcatggcaggatgcaacacatcttgtatccgtgtgtaggagctgcaaaaaaaaaaaagaaatagtagcatcaatccgtaaacagcgaggccgaggggaatgcaaaaagtttcagataaacctaaacctatgtcaagggtttcagtttgaacaaagtgatgcaaaagtgtaaaatgtcacctcagggtcactgttgaggaagaagaggctgaagctggtttgttgctgatgttgcgattagcagatctgctatctgctactgacgtttcaactgcactagagatcatcagaaaagactagccagaaaatgaaccctcactgcaagacaaaccgactcaaacacataaacagggagatttagtgcctggtaggaaacaataacaactataaagatttgacacaatcttctcaatagtcatcggaggatgcatcgaatatgtaacagggaaactgcacctgacagttcagaaatgtcccaagtgcaaataggaaaagatgtctgcacaacaaacaccaggagagggccatagcccatgggtttcagatggacaccgacataataatacaaaccatattagattgcatcaacgatttatatggcaagtatctgttactgcacatcacacagcaccaaccacatgctacatttgtactcttgtatatgtacagatctcagaatgcttattatgtatgagcatgtcacgcatcagatatatatgatggtggaatcaagaaagttcattctcagctgcaacagaacgagtaaaacacttgtaatcacaagacagatcagaaacagcagatataattcactatggttgtaccaggatgtgaaagctcatagtaaatacttgagaatgaaacagcagatataattcactttatgtacaagtaattttcatatatgtatagttgttatatattacaggaaacactctgctgtccatggaaatgatcacttgatccatcctcacagatttaccgtaaagcaatatgtccatggacttttcactaaacttacaagcaagtactttaaacagctaccaagaacatctcttgtccagtaattgtccaaaataactcctgaatattagcataccctcacatctgaacagaaaggtagtcttgcctagtttatatagcaacaaaggttggtgcagtcctcatggcgaccatttgattacatgattaacgtgtctgctgccatgaatagtaaggtcaaaccaataattaatcaaatttatggaacatataagtggatgagtttgtacgaatacatatgcacgaaagcaaaatccaacatcccaatataactaatagtatataccagctaatcaagaacggacataatattctcttaaaaatgtgacaatcttaaactaatagatgatcgtgtagcatgtactgatgtaaatacgaggcaaataccagcacccaatgctaacaaatactaacaggtaaaatattgtgcctgacattctgcatcaattgctcattttctcttgatgaacctaatttagactcaacagaacacatggtatgtctccggcacataatcaagacgcactagttcaaagtactacgttgtcttgtgcctagacagcaaccaaatcaaaagcatgcattggcatcaactaatatgaggcatataaaattttaaattaatcgcaatagcgtccaaacagcgcaggtatgaacccaaggcttgctaattctgtttcaccagcctacaaaatctgcaccactaagacgctactcaaatcacaggacaacaaaattaccaacccgacaagaacaaccccagacaactcaattcaccatccagcgtttcgccacaagcaatttcagcatctcacgcaggaacgcggaggagctcctctggacggtccccacccgtgcagtgcactgaaacctagatccggagtgcacggaacaaccaaactgttcatcaatcccatgatcccagcacaaacccagcacaatgatcacggctcacgtgatgagccttacgttacgagacagcacgctacatcccaattatccaagcacccgatcaggggggctacggaatatccacacgctaaacctagtttgggggagcgatcgaacagagatggacacacaccctgaccacaccaagcacacggaatagctagctatctaaacaaatcacgaagcgtgtgccgcgagtagactcacctggtacggtaggtggtaggaagtgttgggggcgaaatctctgtagggcgtggggctcaggtggcggcggtggcggggccgcggaggtcgtcctggatgggggggaaggagttgcagcagtagcagcagcagaagcagcggccccaccgccggaagcagcggcagtagcaccaccgcccccgcacccgcgctctccccgtcgccggcgccggcgccggcccgccgcccgagtaatccattagaaagaaagagagagtgggtgtgatgaagaggtggagtgggtggaaagtttttgggtggaggtggaaaaggaaggaatcacatatggagtgaggaaagcaaagcaaaggggagagcttcagtgtggaagcgaggggttctggaagctcctcctccatctcttggattccatcgtctgccttcccgccattcccctgacaccgaaagcgcgcgagttccatcgtctgaaaaaaaaaacaacaaccagtcaatccacctacctgaagaagaaacgaggtgtggcttgggaatttgaacttgattggcagattaagaagatgagaatagtgatcaccgatggaaaatgtcaaccgtcagcacgcaatcagtgatcagtccaagatggcgagcgtgtccactcgtttctatcccttggagttcaggcaaacaagcttgaaaagaaactaatcagctctgcaagaaacggcctccgcctacactgattatcctgatactccagaaagaacagtgatctactgatcttgttctcttacagtttcaaacagatccacccaagaggcgttggcaaacctaataacaagatagagtgagtagaaagaattctagtaacagttgagactcaataacgaactgcatcaaatttgtaaaattcagtaatggtgctaatggaaagtagccattttgttttgaggatttcacaattaacaatatatcaattcagatggtttagcaattaaaaacaaaacacataaatattgatagacctgagagttcattagttaccaccacctgcacgaaagttcatcatagttccatccaccattttaaaagaggattaatatgcctacaatcttcataagacagggaataacaatttgaagcaaactaaaagataaaatcaattgcagtattcatcatttcacagaaaataagcactatatcatggcaaaggtggtattgaagaacagtctgtgcaaactgcaaaggaagtctattatggttttctccatactcaccttggttactgatatatcgaccataaataccttggccagtattttggccatcctttgacgatgtccatgattccaatcatactcaataatgtaaaatctttttcaccaatagtcattgcatgagcatactccatcacgaaacacatggaaacgatgacggtcacgcacaatgatctcccgctcgtagagcttggacacaagcttggaatgcacatggcaatcacggcacactcgaaggttcttgacaatacgaataggaacgccctggggaatgtttaagataccaaatgctaatgccagcctctcgctgtggtaggatagggcgatgcccttatcttcctcatcatccatgtccataatcacctggcttgtatccttaacatagccaattagttgcaatctcctctctatatcttccaatagtgcatagattttccttgtgagaggatgtcttgtatccccggaaataaattcatggaccaaaccatttaactctatgaagctcaaacctgtttctttcttggctcccctatcctccatcatctgccgaatggtccttgcttcttcccatcgaccattgacagcatataggttgaatagaacaacataacggccaccatcatatggctctagctcaataagccgcttacccacacgctcacccacattgatgtcattgtgcatttggcatgatgacatgagtgcaccccattgagaagcatgtggctccattggcatatccagtaacagagcttcagcttcttctacattccctgcacggccaaggagatcagctaagcatccatagtgctccctttgtggcttaatgccataatcctgcatggacttgaaaacccttttcccttcgtccacacgccctgtatgggtgcatgcacataaaacagcaataaacgtcgactcatttggcatgaaacccttctgaagcatccttcggaataattcgagagcacgctcaccatagccattcatcgcaagcccaccgatcatcgcattccacaacaccacatcgcgacgatgaactccatcgaaaacttgccaggcatcctccatgcacccacatttgcagtacatgtccacaagagctgtctcaagcatgagatttccacgcctacctccaaaactccctgtctccagatacctatgaacccaacgccccctttcaacggcgccgagatgcgcgcatgccttgagcacgctcaccagcaccaccacatctggcctgaattcctcccgcatcatccgatcgaacacccataaagcctccccaaactccccggcacgcacgcacgcgtccaccatggcactccaggaaaccaggttccgctcgggcattctggcgaacacctcccgcgcagcgcccaggtccccgcccttgccgtacccggacaccatcgtgttccacgagacgacgtccagcgcggcaccaccggagtagagcaccctgcgcgcgcggtcgaggaggcccagcgagcagtagagcttgaggagggagttggtgacgacggggtgcgcgagcgcgccgcacttgaacgcctgagcgtgggcgaggcacgcggcggcgaggcgcgcgcagcctgcggacggagaaggggacggggaagacgacgacgacgacgcgagggcggcgaggaggagggagaaggtgaacggggtgggcggcgatgcctcctcgcggatgcgggcgtacagggcgagggaggcggccgccggggcgccgcggcgggcgagcgcggcgtggagcgggcagcctcgggagggcgccgacgataaggcggcggcggagaaggaggaaggtggggtccggagccaggggaggaggcggcgggggagcgcgggcgccatggcggacaccttgcgttcagaacagaggtgcaaagaagtttgagccttggcgcgccacgtaaaaacgaagagactcgcaaacgaatttgaatccttcagctgacgtttgtccttgaattcgatttatttcaccatgattttgtacgaaaaataaacgattactagtactactgtacgaatttggtgtagaatcttttgcattccagacttatcacgggtgttgggcacatggtaaaaggggtatcagtataatgaactccaggtttattttactactagtatgaaatcaggcactggttttccaacttattccatattttgcaagatacttgagttgtgcaaatcacagtagcatatgaaatattcccctctttttatcaggaaattttgttacacaatggtctagtatgtactaatagattttatgttcagatgttgtgctatttttcaatgataatagatgtgtatctgctaagcttcttttttctgtagctctgcgtgcaggaaaacacaagcataaaatctgaaaatgatgtctttcggagatgttttcatcattaaaggtcaacaaatgtcatggatcttacagctttaagtgaagcaacacagatatgaggctcaagaataacaactctggtatatactaacatctaaactatgatcgcagctatatatggctagttgaacatgaaaattgtggcaccgagagggggatcaaagagaacaaaagggacaagaaaacaaaaaccatggcatcccagcaatgtcgccgaagaacgtttgtactccataaactgccctggcttcttggccaccaaaacatggctgatcacttcacggaacaagccacacatacaaagtttttcgccccatctgtctaaaccggggtcaatttttagtcacactttatgttcctgtagatccttctcacaaacagtgtcgatccaagatacccgacagcacctggaccaaaattcgaaccggtatcagttgaaaccatcaaattcttgggtttaagcatgctaccggtgtagaagagcttaccgcagagtgttcctaaacctaggcagaacataagagtgtagccgaagtagaaacttgtctgaaagaatcctgacatcttggtcttcacatggtaataatatacggagtagaggtaaacatagacggcagtagaagcagcagagaagaatgaagtccactgccagtggtagttctccgcattcagcaggaaatatgtaccaacgattgttacacagatggtgacaattatgaggatcaaaaagactagcaacatgaacccatatacatagtacacctgtcaatagatgatcaggaaggatgcataagtctcaactctcagggctccttagtaatgaagcctgtatgggaaaattagtgttgcctgttttaccttgtagttccaaaatgatgtgaagacaaagtacatctcaatgaagatgctaccaaaaggaagcagtcctcccatgagggcaatgacagaaggcgtgaggtaccatttcttctcagggatagggcgaggaatagtctttactctgcatggattatttggggcaccactccagtttctaccaacaacagttcccaaaagagcaagagggaaagatatgaaggcccacaggatgaacacaaccaccatagtaccaaatggtatggcagctaatgatcgatagaatatagcgattgtgttaagcactaggccaattccaaagcacataaacggaaatagtgatgctgtcataatcattgccttgatccagtttttccctgctcagcaaaccaaggatttaaatgaggtgagcatcttatagtaaaataggtgtgtgcctgttcaagatgtaaagtaaactgagttcatacccccatgccgtgaataaagtgcaccactgacatatccagagatgaatgaagtaagggcataacaaacaatgaatgttgtgacaatagctcctcgcctacaataagaatataaggtgtgagagatgcgcttttgcatagaatcagaaagtacgattagacttaaatgcttcataaagtagttcagctacttgtgaaataaaagcaaaatatcaaaaataaagataaatgtgcactccaaagaaccttttaagcagttcattgacaggccgaaaattagaaaagggggctgggtttcatgtgaaggcggtaattatgatttgacaattcctcacatgtcataatgtgattgtagttataaccacacattcaggcacacctagaatctggaaagccttactgcgaaaaccaatgcagtcctgtctacgttaacaaattgtgtattttaaactggaggtggtgtatgctgtttggcttgacaaaagtaacaagtgacaggatggagaaaacttaggggcctaaggcatttagtagaagctgcctttatagaaatcggtgttaattgtagtgatttgaggtaaatcataaatgatgtgcatacccaatatacagcattccgatgattgccaacaaaatcactagcagaataagagcagacaactgtgtgccaacaccaacaagggctgaaagaagagccaaactgcgaggaggccggaaaacatccccatggacaagcttccatccagattcttcactgacatctctttcctgatattgaataaaaatgtcagcaagaggatgtatgaagcgcataacagaatttgtacattatttgaatatagatagtcaatcaccagagtttcaagatcatcatcgtcgcgggcatactttgcatagtcatttcttagagtgcgcatcaaaatcattgacactagcccagtgagaaagataaccatcatgaaagaattgaagattgagaaccaatggatctgccataaaatggattatctgtggtcagaggaaatgctgcaagatatacatgggaaattgagaatcaaggcataattttttatgtggaaaattggcaacaaaatacataagaaccaaggtgcagaaccaggctttaattgcagaaactgagttcttacctggtgttcaaagaaagggtagtcaaggtatacatcaaagcggtgagcaaatgttacattggttggttcccacttgacagaatatgtcatatccaatgccttacccgcatcaataagctttggactttcttgagtaagattaacatgaataatctacaggaatgtaacagtagtaatactcagtttcttgaaggtcctgcgaaggaataaatgcaagttcatgaaacccaaacctgattgccattgtatctgatgacgatgttcttgtgagtgaaaaggaaatatttgttatcgctatttctgtctgcctctccaacaaaacctgttaagttataagttattagactatatataagatctttgagagaaaatagtaatgataaaagaggatacataccccatagaggcaaatcatctttgatagtggcatagaatttcccagaagtgtgcagaaaaggataataagtaaatcaataagtcacagtgcgtaaaaatgtttatgcgtactgaaaaatggcaagtaaacacaccagcggagtcaagaaggaaaccagaacagcttaccaatgaagaattcaaaccaatatgaactctcaatcgcatcagataactgtttggccttgtcaggatcaagttcaattgaacaaatggtacccttgtcaacatcccctgagacaaaccatgatcagtcttaaacactgcattttaccttcccgtttcaatgttcaaaactgaagcagcataaaaagaacaatgcacaacaaaagtgattgctcacttccaaactttatgtcgatctggctgtcaatcagctcatttccaccgagaacctccccaagccctccccatttatgcacggggttattggacggatggcaaaacggaaggctgtagtagttgtaagtttcctgtgggttgttgtacgggccaaccttgttcacccagagcataaccttctcctccgattggtactacacaaagcgaagaacacgacacatcgtaaatgttccaaagcaccagacaaacacattcttcctccaaaatacacagtaggccaaaatatcacctaaatcctgagttaattaccgcaagaccaaacattacagtcagactaactgcactagacgttacagatcaaacgagtcaaactttcagaaggaccacggatgccgatagagacgaactctcgcattgcaacccctccatttctcaccactcgcgcggcgagatctctagcagagaccacgcgacgagaccccgatccagcacgagggagggactggctacccggagatcccgccccgccggagcccgcgccacgcagatctgaccctcccacccgggcgagcacggatctagcggaaccacggcgcacacgtccccgccacggcggcccgaacagaccccgtcgccgccgggtgggtggcgaccgagtgttccgacgccgaagcgcgcgccccccgtctgttgttcccagcgaggcggtgaagtgggaggaggagctggttggttttttaccttgtggtcggagtcggaggcggcggcaaggggggcgaggaagacgacgaggaggacggcggcggcggtggcggtggccgcgtgggcggcagcggaggccattgggagggacggcgagtgcgaggagaggagagggagggagcgcgggcggacgcgcggtgcagtggctctctcctctctgctcctcctattgtgttattattacgagagtactactactagtactagtatttttttttctttctttttgtttttttatcctctcccgggctgttcgttttgtttctctcttttttttacatttattaataatttaacactgcttgaaacgggcttcgattgttttacattttaacccactttcattcactcagatggtctcatgtatttcctccataaaaaaaataatctaaaaggggatatgatttatccaaattcgttacattaagagaggttacatcctggtcacagcgtgttttaggtttttcttttttttacggatagagtatcaatcctataagttttaattaaaataaattggacactggaaaaaatattaaattatcaaatgtcttgtgtgttggtgtcatcaactggtgttgctgacttcctgcatggaggagcgagatggttgatggggttgaggaggttttgaggagaggcacctctcgccggttgagggtaagggcctgtttgtggaactttagattttgagaagcagttgtttgacagccagtttctaaaaatctggaaaagccctgaaacccagcttctccagcttctggtttcttagttcattttttagaatctgtaactacatattctcagaagctgtgcattgtttggggtagcttctagcagaagcagcttttgtaaaaagctgcagctgggacaagctcccccaaatagggcctaaggctgtgttcgctagtttcggttaggaacacatgtcctatgcacgaggggtctattagcgcgtggttaattaagtattagtatttttttaaaaaaaaatagattaatttgatttttttaaaaaaagtaactttcatatagaattttttttgtaaaaacgcaccgtttagtagtttgaaaagcgtgcgcgcggaaaacgagagagtggagttgggaacctatgagaaagaactcagccttataaaacgtgcaatgtcttacggaggggtcgattagtaaacatattactttctccgtcccaaaatgtaactacctagtataggatgtgatattatctagtcctacgaatctggataggaggtagtacaacaaatctggacagcttcgtagtggtagcactggtggagaaaccatttatactcccggttggcaaccccctttagtcccggttttccaaccgggactaaagatgggcctaaagatctttagtcccggttgaaataaccgggactaaagatggatctttaatcccggttggtaacaccaaccgggactaaacgggactaaagagagggtagcggcagttccattaggtctccttttctttttttcattgttttttagccagagtttaatccctatatttcctctcaaatcgagtgggatgcatatccaaatcaaaccccaaatcaaaataacatcccaaaatattcacatcacaaatcttaagttacttgtacacacaaatcaaatacatcacaaatcttaaaaaaaaaattacacacaaatcaaatacatcacatattatacatctcagatccatacaacaaatcacaaaattatacatctcagtgaatcacaaattgtaaaaaaatagaaaagaaataatggatgccggtagcgccacctgccgccgctcgctactcggccttgcgcggcgcctgctgcgtgcggccccgccggctgcctgccgcgtgcggtcctgctgggcacgggaagggaggaggcggcccttgccgggatgggaggaagaaggggaggagggggaggagagggccgggatgggaggaggaaggggaggaggaggagagggagatggatctgaggagagatcggatgggaagggaggagtcggatgggaggggaggagggggaggagaaggccgggatgggaggaggaagaggaaagggtgatgcatctgaggagagaagaggccggttgttggtgagtggatagggaatatggattatatactacgcatgatttggagtaaagaactagaa

SEQ ID NO: 11583 - DNA, 7809 bp, Oryza sativa
  unsure (1)..(7809): unsure at all n locations
ataatgtcacatgtctatattangtanctatattttgacacatggtaagtaatgaatattgataagttatataagaagttttgtgcaagtgtggtaggtatttaagtagaacattacacgtgtagtatttatgtaaatggataacaaaatatagaatagtataatttctattggtaattaaatagctgcctatgtgatatagtgtgacaaaggttacatgtagtaaacttatactacaaataaatagcatttttccttttttttccttttactttatcctttgaatatttcttgaattgtggatattttgtgttttcatcaaactcgttgttatagtactagagtatttttcaacttttttcattgtacagttgattgttcgtatctacttgtatagttttctttttccagtgtccctacatggtatttcactttttgttaaaaatgtcacttttagatttttaagatttgttcttcattattatattaatagaatacttgtcgatacctcgtgccatttcatcacgcaagacaatatataaaaggtccttttccattctggccattttgctcaatatataacggccgatccatgtttttttttgtcatcttaatggtaccaacattattcatgaccataggaggattattgggcacctagctatttatgtgcacagtgcacttgcaaagaaagagcatgtacttcatcattcttcttgtagtgaattgttcactgattttattatagcggtaataacacaaatataaatataatcaaataaaaccattttttgcgaggataaaaacctttttcgttgtggttgattatattatagtcggccaatagcgattgaatatacatactgggcattgcccaaagtacttttgacggtggatccaatggtattcttctaagtgattgataaatattgcttatcatagtttgagaaaaaaaaagtcaattgtgtgtcatgtacttctgtttggtattgaagagaataatatgtctttcatattgttctcttcaccaaaggatggattaagccttcttatgtcataagagtataaaaccatcctctcacatttctttccatttaactataaaacactactcaatagatcattaatcaagatgattttgctacaagtataactaggtgaacctcgcgcgttgctgcaaaagtttaatatgataacaccgagtaaaaatattgtgtaagatagctagataatataatcttgcgtaagtttatgtggtttataataatttaaatttaaatagtatataaaataatgattcaaatgtaaaagtaagttgatgtagttttatgagagaagaaaaggagggagatagtttggatcatagattaatcatctaagagctaaaaacaattgaggtgatatgacttaataaaagaagaaaataagtggataatttggaccgtaaataatcatctaagtacaaaacagttgagtgatatgggttaatgagaggagagagagagagagcacattttcggcatgtttggcacaactctagctcttaactccagctttaagccggagttgtgccaaatggtttagatcctatgtttttaggagtgaagttagcagagctactccttaaatatggactacgaggtggagctgggtttttattgctccatagctccattccaacccaaaagacccactgccttcaattttttttagcatatttacacacaaacgctacagaactacccaaaactcacctcctcacccctctctatccctcttgaaacttcacctcccatgggcgagcacagacggcaagccaacggcgatgctccgacgggggcaggcgagcagtgcgagcagctggcgcgagtggggaggacgcgctggtggcgcacgaccgttggtggggattctatttttttttaatttttttagatctagagctaaaagctagccaaacatttttcaacaggtcttcaacctccaacaggagctagattctattggagtaggagtttggagtcctaccaaacgggaccttcaactaagttatgaattaggatgaatgtaatccatccaataaaaaaaaagccaacttagaatgtgtcccctcttagtataatgaatcaagatatatctggatatgcgtgtgtatgttcatataaataagtgtgtcgtgttgtgcgttgtctatgttctgtgtttataaagaaaaaaaaactaccatggcatctccgacggattgagatccagtgcagttgttactatcactgcaactttagtagttgcaaggtagccgatggatcaaaaacagcggctcagatcatcagaaaatactgttcacgaatcactgtagcgtatactatgcaggggatggcagagtagatccaagctgttggctgcatcgatccaacggtcataatatgctatcactgctaaagttgtagtcgttattttaactgcattggtcataatacgctatcactgcttaattcatccccgaccatgagtagtcctaaagaaaaaggaaggagagtgtgagggtattgcaggaacgacgtgggtttctttattaccgtttccaaccaacgcgctgttggaaccttcgccttgtcttcgtggctatcttgggatcggtgagcttaacgacgcgatcatgatcatgccaggccctgtatagttcataaaacaaaaattttacgttgtcacatcaaacgcatacataaaatattaaatgtagggaaaaaaatcaattacacatatttgcgtgtaaattgcgagacgaatcttttaagcttaattgaaccatgatttgataatgtgatgctacagtaaacatttactaatgatagattaattaggcttaatatatttgtctcgcagttttctggcagaatatgtaatttgttttgttattagactacgtttaatactttaaatgtgtctacgtataatccgatgtgacaaccaaacctaaaatttttcccaactaaacaaggcctaatgcgagttgtcggaactcgggaaccctcctgttcggcgctgatcaatggctcaggccctgtttagttcccaaaacaaaaattttcacgctgtcacattgaatgtttggacacatgcatggagtgttaaatgtaggaaaaaaataattacatatattgcgtgtaaattgcgagacgaatcttttaagctaattacgctataatttgacaatgtggacagtaaacatttactaacgacggattaattagacttaataaattcgtctcacagttttctagtggaatctgtaatttattttattattagcctacgtttaatactttaaatgtgtatctgtatatccgatgtgataatcgaagaaaaagaatttccccaacttgactgcacgctgcagcccccagcttcggttgtgtacaataaaataccactgtagtagtactattctctagtacatcgtggtcaacactttggcagttggcacgaatcaaagtgaccttacgacgcggtaggagtcaacataagcaaaggcaaagaacttgcaccgaatcgggcacactgccgacaggttagaagcataattaagcactggaccgatacattgacgggagctaggaatttacaaaaaatactaggactgaatcaatcaataaagacctcaaccaatgcaatttgttgaatcctcaaaacttttcatgattttttaaaggatttacaagggattaaaggaaacaagcctgatgttcaatccctaattatgtgtctccgccccggaccgataaccgctttcaaatgcaagtttgagaaagaaaatgaaggaatagaaaaaaaaacaaaggattgtaaataatacagaaataactagtgcctgattagactgcagaaaaaaaaatgaaatttgagaaacacataaactcgagaagagaaacagaagaaaacttttcgttaggctgaaccttatgttaaaattaggtgatacacctgctttgctttggaatttatgatgggtatacgtgaaatattgcacgatattgaatattgaaacattatgaaaatgacgtagggagaagataacgtgtcatgcttgtacaaaatttaagatgctactacatctgttctaaaattttgtaatctaggatgagatttgacccataaaaattcattgtcttaagttgagtcaaatcccatactaagttgctatatttttagacggagaaagtactccttccatttcataatgtaagtcattctagcattttccacattcatatatgggaaatgctacttatatatgggaaatgctacttacattgtgaaacggaggaagtaatagctaatgatgatgagttgatatacttgtatgttgagctttaacttataataattgtataacctatatagaaagtatagtttctactggattcaatgggtccaatcctcaatttaaaatagtgggctcaaagccagcacaaacagacataaataatagctgtgggccgaaaccaccgtgtccgaacggcattgcattgcacgtatgcacggcaaaggttgaattaccacggccgtgtcaggtggaagaaagctgtgattcttcaacattggtaagcacatcgaagcattgttagtttggtccaatacctcttgaaaaaagcaggtgaaagcataaaaggttgcaaacaatgattgtattctgtgattgtccttttgaatttgattaatgggagcagcccaacattaccaacctgcataattcagaaggaaggggggtaattctcaattctgaccaactacccagccttattttgaatattgtacatgtatgcaaaactataacccaaaagctaagattttgtaaatcatatgcacaagcactggatgaaaaaacgactgatctgagcagctcattcttcgtcctcagtctcctcatcgtcgtcgctgctagcagctctgtacctcgccccgtccccaacattatctccctcttcctcagtctcctcgctatcgtcctcgtacagcacattcctcggccactggtgctcttcgacaacactaacaggaggttggtatggctctgtgtaacccctgcgcttagggaccttgggcagtggcatcttggccgtcaaggagggcttgcttcttcgcttcgacatcttcgaagaggcggcttgagcaccggcatcctggtagtgattagggtgctctttcttcagatggaggttaagtttgtactcatgaatgtatgccttggcacaaccatcataaggacagacgtatgggcgatcagctgagggagtgggtggagctgctgacggtttcggtgtgtgactattatgggagtggtctgctagaccactgcggtttgttgcagacccacctggattctggagaccaccctatatcagtgttatgaaagtaagtggtcagaactggttccttcctaagcacaaatctggaggtataattagatcttaccttttcatgctgttgcttgatatgagcccttaattttgattcctgtgtaaaccttcgagcacattctgggtacttgcacacatgatagttatccacagaatgtgttttcatgtgtgcctttaaattaaaatccaatgagaaagcctgcaataaccaggaccaaatatgttaacaagaaacataccaaaacctaacaaattaacagcaacaattaccgataatgccaaagggggtggggggtttattccataattagaatgtttgaccatatccaagcatggcccaaaaaaactcaatactattagagaaagggaataagtgttgatatgccactccatatggactatttaacatgtatttgaaatttatgcatcgtacggaaaatgcagtcaaggaatagaaatgaatgacaaagtttacaatggagagatcatattaattacctttccacagccttcatgagggcagacaaagttcttctctcctgtatgaataagaaaatgcctcttcagcttagagctgtctaaaaatttctgcaaagtcagattcaaaaagaaaataacattagcgaacaacccagaagcagcaatgccatagtgatccagaaaggccaacgcaggcaagaaagattacaggcagtaccttgtcgcaaccggcatagtgacacacatactgcctctccccgtgaacatgagcatgtttcctaagagcccctgcatcaacaaaagttttcccgcagccctcatagctgcacaggaagagaacctcggtggttggttcaggttttgccagttctgcttcttgttccttgtccctggatttgagagctgacaacctatcctctgtaaagaaataaggtgaaaatattaacagctgaaagggtagttcacagaacaaaaggcatgcccaagcccaacaaatgaattcaactagtttagtatccttattggttggacatgccgaatgagaactctacactgctcataaatatgtcgaagtgaagctcagatgtagtgcagactgcaaaggcatgggatattggtcaaaagatatacttgtaactcgctaaaaaaacgtttgacaaaatttcaattgttcgctacatttatctcagatcaagttatttatttactagaacaaattggtttatagggtctgaaatttggaaatgataaaaaaaacatagtaaatctcactattccaaaagtcaaaaggactacacctgtgcctcgcagtcccaggtacttggactgcaatgcttatgccatacagtaatgaacggacagcatgaaaaccgaaagcgaactaagggcgcgttttaactgggtgattggatagatcatagacagacagaggaaaattgctcatatggatggattaaatattactcactccatctacttttgatggtcatatttcatcttggtacacagaccaaagataagtaattctacttatcatccatttaagcatgctactagttattcctcgtaaacaagcgattcattaatatttacatttctcgatgcccatgtagtcaatcttgtgtggaagaatggagagtcacgcattaaatctgagaaagtcattaagaggataggttgttggattgaaatatgcttatgaaaaataaaattttcagatttggaaatatgcctatcaaaagtaaatggagggagtataaagctagcaaaaagcttagaaaaacttatctaaacaatgctgatgtagaaagcttttttttaaaaacaaattgtacttccaagagcttcttttttttttttaagaaatcgtacttccaagagcgttgcacaaataatccatacatccattagctgtttagaacgcgtactaattaccgtcaaagctgtcacaaagtcacaggccaagcaaatcgcatagctcccctgcggtaaagctagccaggggaggggccaattcagaaaaaaaatgcctaaacaggtcctctctgataaaccaacctcccatggaattcaagcagccggcaactgcaagggatcccatcgcgcatgataacatcacgcgcgagcatacggacgataaaccgcacatagcaaagtagtaacagggcggggaggcaaagcaaaaaattgaagagggcggggcgtacctcgcacccatttgtagagcgcgcatgggccaccggcgacgaccagatcctgcggaaccctaacaacatgtataagcgcgtggcgcggacgagagatcagatccgaatccgaatcaaaccaacaagaagctctctcccattacaagaacggattggaattcgaggaggaaagaggaacggaccactccttgacccatcggtggcgg

SEQ ID NO: 11584 - DNA, 13267 bp, Oryza sativa
tgcgcgtgtggggacatgctgcttgtcgcgagcgagagagagagagagagagtcaagagcgacgggggcttttgcttggcctcgagggcagttgagccgagacggaatgcggagcagagggaagtactgaaaatctgacgttctgatcctctcacaaaatttattttataattaacccgtgtttaaaactatagtcaaaactgaacctcgagcttagcaccgagttatatgcttgaatataaaaaaaacaagcatatcagagaatagtgaacggtaggaacattaaaaaaaccaaaacttttagcagaaataaaagtttgcgcgcaggcggctgggctggcacggtgacggcgcaaggcaccggcgcgtgcacgtcggcctgggcagggcgcctggcggccggcggctggggtggggagggttggccggttgggatgggaaggggaggtgaggagaagaaatagggttagaaatgtgggcttttatttgctattgggtcaatggacctaaaatggtgggtggtgggagggttcagtttgggcttcttttaagttttgaatgggtataggtatttttcttttttcctatatatacatatatggaatatatacttcatatatgtattttttgttcaaaaatcttgggtattcatttgaatacccacgaattatagtgggcccgcccctggataagttgggccgatgaggacatcgggtcctttgaagggggtatatgtgatatcctggcctaattaggatttggcctatgtggcggggggtgggggtatgtgacatcctggtccaattaggatttggcctgtgttgcccatgagagatatgtgcttgtttagttagcaaagttggaaccaacttataaatcctcttccctccaaccatgccactcctgggtttaccttttacacgaaacaaggatgaaagtgtaagtggggtggtatgtgtaagtgggctcgtccgtcgaatgggatggctatgctattctggagggagggctattacacttttgcacgtcactagtctgactacctccttgacacctattggactacccgttggttagaccgctcgttaaatgtcggtcccgctggttaaaccactcattaaatgtcggtctgattgtcggaatccagaaaaaagcgtatcaacgaaactcttgaaagtagattaactttattgcatcaatatgtgtttacaaagtgcatctaaatcactcctctctcaactcacaaactaggattgaaacatcgaagcaaaccctaatttttctctccaaaagatgatctctcctagcctcaagccatcttctatttatacccataatgtggttgtctctagccacgaatccaactagaactaagacttctaatcacataggaaacataccaaaacagggaaacaacatccccatagaattccacactccaatattcctaaacttagactccaatcaaatttgactcatttttccatacgcgcacaacaccatgtgtatgccatatggaaaccttaacctccatatgcattgctctctagtccgagcatcccacatgatatctttgaccgtctggacctcaacttctcctaagcctagtcctgatctatcatcggttatactcctccatattcgagtacaagttcgcaccaacttgactcacatcagcacacaatagtatcatatacgaataggaaccatctgaaagtcataaacatgaagcaatctagaaattccacgaaaataacccgaaaccgactctccctcgaagtctaccagtctgacagtcgggctacccagtctgaccacccaaacataaatgtcatgatatttaacgacctctaagaatagtatagaacatagaacgataaaccaaataaccaaactatggtatgatgagggagcgataatgaataagagaaaaatataagaaataagctcatgtaagtgctcaaaggtttgatggcctctaagaataaataaaacatggaataagagaaaagtattcaaatcatatcataatgtgacgaaggagtgataactgaacgaaaagatatagcagatctaaatctaatgtaagtgtgatatgatctgatgacctgaaagaataagataacatattaaaaagaagatataggagattcaactctagtatgatgaatgagtgacaaatgaatcaaaagggatagatgatataaggccatgtaattgcctgaaggtttgacaatatctaaaaatggataaaatatggaatgaggatgcaagtggttaaatcatggaggagtgatgaatatgaaaagatatactaatctaaatctaacgcacgtttggtatggctcgatgatatgtaataataagataaaatattgaaaagaaaagaaaagtggttcaactatggtacggtgaagaagtgataaataaatagaaagaaatagattatatgaataaatagctcgaacaactaatgacctttgagaataaatagaacgtggagagatgatgatggaagtgatcaaatcatggtgcaatggatgagtactagatggatgaaaactatgtggtatatttaaatataacataagtatgctatggtccgacgatctctaagagcaagatagaaaaccaaaatgaagaaataggtggttctattatgatgtgacaaaggagtgataaatgaaagaaaagaaattgatgtgtgacacatgagtgataaataaaaaaaagaaatagctgatataaacccacgtatatgctagctacaaaacaaaactaaagatatcaggataaagtgaaaaggtcaattaggcctagagggggggtgaataggctaatttaaaaacttaagtaaagtagaagcagtaattttcggaactaggctgggaattttcggaacttccgaaaatgcacagagctagcagcgcacacaaaaagaagtatctagatctagaagtctaccacatgtaatccaaggcacatacagcaactagaccaatagcggcacaagcaagcaaagttagaggagagggatgaagagatatcaccaaggtgaagcttgcaaacttgttcccggagttcaaatccttgaggggattctactctccgttgaggagctcactaagagccgggtcttagctaactctttcctcaagaggttgcactaagcactcctccttccactaagaggtatctcttcccttgcggaggcgagatccgaccttcacaaacttctcccggccaaccacaagtagatcggtggctcgggagtgacacctagccgtctaggagtcctcaacctccaagagtaaaagatgatgcaaagaactcccagagatgatgcaagtgctcacaaatcttcacaaagaccacaagaaccacccacacaaactcgaatccacactctcacacacacaccaaatccaaatcaaacacgggtggagagatgaatcgaggaagcaaggctcaaatgaactagagagagagagagagcaagccaatggcacaaataattggaatggaaccagcagccctcacaagtgaggggaggtgggtatttatacccacatcacaaatctgcccgttggagtgcaataaaagggattttcggaacttccaaaacaatttttttcaagggaatttgcaccgggaattttgatgaaagcaatttgcaaacctttgataggagatggagtgaaaagaatggtcgaacatttaggccccatttgagcttatggctagcacgcaataaaccacacaaaacaatagccacaagacaaatggatgatccaaagatcaaatgagagtgaattaccatgagacaagatgattcaccctcgaaagagggaatgtgcgaatctattgcaaattgtgttaggaccaacattcattgaaaaatgagatccccatacacatagattcaaaatatccacaaaaatgtgactagtgtccatccatgaattgaatgttcattttatcacaaggagtaaagtaacctatactagaaaccaaaaacaaatgtatgcaaaagatcaagctacgtttcgagaatccaagatattgagttcacttctcaactcacaaaacctagcttcatctagaggcttggtgaacatatccgccaattgtttgtcggttctcacatgttggatatctatgtcgcctcttgtggaatggtctctcaagaaatgatggcgaatatctatgtgtttggttcgggaatgttggacggggttattagctatcttaatggcgctctcattgtcacataggagtgggattttggacacatttaggccatagtctctcaaggtttgcttcatccaaagaagttgagcacaacaactccccgccgaaacatattccgctttggcagtggatagggcgacggagttttgcttcttggaagaccaagaaacaagggacctacctaagaattggcaagtactcgatgtgcttttcctatccactttgcacccggcataatccgcatcggcgtagccaatgagatcaaacctcgctcccttaggataccaaagactaaggttaggagtgtgcactaagtatctaagaattctcttcacggccacaaagtgacactccttcggagcggcttgaaatcttgcacacatgcacacacaaagcataatatcgggcctagatgcacaaagataaaggagtgagccaatgatggaacagtataccttttggtcgacgtctttaccttgctcattgaggtcgaggtggccatttgatggcatgggagtgtggattggcttcgcattctccattccaaacttcttgagcatgtccttcaaatactttatttggcaaatgaaagttccttccttgagttgcttgatttgaaggccgaggaagaacttcaattcacccatcatggacatctcaaaacgcttggtcatcattctactaaactcttcactaaaagacttgttagtagaaccaaatataatgtcatcgacatatatttggcacacaaaaatatcattattatgccttttagtaaaaagagttgaatcggctttcccgatctcaaagccgtttttcacaagaaaattgcgaagacactcataccaagctctaggggcttgcttaagcccgtagagtgccttatggagcttggacacgtggttgggatattttggatcctcgaagcccggtgattgctccacatataccaactcgttgataggcctgttgagaaaggtgcttttgacatccatttgatatagcttaaaattgaggttagtagcaaaagcaaacaatatgcgaattgactcaagtctagctaccggcgcaaaagtttcaccaaaaactaatccttcgatttgggtgaacccttacgccactaacctcaccttgttccttattacgaccccggcctcgtcttgcttgttgcggaagatccactttgtgccaatcacattttgccgaggtcgctccaccaaagtccacacttcattccaggtgaaattgttcaactcctcttgcatcgccattacccaatccggatcattaagagcttcttccacccttagaggttcaagagaagacacaaacgagtaatgctcacaaaaatttgcatatgagaacgagtggatactcccttgttgatgtctcctaagatgttgtcggtgggatgatctctttggatactttggtggattcttgggcgagctaagttgatcggtgagggtggaacttgctcgtcttcttcaccttgattcaagcttgaggtagagggatcgtcggcttgggttgatgtaggtggttctacttgtgttgaggaagaggctccttgttgtggctccctaggacgtacgtccccaagagccaatcttttgattgcttcgctcggatcctcctcttcacctaacacatgtgattcaacttgctctacttgagagccattagtttcgtcaaatgtcacatcacgcgcgatctcaacaatactggaggttttgttgaaaacgcggtatgtgcattcatttgacccatacccaagcaagaatccctcattcactttaggagcgaacttagaggatctagcctttttattaagaatgtaacacttactaccgaaaacacgaaaataagagacatttggtttgttaccggtaagaagctcatagggagtcttcttaagaaggcggtgaagataaaggcggttgatggcgtggcatgcggtgttgacggcttcggcccaaaaacggtccgatgtcttgtactcatccaacatgatcttcgccatctcaatgagagtcctattcttcctctccgctactccattttgttgaggtgaatatggagccgagaactcgtgcttgatgccttcttcatcatggaaactctcgatgcacgtgttcttgaactccttgccgttgtcgcttcaaatgttcttgatcttgaggtcgaactcgttttgtgctcttcttgcaaacttcttgaagatggcttgtgtctcactcttgtcatgcaaaaagaacacccacgtgaagcgtgaaaagtcatcaacaataacaagaccatatttgttacctccaatgcttagataagcaattggcccgaagaggtccatgtggagaagctctaatggtcttgtagtggtcatcacattcttgacggggtgatgtgctccaatttgtttgccggcttgacacgcgctacacaccctatctttctcaaattgaacatttgttagtccaaggatgtgatcgtgctttagaagcttgtaaagattcctcataccaacatgggctagcctccaatgccaaagccaccccgtgttagacttagccactaagcatgtctcatgtttggctttacttgaggaaaaatccacaaggtaaagctctcccttgagaacacccttaaaaactaccgaggaatcattccttctatagacggtcacatcaacatcggtaaaaagacaattgtaacccatagaacataattgagaaacggacaaaagattgtagtttagagattttaccaagagaacgttggcaatggaaagatcagagattgcaatcttacccaatcccataacctttcccttttcatcgtccccgaagactatgttatcttgtgaagtgccatttggatcaagagttgaaaacattgattcttctctggtcatgtgattggtgcatccactatcaatcacccaacttcttccaccggagacatattcctacaagagatcaatttctagttttaggtacccatacttgcttgggtcctctcatgttagtaacaagtgccttaggcacccaaagtactctcttgatagaaatattcttgccccttaggcctacatacttagcaacaacataaccactagcattcttcctaagaacataagatgcatcaaaagaaccatgtgaagcataatcattagtaaggatacttttggccttaacaaaattgctaagaccttagggactcttgatcatcacactcttgtccacctttccttttggtggaggaacatacccaagaccctcatggttgaagttgtccctttgatagcctaggtactcctttagggccttactacccatatggcacttaagtaggccattgtgaaggagtcccataagcttctcattttgcttttgcaaagcactcaaagaaatagagttagtagcacaagcttcaatatcaatatctttgcatttcacacatggttcatcgcttgggacaatttttgaacaagatggctcgctagggagagagacactattctttaaggtttcgaacttctcttcaagagagaggtatgctttgtccaagccatccactctctcttgaagttgagcgttcgccacctcaagattagcatgagactctttggtttgcttgtaaagctgtaccaatgcctcatttttctctctctccttagcaagctcactcttgagttcatgacaccgctttttctcacgaatgagcaaaacatcttgcctctcaagtgttgcatattggtcctcaattttcctaagcaactcactcaagtgtggtagggattccttagttatggatttaaacaattcgtcatccataacctcatcctcctcatcactaacaagatcaacattaaatgacttgagaggagaaggtaccttaggctcctttgccatgaggcaaatgggagcatcctcatcacttgagttgtcgaagagtcttggtggtgatgaaggcttgacggcgaacgcgacgactccttcttcatcacttgagcttgactcggagtcggagccgaagatcatcacaaggtgagcttggccataatgttcccgcttcctatgcttgtgcttctccttcttctcatccttcttctcacccttcttcttatcttccttgatgtgggaaccatccttgaggtgggggcaatccgcaatgaagtgcccgggctctttgcacacgtagcacactcttgcggagtgtcttccacttgacttgttggagtagtgcttggaagaacctcccttgaagaagccgcttcgtctcatgaacttgccgaacttcttgacgaagagagccatctcttcatcatcgatctccgccttgctcttgctcttgcggttctcttcttcttcttcctttgccttcaaagccaagtcttccttcttgatgcttgcggttgagctttggttgatgtattggatgacatccttggactcttgcacgagcatgtcatgggcaaggatgcgtccgagaaaatcacgaggtgtgagagtcttgtagtccggacgctcacgaatgatgatcaccaaggtagagttccttggagtgattgctcgaaccatcatcttgaccacaacatcattggtcatgtccttggagccaagtcccttgatctcattgacgatcttgctcaactggtcgtacatgtcgcttgggctctcaccatccaacatcacaaatctctcaaattgccccttgaggatctccaccttggactcacgaacactatccgtgccttcatgcaagttccgaagcgtgtcccaaatcactttggcactctcaatgccatccacacggttgaactcacttccactcaaggcgctaagtattgcattagcggcttgagcgttcttgtgctcgttctcgtcgtcctccttggtgggatcttcgggattctgcaaaacatagcttttttcgactattctccaaatagatgggttaatagacttcaaatgcatcttcatcttatgcttccaagcggcatagtccgtaccactgaaatatggagctttgccgctataggtactcacataagatgtagatgtagggggatagtcataagggatcttagctcccttatcaccatcgatcccatcccctgcttggcccgacatgatctctccaagcggttaagcctaattaggatattaggctctgataccaattgaaaaggtcaattaggcctagagggggggtgaataggctaatttaaaaacttaagtaaagcggaagcagtaattttcggaactaggctgggaattttcggaacttccgaaaggattttcagaacttccaaaaatgcacagagcagcgcacataaaaagaagtatctagatctagaagtctaccacatgtaatcaaaggcacatacagcaactagaccaatagcggcacaagcaagcaaagttagaggagagggatgaagagatatcaccaaggtgaagcttgcaaacttgttcccggagttcaaatccttgaggggattctactctccattgaggagctcactaagagccgggttttagctaaccctttcctcaagaggttgcactaagcactcctccttccactaagaggtatctctacccttgcggaggcgagatccgacctttacaaacttctcccggccaaccacaagtagatcggtggctcgggagtgacacctagccgtctaggagtcctcaacctccaagagtaaaagatgatgcaaagaactcccggagatgatgcaagtgctcacaaatcttcacaaagaccacaagaagcacccacacaaactcgaatccacactctcacacacacacacaccaaatccaaatcaaacacgggtggagagatgaatcgaggaagcaaggctcaaatgaactagagagagagcaagccaatggcacaaataattggaatggaaccagcagccctcacaagtgaggggaggtgggtatttatacccacatcacaaatctgcccgttggagtgcaataaaagggattttcggaacttccgaaaattccagatatgagaaatagtcgaagtcaacgcaattttcggaacttccgaaaatttccagaacgcttctgtgtattttcggaacttccgaaaatttccagagagctctcaaacggttctgtgtattttcggaacttccgaaaatttccagaacgctcaaacacggttctgtgtattttcggaacttctaaaaattcttttcggaacttccgaaaatttccagaacgctccaaaagagaaatgcttcgaagaaaaattgattttgagcacatgcatcactccttatatgtctatgcatcatcccccttaatagtatggctttcctacgacacaatgcgaggaaaaagatacaatataccatttgatcattgccgcattgcatcgctatgtcgcattcatgggatatgcattgtattacaacacgttgaggacataacaaccttcatatttgcttgaataaaaatgttagtcctctctaatcgcattgtaatcaatcatcaaaatcattaggggcctagatgcactttcataaagaaaatcttacactcatatttaatatcacacattctatcttcgcgtcatctcatcccacaccgttctgcctacacatctctttctccctctatttttttttgcctttgtaggaaaacatgtatttaatatcacaatgaatttatttgttattgttggataaatctgtacgaatgtaagtgtgtgattctagttggattgtttatcagtgtgtatgaatgattatatgaacacaatttactatgaatcaatgcaaattgtatcacttttttttgcattgattacatccttttttttgaaaatcagtatcaccagcgattaatgtgaggaataggcaatgatactacttatggtagtcgtttcaaaccccggttgtggtacctcgaactatcatcatcatcaattatccactgttggttcaaaaacggacagggatgtcattgttttgattgacattgatgtgttatggtccgacaacctataagattaagaatttaagatatataagaaagaagaggtaggttcttttaccatgatgtgatgaaagaacaataaatgaatgaaaaaacatatgatatgaggacatataagtgcctgaagatttgacgactcctataaataaataatatatagggaaaaagatgcaagtgatccaatcttagtgtgacggaggagtgaaaaaaaagatgtagtagatctaaatctaacataaatatacatgatatgacaacctctaaaagtaaaataaaatattaaaaggaagtgacaagcggttcaactatggtgtgagaaaagagtgatgaatgaataaaaacaaatagctaatataaacacacgtagatgctggccacataacaaaattgaagacgtactaatgaaggaaaccttatacttatattcaatattacacgttatatctccatgtcatctcacaccttgcgccgttccacccacattttctttgtgtcatcacaccctgcaccgttccacccacacttgcctttctttcccttcctacaaggcagattgcaaggaagatcctattgccattgtttgttttcacaccatcccatttggaaccttttcttacgtgcgaacgatgctacaccaaaatctatcatgacaaaagcaaaaacctaccgaatccaaacaccataaaaaggcttcatattcaaaaattcaaaccagttttgactgtgggcacacattatcttaaaaaaatgactgtgaccaagtgaagtggtggcaactgcaacatagtcctaggctactataatttgtagtggtagaattattaattttgatatatacttaatactttgcgaatgactataacttgtacatagattgcttgtggtttttatacttgctagttaacaatagatgtttaattatgacagtctatacctattaatagatagttccgtcatgttggttaaaaactcatggtaccagtgggtacccagtacccgacgagcatggatatggttttttttcccacccagcgaagagtattgcacatgggcggacaaggagttttcgggtctcgggtcaagcatgttcttgctccacccaaactcgaccgacccattgtcatctctaaacataagtgtccatagtatgatgatatctaaagtataataaaatattagaaagaagagataagcggttcagctatggtgtgacgaacgagtgataaatgaataaaaataaatagctgatataaacctacgtagatgctagccacgcaacaaaaactgaagacgtctaaacgaagaaaaccttacacatgtattcaacaccacgcgttatatctttgcgtcatcgtaccctgcaccgttctatccacactttagtttttttttccctttccacaaaggcccattgcaaggaagaccgtattgccattgtttgatttcttacatgctaggaaaaaaatagtcacaacaaaggcaaaaaaaaaactacgaattaaaacaccgtaaaaatactacaaattcgaaatttcaaacccattttgactatggccaagatttatctatattcttttgtgattaaaaaattttgattgtgaccaagccaaagtgtgatattgatgaggagcatacgaggatgagaggagagaggggtggtgtggtggtggtgtggtgggggtgggggtagtcgacaaagcgcccaaagtcaaacccaaccaaaagtcattggctccatcgctgcggtgggctgacagcccgtacatttttttaatccacccccgaccgtggactttgcaccatttcgccccccctttttttagaaacaaaaaacccacaaaaagtcgcccacccaaagctcgcctcgcctagcgacgatcgcgagcactcctcctcctcctcctcctcggactccgatcaaatcacaccggagaaacctcgccgtccggccacaccggcggcgcgcgctctctcgctgtcgggggggt

SEQ ID NO: 11585 - DNA, 12792 bp, Oryza sativa
ttggtttagttggatttttgcgttcttggtggtggtggtggtagtggtcgtcgtcgtcggcaacgcgggcagacttagcgttcttggtggtgttcgcgatctttgcggcgtccagtggcagtggattgcggtggtgggattggcgcggatcctgttttgctcgtttggttgtcgatcgccggcggtggattccggtggtggaggtgtttgggttgtgagctcgtcggcggcggcggcggcgcattgggtgttgggggccgagatgggcggcgtgtgctcggcggggatcccgggggacaggtcgccggcggagctgtcgttccgggcgatggggctcgtggtggagcaggagctcaaggcgttcccggccgtcgccggcaaggtgcaggggaagcacaagacggcaccggtggaggtggcgccggagcctgatccgccgcgccgcctctcccccgagaaggccccccggctgtccaccggcggcggcggcggcaaggctcgccggtcggtctccaaggagccgcagctggtgcgctcctcgtcggagaagctcaaggccggcaagtccaggacaagcacctccggcaaggcaagtctcccgattctttttcccccctctatttcttcaagcaacaggattagcattgccatttggattaatagatggttaacatcgatcatgaacatttttgcttcaaagttgagagactgcaagatgtggactccgtcttattttgttgacgtaatttaggcatttcttacactgcaatttgtagcataaacaatgagacaatgatctagttgccttttatttttatttttttttctgtgtatgtgtatcagattgtgcatattcaggcatgagctttgcatttctgaataagctctcctgacctgctggctgctgaccggtttccaccgtgtaatggtgcactctttgcaggcttcagacaaaggctcggtgtttggtagagccagcacatctgggattgggaaagcagtggaggttttggacacactgagcagcagcatgacgaatttgagccctgtaggtgggtttgtggcgggcgcgaagatgaaggggagcccacaaaagattcttgcgtttgaggttgccaacacaatagtgaagggcatgagcctgatgcagtctctgtccaaagaaagcgtcagatacttgaaggggaccgtcctccgatcggagggcgtaaagcgtttggtttctagcgatatgagtgagttgatgagaattgctgcagccgacaagaggtttgtgatggatgagagtgatcttgttgctctagttctaacttccatgatctgtaaatgagatcttcacattctggtcatctttgcaggcaagagctggcgctattttcgcgagaggtgatcagatttggcaatcgttgcaaggatactcagtggcacaacctcgatcgctatttttccaagtaggttcacagcttcacactgattacatgtcctgatgattgatatcagagtatgatgaactcggttttgatcttgtgcttgtttgcttccaggctagaatcagaaattacgcctcaaccaaacttgaaagaaatagcagaagcagagatgcagcaattgttgacactggttcggcacacggctgtgagtacattacacccttaaatactcccctagtcacgaaataatgcgatcatagaatgtgtgcaaccacgataattttgacagaacattctctggaatatatggtttcaatgaaaatgatacgagtgaaatatttatggtataacacacatatttttctggatatatgatagtagaattcagtgatcaaagttgctacagttgagtttgaaaaggaaaaggaaatgtcacgctttgattttggaggcagtatgtatttagtggttatactgaaacgagaatcgattccaagtgttatttattatgctactagatcatgtttgcgtcaatcattaatctgtttgctatgcatatttcaccccatgtccatctgctccatgctagcttttcctaatacagtttctgtttcatttttatattgttcataggatctgtaccatgagttgcatgcattagatagatttgagcaagattatcgccgtaaattggaggaagagaaaaaatcagttgcttttgaaagaggtacacctatcatcatcaatacctcacacccttgtagattgaattaggaagccattagtcgttccctttgagaatgattgtttgagtacaatgaatgagcaggggacactgttcagattataaggcaagaattgaagagccaaaggaggcatgtgaaaagcttgaagaaaaagtccctttggaataagatgctcgaagacgtaagcgtttgtactgaaatttgcatgagatgaaatgtttgtataatgacagaaagataaccctgtcatctgggtttaatggttaatctgaaccatgtaatcttcattctgtttgtaggtcatggataaacttgtggatattgtccactttttacatgtagagattcaagaatcttttgggacctatggtatgcctagttgctcagaattttcaatcatcaagtcactaattcagtatggttaccaactgattactttggacttctccatgcttttggtctcccttttttctgtagatggagctttacaattgaatcaaccttcagagagccgtcagacgttaggatcagctggcctctcgctgcactatgccaatatcatttcacagattgacaacattgtaagtttttcttcaggttatttatatatttttctgttcatgtcaatacacaaaatttagatgatcttaagcttatcaggtgaactgtcaatgttttcccataggatttaatagctggtgatatttttccatactatgatattatccgctcgaaagtatggtctgtattcccccaagttatggccatacaggacaatggcatgagaaagatagaatgatagaatttgaaaagccacttaagttattgggattcttaaactgcaatggtttctttcagaactgctgcttttgtgttcaggcagtcaacctctgtaaatgttacagtcacaagtcacaaatttttgctgaaaaatatatttgtagagttagagatcttatgattctagtaaagaaaataatgcaaattatacttctactgaattgacatcaagtacaattatttgttgaacattgactgaattactgaatctgtttactgacttgattttggctaaccgaaggtttcccgaagcaccgttccaccacaaagcacaagagatgcgctctatcaaggactgcccccaactattaagtctgctcttcgaaaaaaactacataattgcccacaaccacaagaggtattttgatgcttaataaaagaatcgctcgataaattgcattagtgattcacatcctaaatttgtgtcttgctgtggtaggttccgatcactgaaatcagatcttcaatggagagaaccttgcaatggattatccctattgccaacaatacagccaggtatagcactgaaaagatccagccagcctttgattctactccagatactgacgttctgttcatcattgcttgtatgctacatcagacctcaccatggattcagatgggtcggcgagtgggcgaacacagggttagatgctcatcattgctcatccgtgcactccatcaattaatcagtccaattattgtgttatcaaaacatgagaaaacaggaccaaaaattattaccatgctaatcagagaacaagaaaaacacttcgcgttgttgattttaacaagttcaaagttcaaactataaattactccctccgtccctaaatatttaatgccgttgacttttttaaacatgtttgattgttcctcttattttaaaaaatttaagtaattattaattcttttcctatcatttgatttatttttaaatatacttttatttatatatatagttttacatatttcataaaagtttttgaaaaaaaaaggttaaacatgtttaaaaaagtgaagggcgtcaaatatttagggttgaagggagtataaaactgtagattggtcgaatgctcgaatatacatcaaatcagttagagttgttccacaggaatattatcacattttcatctggaagcatgtacgtacgagttgcattgctgtattgttatattatcttttatacataatatattccgtatcattatctagcagcgcaattgcgtgtgtacagtacatccagcttactgaacgcaagaaattctcatcatgtttaattccaaactaatttatttacacaggaacgatgcgatgcggagggcggctgggcagccagacgtgatcaagatcgagacattctaccatgcggacaaggccaagacggaggcgtgcatcctggacctcgtcctatagcttcaccacctcatcagctacagccacccaagcaacggtggcaggtccaggtcgccgagcaggtcgccggtgcgctccccttcccttacgccggcgcaccaggtgccgacgacgacgtcgtcgtcctcgccgccaccgccggcggtggcgaggccgagcggcggcaccggcggtggcctcaccagggaggaccgcgcgatgctccaggacgtgtacgcgggccgccggcgtcgcgctccctgtcacagcaggagccaggagctgtcgtcagctcgcggcggcggcggcgccggcggcgacagctcgtcggcggtggcagccgcggcgcagctgagcaagaacgacaggctgagcaagagcagcaacgatgctccggcgcggagcggcggcggcggcggcggcgggaagctcttcccgctgagcaggaggccctcctccgccgtggtgtcgcccgccgtcgacttcgacatcgacggcatcaaggcgctggcggatgcacagaagcggcagtgaccgtgacgtcacagccaccatcttcttctccgccgcaaattttgctcaaactgtccactgctcaaacgcagcgacgccggaaaaccgtgagaaaaaataagagaaaaaaaatcaagaaagaaatggagatggccagatgatgagaaaccaagatcggtgatggatgcttaattagggtgtgattgatacatgatcaattaattaattaatcgccattgtatattgtaggagaaagaaagaaagaaaaatagatggatagatagcccaagaattgcagctgtcaggtactgtactaccatgagacaatcatggatggacatgttatatagtactccagctgtgcaatgcctgaagactagtagtactactacatatatcaacagactctgcaggcacatatagatagtgaccaaaaaccctcctgcttgtgaattttcaacccttcttgtcttggaatggaatgcacagtttcatttctgtttgtctgcactgttctgtgcaggtacattcactccatgtgctgcactacatgtacaatgtgggcttgcatgtacccaagttcatgagattgttggaggggggacccttgcaaagatctgctagcctctcctcgccctgtgtgggtcatggatgatggatcaatccatgcatggtccatgagggagagggagcaaagattcaggaagaaacagggagatgatcagagaggttcagaaaagaagaaagataacatggacgatcgcattgtccttgtgccatcctctgggctggagtccactctccagctactacagctgtggatcaatccatatgcaggtgcacctcaagggattcagatcaggtgcagttatagctgtgactgcaacttaagaactgcaagcaatttcagccgtccatttcagtgatcaatggctcagatctagtgatacagcgaccgtacaaacagtattatgtactacagtgttttgctacagtgctataaacagtatgcctcactgatctggaccgttccatttgcatctgttgatgaaaattggtactgcctaagttgcagtcccagcagcgactgcacctgatccggattccacctcaaggtatagctgcatgaggaaggggaaggctgccgcatgggctcatgggggcgcaataattcgccatgccaccatggtggtgaggagtgaagtggacaagtggtgccgatctctatgtgtactatgttggtctctatctcgcgtactccttccattctaaaataaactaatataagaaaaaaatgtgatacaacctaatactccctccattttaggttataagatgttttaactttggtcaaagtcaatgcttaaagtttgaccgagtttatagaagtaataataatattttcgactcaagataaatttattaataaatatatattcaattattaatttactaaaaaactaatttggtaatgtaaatattactatatttgtctataaacttagtcaaacttaaagcagtttgactttaaccaaaaataaaaacatcttataacctgaaacggaggaagtatattctttgcctccggttaggttcagcaaccggaggtaaatggaatggtgtcacatacataggtgtgaattacatcaggagatagacgtcgcgcttgtgtggttagcggttgggaaactaggcattgtatataagaggaagggggcccgtatttgaatttattaagagaggggtgagacaattttttttagaactggctagccagaagatcgccctcaagcctttctcatcagttaaactagattaataccccaccgcgttgctgcggaaaattaaattgcataatatgtaaaaataaaatgtaatttgattatcaaaactaaaacaatttgatacaattttaagcctaaaaaataattgagattgcatgtttttaatgagagaagaaagaatagacaatttagaccatagatctatcatctaaaagatagaaataattgagttgatgtggtttaatgagagaagagagaatatcattaactacatttagtggggatgaactatataagtatatataggattgaatggcaaaacgaccgatgaaacctttactgactgcggtaaaaaaaaagtaaatacaaatggtttggatgcaattaaaatactacgtactagttaataaagcatatatacacaattaatgatcatttttactagtgtactccctctccgttggttttttaaaatatgattgaccgtgtacataaaagtatatttacccatgaatcaaatgataaaaagagaattaataattacttaaaattttaatttttaataagacgaacggttaaacatattttaaaaaaccaacgacgtcaaatatttagggacgaagggagtaaaaaaacaagcagctcgtgatgaactgctcataagctcatgagataaaaaatccaaacatggccccgttcgactcattatatgaccaccagtttgagccgttccaagccacgaccttccagctagctgtttttccgcccctgccagttagcatccaagaacgaactcgatcgatcgctgtattcttctgctcattgacgcttgtttttcatctggaacgaagcagcgaacaattcaacacaacacgacgcaagacgcaagcaaagctttgattgtcatcagaaatgtcaccttgccttacggctcatgtcatgcacaccacatgcatatacatataatacatatactccaatttttaatagataacgatgttaactttttatcacatgtttaaccatccgtcttattctaattctaatttattttgtcatgaattgttttatcacttaaaaatactttaagcatgatttatatcttatacatttgttcttataaattattttaaataagacaaatgatcaaatatatgttttaaaaatcaacaatatcatctattaaaaaaacggaggaagcatgtactaccatacaaacaccaccattgccaatcaatctgccatgccaagacccagcgagaggaaaaggctccacgcttttcggcaaggaaacaatcgctgatggggttcggtggcatattgcacacacatgcacacatggagttgtttggttcactcctaaacattgccaaacctagctaaatttgtggcttataaattgatgaccacaccttaggcaacttttagctaaaagataggtgtatgacatgtagactttgaattgaaaaactttggcatgccacaactttggaagtgaaacaaacaagtattctagaaagtgtggtaaagtttgacaaagtgagggagtgaaccaaacagctattaactagtattccagtagctagcatgaaggaattaattaaagaatctcttctttcactcgcattatggttcccctttggctgcaaagtagtgtgtactctttctacaggatgaagatgctgcttgatgtagtagtttaattattgctagatggataataagaatctataattaatggacaattaggatgccttgtttataattaactttatatatatgcatgaggaatccatggactatatattattgtggactttagcatggggttagctagcttgcattgtcaggactcaggaggaaaaagagcttgagctgaccactatcaattttttttaaaaaaatccttaattaacaggatcatggcctgtgaataattgttgcatcactagctagtgagcaacttcttttttcaaaaaaggaatgaaggctaacatctttacttggcagacactccggtgtcttaagaatactcattagttcaaatttaaactgaaacattttttgtgatagtattttggagactgaaacctactacaagaattatatggtcagcatgtcgtaatataatcaaccagttggtgtgcagttacatcgactgttggttaatgatttatgacagccccgacaaaaaaaaaatccccaaggttgctataacaagtaaggtcacaactcgcaaatagcaaaagaaatggcaggaattaagaatccgtgcgagttgacagtgcggtgcttctctgataatctcgcacaatcttgtcgaaaaggacacattgcaatttatataaaaggaacagttttaatatatatagaacaccctatctttagatcccaatgtagcagcgatatatatatatatatatatatatatatatttatatttattaaatttgtttggtgctccatggggcccgggcaccattgttgaaattgagtatatatacatatatacatatgtatacatatacatatacatgtatacatatatatatatatacatgtatatatatacacacacacatatatatatatacatatatatatatatatacatacatataatgtagcaattttaatatagagcaccatgtctttagtagatcccaatgtagcaatcatccatccatataattttggttatagccaataaacatggtatcgtgcgcttttattacgaagaatttggcatatacgaaagggattgtagcttagcgattacagtgctcaagtagttcagagttggttaaaaaaatcacttgctaaccctatataaatacttattaagaattaatcaatggagaacagatcctcatgcagtggacagtggtatcaaagaaccagtccgtataggggtcggggggcagagttcgcgatctttctcggacagattggttgagacttattcttcttaatgaaaagccgaggaacggtcattcccgccagtcaagtttttttttttaaaaaaaaacattgtcatatgctccaatttattaagagaaattttaaaccaagtttgatatatataactcgaacttgggtggtgcaagtatacattgaggtatgttctatacttctactcatatgttgccatgtgtataaaaacactataagcacgctcatttcggcagcctgccatgtctgtatgtaacattagctatacctaggttaagttctaagaagaaattagggtaagatacatcatcatttttcgtgagcacacttttcaaactattaaatattatatattttttaaagaatatatattgaagtttttgtaaaaacaaataaatccaagtttacaatagctaatacttaatttaatttcgtgtgctaatgagttgtcttgttttttttaaaaaaaaaaattcaatcctaaccccttttcgacactcagcctaaagatagtttaaattaatttcatgcttacacagttgatcaacaatggccacccagagaaactttagctaaagataatttgatcagcaatggtcacccagagaaactcaaccacaagttcaaacctaagcccaacctcagtgaagctatcacacaccaacttacctcaccggcaacaacaacaacaaacatttgactataactaatggtgccgatttattggagattattaaccaattaattattaagcacactaattaatcaaactaagaatcttgttgttcatgtatgatactcccatcttagttaatcacacgaattgattaattacaccaaaacacaaatccaaacccacaataataatcatataaactaataatagtaaaacgtacacgagtagtagagagagatggcacgcgcgcgagctctcatggcgccggcgccggcggcggcggcttggccttggcggcgaagcaggcggcgacgcgcttgcaggagcggtagaggctgagcacggagagccactcggcgagggcgtcggcgagccgcggccggcggcgccggagccggagacggcgggcggccttcgccccggcggggtagtagtagcccggcggcggatgcggcggcattgcgccggaggcggcgtactcggcggggacgacggcggaggcgtaggggtcggaggccgccctggagaggagcgagggcgggagcgggagcggcggcgcggaggggtagtgcttcccgccgccgacgacgccgggcggcggctgcttggaggaggagcgggatgacctcgccggcgtcttggggatgccggggcggtgctcccacgagaatgggacggaggaggcgcggagcggggaggggaggaagcggtggaacggcgacggcgacgtgggcggcgggaggaaggagacgaatggcgacgacgacgacgaattggtggaggagaaggaggaggaggagcctccgccgcctgccgacgacgggaggagccgccggcggcggcgccggcgtggagttgcggtggtcgccggcggcggcggcgggggcggcgaggaggaggagggcatggtgggtgggggcaactcgctggggccgtcgcgtcgcggcgtcgccttttatgctgccgcgcgcgcaatgccgtcggccacgtggcacggtgacgtggccaacccggctgcttcagtccgcagcaacgccaacaaagcttttaccagagctgtggcaaaattaaggctgagatcgtttgttggctttggggttggggtgtgtgggagggaggggctaaacatcccctttcttaacttggggagtgtttaacttacgttaaaattagaagtttgattaaaattggaacgttgtgtgtgtaggaaaattttgatgcaatgtaaaagttaaaagtttgaagaaaaagttgggaactaaaccatgccttgttactctcttgcgttatttataggcacgcctaccaaactgttaaatagtgtatttttctcttaaaaaaattcttcatattaattcatttttttaaaaaaatatgactaatacttaattaattgtatgctaatgagctgctttattttgagtgtacgagggattagttactgtctccaaccaactaacgcggtaatcattagtgcataatgaattgattaattattataattttaaaaagatttgtttgatattttaaaataaacttatatatagttttttatgaaatgggtcatttagcagtttgaaaatgtgccaatgaaaattgagataaaatatgtattttagttactccctccgtccctaaatatttaacgccgttgatttttttaaacatgtttgatcatttatcttattaaaaacttttgtgaaatatgtaaaactatatgtatacataaaagtatatttaacaatgaatcaaatgataggaaaagaattaataattacttaaatttttttaataaggcgaacagttaaatatgtttaaaaaagtcaacggcgtcaaatatttagagacggagagagtaagaaaagaacgggatcgaatagctcaaattcttcacaaatatgttcttctttttctttttgcaacgatttggcagaagctgtcgtgtttcaaattagttcaagtctttaagatcaagttgttttaaatattctggtaagtggttttagaagtgtatttcacgacaggattatgagcagagcgagtttaaagtccacttgtgcactgatggcacatttgaaattcggagcgccggattaataccactttagccctaccgtctcttcgctcttttttcctcgtcctctctttgtaaaaagtagaatgtgactaatgtgcgatgtttccttcaacaaacaaagcacaaaagcgaggctggtaacacaagttaacagtactgcaatttgaaactttaattcattttctgtgacgaaattgtaatatatacactgcgatttggaggtttaggctgctggtgatacgtcgttgaatcacatttctctcaaaagctttgcatggacagtaggttctccgattatttttcagcaccacgtgtacacgaggatggtgatggttgcaattaaccgttttaactctaatcactgagataatgcgcacgg

SEQ ID NO: 11586 - DNA, 1588 bp, Oryza sativa
agtgcatgtacttttctctgtcttcagatgtcagtaattttcagtagtagtagctttggagtgaaacttcccatttggaataacgcactctgaattcaggcagcttcccaggattcatgcatgcccagaaatgtaatcccaattttcttcttttttttttacagacttactcaagtggtaaattgcaaatcacgatacaagaaacctaaactttcacggtaaaaaaagaagaagaaaacgatggaatttttttttcctcatgccagctacttccccttttcatccatttaaattggaaactcggcatcgcaaataacccaatctgaaatctacacgcccatggatgcatatgcatcgaatgacacatgtagcccatttcgccatcggggttcatcactgacttgacgaggagaaaagcaaagcgaagcaaagcatcggagagcaaaacacccagaaaagcgaagcaaattagagtaaccagctgctatcagagacaaaagctagcaagataagcactaaacaagctaggaaagcgcctgattttgattgtcattaggctttgcttttctgcaatcctctacctgcgtctgtgtcgtctgcgtttgttcagacgaatggagatagctagctagatagatggcttaaacaattaattgtcctggttaattagttcatcatttgtcatgcatgctttcatggtgttaattgctactatcatttagtatcatctgttcggataatgtccctccatttgaaaatacaagacatattttgtttcactaatgtgatagaaaagcataaccataattaagtattttttaacaccaatttaacaaatttagttgtcacaaaaattacatcataatagagtaattgttggttaaattcttatcctaatgaaataaaaattatcttttattttgaaacggagggagataatacgccataaatgattctcctgggataattagtcaccatttatcatgcaatattcatggcgttaattatcatttaagtatcagctagctaggacagcgttttcagcttgcaacagacaccaggaagatgacaaaggctaacctagctgacgggagttttctgaatatcgagtacaggataattaaatctgtgttttgtagtatctggcatcgtgttgcaaccgataattcgaggaaaattaatttggggtgattcttctttcactttcaccctaatcttggagccattgtcaaagggccatgtggtacatgctgacctaatatattattgggtgaagtccattatttggcttggctctgaactttactcttcagtttgaagtccagttttttcttttaaagagaacggtttgaaggccaaatagtttttgtttttaccgtcgaatccaacattttacttcgcgtgtcgggtcacgaagatttagttgagataactgtcagtaaaaaaagatagagttcttgacaaaatgtgcatataacagacaaaattactcagaaaagaaatgcctactctgatgcctaaactctgaactgacggttcttaatttacagcatactatattcagacacaatagtaatatgataaacgt

SEQ ID NO: 11587 - DNA, 846 bp, Oryza sativa
ggggtacggtggagatggcagcgacggccgtccctccccctctccttctccccatcggcctcgatggccgtccctccctctcagcctcaagatccggcggcgtcctcccaacggcggtggcttcccgcggccggatccgataccggcggcttcctgcggtggatccagcgatgacgtagacatcaccgatccggcttcaccgatggcgccgacagcttcccgtggatggatttaccgcgtcacatgtaatcggattcgattttatttttcgccccattttttcgcccgagtttgtttctttttttgaatcggacagatttaattttttttcgtctttttttcgcggatggaggtggccattgcaggcggcggcgtggaggcgacactcacctccccttcctccctccacgctcctggatatggccggaggaggggagcgatggtgggggcggccactgcaggtgatggaggtggagctcctccctccctccctagcttccagtgttggatagtatagaagagaccgaagcttggcatagtacacttgctcgaagacgattcatcccatgaagacgtgtcgcagatgggcgcttgattgggtgatcaggccaaccacgcacagtacgacactggagtgagagatgccgcgtagaccgtagtcgatcacggcattgtcgaggaaatcgttgtagccgagctcttgaacggtgattaagtcaaagttgcgcggggctagacgacgaagacggagcagaattaatgctgatgtcggggacacgaagagtcgacgacgcaaacccgttcattgaagggaaaaaaaaaacaaaaaggtacagcaagcgcagc

SEQ ID NO: 11588 - DNA, 3592 bp, Oryza sativa
  unsure (1)..(3592): unsure at all n locations
gcacatatccgcgcccaggcgaagaagcggacttgcacgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagcttcggccgcccccgggtccgccgctcggtcagggcggcgggacaggaggaggaagaaggggtcggcccgtttcgacgacgagggtcatgtcctcgccgtcgagggcgcttcgcgggccccccgaaaggggaggcctgcgagcgacaaaaagaaggaggccggcgcttccagcagggagcgcccgaccggcaagtggtgtaccgtgcacaacaccttcctccacgacctcgcggactgccgcgcggtcaaaagtttggctgagcggacgaggaagtgggaggaggagaagaggcaggagcgccgtgagggcaagaccctggcggctcccgccggcaaccggcgaggtgaggccaagcagaaggccatcgccgaggacatcgacgatggcgacgatgacctggggttccaggagcctgaggccaccgtcgccaccgtcgatgggggagcgtgcgctcacgcttctcgccggagcctcaaggccatgaagtgagagcttctggccgcggcccctaccatgaggcgacgcggcgggcgcggtggtcggaggttgcccttaccttcgaccagaccgaccacccgccgtgcgttgtccggtgaggacagatcgcgatggtggtttcccccaccgtttgcaatgtgaagttggggcgtgtcctcatagacgggggtgcaggccttaacatcctttcccccgcggcctttgacgccatcaaggtcccggggatggtgctccggccgtcccagccgatcatcggtgtgacgccggggcacacctggccgctgggtcatattgacctcccggtcaccttcggtggttccgccaacttccgcacggagcgggtggacttcgatgtggcggacctcagtctgccctacaacgcggttctggggaggcccgcgttggtaaagttcatggcggcggtccactacgcctatctccagatgaagatgccgggccccagtggccccatcaccgtccatggcgacctcaaagtcgcgcttgcttgtatggagcaacgcgcggaccaccttgccgcggcgtccaagcccgcgggcggcgacgagaggctcagcacctccgtcccggccgccccaaggcggcggatggtcacgtgcgacgaggtcccggtcaaggaggttgtcctaggcgacggcccgtccaagaccacacgaatcggtggtcttctggacgataaataggaagacgcgctcgtctccttcctgcgggcaaacgccgacgtcttcgcctggagaccggcggacatgcccggggtccccagggaggtgattgagcaccgtcttgccgtgcagccgggcgcaaggccggtccggcagaaagtgcggcggcaggccccggaacgtcaagccttcatccgcgaggaggtggcgcgacttctggaggccggattcatccgtgaggtcatccatccggagtgactggcgaacccggtcgtcgttcccaaggcgaacggcaagcttcggatgtgcatcgactacaccgaccttaacaaggcatgtcttaaggacccttaccccctgccacgcatagatcagattgtcgactccaccgcggggtgcgaccttttgtgttttctagatgcatactctggttatcatcagattcgcatggctagggaggatgagaaaananctgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcaaaagtctccgctccgcccgcataaagctgaaccccgataagtgcctgttcggcgtgcctgcgagcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcggaccttcactcagttgaaagcgtacctcagttctcccccagtcctggtcgccccggagccagatgagccgttgctattctacctggcggcaaccccgcaggtggttagcgcggcgttggttgtggagcgcgacgaggacaaccctcaccccgtgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctatcgccctctgaccccgaggtcgtcagcacagaagccgagtgcggggccgcgaggcctctcggacgaagagcgccctggagatgcggcccctggcgaagaggatcggccccgccgaaaggtgcagcggcccatctacttcgttagcgaggccctccgggacgccaagacccgataccctcaggcccagaagatgctttacgctattctgatggcttcgaggaagctgcgccattacttccaggcgcatcgggtcacggtggttacgtcttaccccctcggccaaattcttgcataaacgagagggtactggacgggtggtgagatggccaatcgaactctctgaattcgatttgcgctttgaaccacgccacacgatcaagagccaggccctcgccgactttgtggcggagtggaccccagctcccgagcccgtctccgcccacgagaccagctcgggccccccgcagctgcctcacaccgcctactgggtgatgcagttcgacggctccatgtctctttagggcgccggtgcaggggtcacgttgacctcgccaagcggatatgtcctcagatatctggtccgcctatactttcgggcgaccaacaatatggtggagtacaagggactccttgcggggcttagagtggcagctggactggggatccaccgcctcctggtgttaggcgactcccagttagtcgttaaccaggtctgtaaggagtaccggtgctttgacccgtagatgaacgcttacgtgtgccaggtacggtgtatggagcgccatttcgacggaatagagcttcggcatgtgcccagacgggata

SEQ ID NO: 11589 - DNA, 1582 bp, Oryza sativa
  unsure (1)..(1582): unsure at all n locations
ccggactcctgatttctactctattcctattccaccagctagatactactaaactaaacttgatgagaatgagagagctactaaactaaacttgaggggaatgagagagctattacttgaagtgtgtgagtgaagtgagaaggtgaagtccttatatagaggtagttatgacggttgtggaaggggaattgtccgaagtgccctccaaccgtcattgggatgcaatcctggacgtccacgccaaaccttgcatccaacggtgctaggatgggttcggccgaaccatgggctgggtcttcccggcccatcttcggctggcggcctcctctattgcttcactatgtagacttgtaaattttggcccaattcatcgtgtcaattctgagtttgtggcccattcatacataagtctggttatcgacaacgtctgattgatttatcgtctgagttgatgtcgattctcctccactttattgccattgtctgcaaaaggttagtatacctaatactagtggaatattattattctaacagatatatgcgttgcaagcattactagttctatattttggcaatattgacggtcaaaactgatcgataacaaccgtcaacaaaaccccccaagcttgaacctttgctcgtcccaagtgaaggacgaaaggaaacaaagacttggttgttgatcaggagttgctactatgctgcatatctcaaagatataggtgcaaggtatatgtactctctctcagattaaataatctttggtacggtggcttacccttacccctgattcccacgagacactgcttctccttgccttgggcagttgaaagacagaacaacaattagagcaccaatcacccaatcattattcaactcttattccggaagttttcaaatgattttgcataagaaagcctagttcctcaaatgattcactcagtctctctaagtgtatcaaaatgaattcctcaccactttgcctttttgattcctactctaaggcttgatatgtggagctcggtagggatcaaacatggcatacttgcattcgcctttattactaaataaaaacttagactaaagcaaatgactaaacatactcaagatcaagatcatgcaatatgtgtgtgtggtatatgatggaaatggtatataaaggaaaataaagaaaaagcttctcctttgtgcttactttcttctcccaaaaaatcattcttttattgattaggagagggcatggctacatttttttttcagtgtcatgctcatgcttaatggagcataactntatttttattatttatttttttcataaccatgcctttccctctctcttttttttttctttttcaaaaggatttttttaggagaagaaaacatatgaaagtatggagaatttattttggtggtaatatggaaatggaatggaatattgcttagctcccagtgtaggagtttagcatgtgcatatatgtgggtgtatgatcttgatcatagagcatgagaattatctacacaactcacaagagtttgacaaagttcaatggaatgacaagcaccaaaatgtatatggtttaat

SEQ ID NO: 11590 - DNA, 448 bp, Oryza sativa
agactcgaatatggaaagaacatgagaacaaaaggggttatatatttttttctttcgtttaacaggttcaattccattttttctaaccaattggtttttcgaaaagttattttgaaattagaccgtgcaaaaaacttcaacaaaaaataggccgttggctcagcaccaactgtcttggcgctaaggctagacggctcgtgccagggctgttggtgctgaaccccctgccaacatgacagtcgaggcaatcccctcgtctacgtggcagggtctcagtgccaaccgccttggggctgaaccgtctaacctcagcgccggccgtgttggcgttgagctaggttactaagggcgacacgaggccgcaacaacccaacatctcttcttcctctcctctcctttcctctcccctagtgctcgtgtgacgacgccaagttctctctcctccctt

SEQ ID NO: 11591 - DNA, 435 bp, Oryza sativa
actagtatttctttgtgtagttatttggacaactctttctgcacttgcaatcaacagtagcagtctatgctgatcacatcaactattcttaagttagcaaataaaatatgtatatcttttttgtaatttttgttccatcaattcttgtttcaaactggatatgaggcatctggttataaagctcaaaattgatcgtatttcagtacatcatgtaattgataattttcttgagttcttcagaaaaagcagtaagtcttgctgctgcagtgggtggtcatgccctgagattagccgagcttgaaactttcaagcctgaagaagggatgatccttgctaatgcgacatcattgggaatgtaccccaatgtggacggcacccctatcccaaaggtatcttgctcatgcatgcaccatgttatattccagaacagcatac

SEQ ID NO: 11592 - DNA, 410 bp, Oryza sativa
aattttataagttggtagagatatagaaggcctaacctatatatgtactcccgctatctggcaatagattattgtgttgagtatattccgtcttacagaatattaacatggcgtgcgtgtaagaaagagacctttggaataggggtgccatccacattggggtacattcccaacgatgttgcattagcaaggatcatcccttcttcaggcctgaaagtttcaagctcggctaatctcagggcatgaccaccaaccgcggcagcaagacttactgctttttctgaagaacacaagaaaattatcatattaaatgatgtacgtactcaaatatgatcagctttgagctttataactagtgcgaaacaagaattgatggaacaaaaatcacccatgacaatgatacaaacatg

SEQ ID NO: 11593 - DNA, 2281 bp, Oryza sativa
ttccatatatttgtaaaaatatgtgcaaagctatgttcagtaagtactctgtaaatgttagaatatcaagggaaatgtaaaagaatcacagtaacagacctagacaagggagggggagtggccgtttcacatgttcagtactattttttgctatgttggctaaaatttggcttagagagttggatggagagtctcttggtgatgctctaactgcgggttgggtgggttttttgtgtggatttttcgctgtgatttccacaatttgagtatgtcacatgtggacagtcagtgatgatatgactgtacaaaccaattattcatacccagtcaaagagctgccaggaaaaatatatatagctgaatttttcccatgaaacctaacaagggattcattaggtgaggtttgtacgaatgaggtttgtctaaggaagacatcagattgggggatccctcatgtatgatttatcaaaaaattacaacaatccttattcatgtggtcccttgagagtcaataccacttaaatctagtatatccaactcctagaaaaaattagtccatccaattccaagaaatagtaaagtaattatttctactttttgaaattagtacctgaatcctgaaaaatccggagacgaatatgtgctaagaaatctagcaatgttgtctgccaaaagtggaagataaacagcattgtatccaatagattgaagacatgtattgtgcaaaactgggctcttgctctgttttactgggttggctataacaccgagaacctttgtatcaggtcctatgcgccttatatcataaatgtctatcagctcttcgacggttggctgcccaggtgctgatacctttgtagcatcaagactcccaaaggttagatatcccccaaacttgggggataacacccttgacattaaacctttttcgcccataactagtccaatcataggcacctgtcatttccatttctactggtcagtcaaatggaagttaatccacaatggtcaaatttagaaaaagaagagcataaaagtccaatttagacatactacaacattatccatactgttgtctacctcctactccctccggcacaaaacatagctacttatgcctttttttgaagggattaaggttgaggtgggaaatggttgtggttggttaagataaaaaagtagttgaagaaatttaatgaggagtggttgtgattggttaagatggggaagtaggttgagatgagacaaatttgaatgatagaagtagccatattttgagaccgagggagtaataaataacaccaaacatgatgacataagaataagctaacaaacgagcacagctttgccaatgagcttagttttcttcttaaaattctcctaaacacataaagttttaaaagcttaattggtccgatatttcaatttgcatcctctctgcaagcgaccaattttatcactattcacatcctctgtgcaagcaaccaattttatcacaatggtaagtaatgattttctattaaaaattaatgatattatttgctttcactggtaaatagggagatttgaatatggaaagtacagtataacagaagggactgaaaaaaaagtttaatactacaggttagattggtgaaattctcatacagcttaactgaagtacaatatgtgaaatgcaatttcctaaaagccaatatgctaaaattaaattgcaagtcctaatgttttcattaaaaaaaatgacttccaaaccataggagctaggaagcatttcatacaaagtttgaggaatgtttactggcctgagctagggatcattagacagaacgatttccgtgtgaagtaatttaaaaacagcatgaatctaaaaggaatgcagtagtggtatcaagatgtacaggatgattatacaggataggtgacgcaagtttccagatggaagagtgaaaatgtatcttggattttatacaatgacacttacttggcagtgcaccatcacttggaacattcgtgacacatcagcaatgtcactagcagttgttgcgattttcactatgtcagatccaactgcttgtattctagccacaagatctgcaagctcctcgcaggacggagtactttcataattgtgtgatgagacaataagtttacacttctctggcttactgccagaaataaagctgataaatttgtcagcaacctacaaaaaaaaggaaagttggttacaattgtgtgcatgtattccaaatcgtgaactcaaataaatgaggcatatgggtgt

SEQ ID NO: 11594 - DNA, 785 bp, Oryza sativa
tacactattactgcatactaattgggaacagcgtaacagtttaacacatttatggaaacaaaccttcaattcaatatcaacatagtctacgcctaactccattgctaaacggagtgcttcaaatcttgtagcatcatcaccatcgtactggcctccttcccaattgggtctgcaaaaaaaacaatcagatacgtcatttatgcaaagcatagtgttgtaaactagtatacataagttagacaagtatgaccaactactacaaagtgggttgcaacattgtgaatataaaaaagtactcacgttggaaaaagctacaaaataaatcaactaaagctcacaaaatgaaaagataaatataaggatgggagaagcatataccttttatgtatattttttttacagatcctataatataaatattcatttctacaagtatagaaagctaattaatggccacagatacgctcaatcagtttaagtgtttaaccaaacgccggcttttacgaaaataagaaatgattgtgccacgtctcaatcagaagtgaacgaacagataaaaaaccttttaggttcttgggtttagttcttttcagattatttaccagattgttgaaatggattatttgctcaacacttcaaaaaatacattttctccaaaaaaatatactcctgatgtattgcttagaccacttgttttaagttatttgttaagtaaatttatcaaaatattttatttctccctatcatcaagtagattatccgcagcaacaatctgctcaataatc

SEQ ID NO: 11595 - DNA, 1152 bp, Oryza sativa
cgttgggtttctgcctgcctgtggggaccggccccacctgtcaccgggcctaaggagtggcatcatgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcctgtttcggccccgagggctggggcaccccgaccccctgtggtgattggcgccacgtgtgtgggttaggtgagcacagcggcgctcacttaaccgcatttatagcgggttagacgagcgcgtcacgccgcattcaatgcggcgcagcgcatgcttatccgatctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcctggtcagatccattccaggcttcagtgcaagcatggcaagaaaatcgctggccattgaatgaaggatgaaacgggcgtccaccgggagagctgacgagcggagcaggaggcgtgtgtactgcttgtcagaggtcatttccggctgtagattagccctcattgtaaaaaacatgtttcttttcttaggcagagagaggcccatgtggtgacccctaaccagataaaaaaaggaggcccaggcctaaggagacaaaaaaggggggggggaggtgagaggctggccacttgatcggagagcctgaactctctctcgctctcgagctctctggctctggagctctctgttttccttcacacacagatccaccagaacacaggagtagggtattacgcttctcagtggcccgaacctgtctacgtggcccgtgtcttgtgcgcttcttctcgctgacattcctcagatcgagggcgaagaacctcacttagcgcccccggccgaaccggcaaaggggggcctgcgcggtctcccggtgaggagccccacgctccgtca

SEQ ID NO: 11596 - DNA, 1717 bp, Oryza sativa
gctaccgaactcagcataggaaagacttagatattgtagtttcattccatatatagagtattacaccatacttatattaatatattccatagcacaatacgaatagattccaatagaaccatcaacacaatccataattttaatatatgacaaaaacattgaaattataaaataagcatagttgcaaacattgcttgctgctcatttattcctcaacaagttctctagctaattggtccaacacatcttcatgtctcttcagttttgcttcattgaaggttgatgtatccttctccatcaatttttaaatacatttggtatttttctacccttgcctcctctcttttagcacttgcgttctcttttatttttgcttctgctccaatcagtgttgcttctgcggcctttagcaatgttgctgctttagttgtaatagcttcatgaaagagaaccatattttgacttggcttgtcccccaaagttgatggagcaccttttccttttttcctctgttttgctgccttttgcctctcaaggcacttctctttgcgctctgttttctcctctatttcttggttcgatgatgaagtatatgctcctgattcagaaatcttgttcctcttattatggctactctcttcaaggactctacaccatttaggttgttctttaagatctttccacatataatccaaggtgaaagtattttggttgttctaacttttgtgccattcacgggctttctctattatcatatgatcagaatacccattagtgaaagtacttctagctttacaataaaatccacagaacttagtgacatctctcttgacattatcccaatgtgttctgcattgcttggggttccttttgtgcccattgctaggcaatactggtgttgaactctcaagctatagccttccaatactaatattattttttgtcattgcctttgatgggatcaactgagttgttcaaccaagagctcattagttgtatattgtcatcttcagtccaattgatgcgtgtccctcttcttccttcttcactgctttcacttgcctcttcaatctcaactacttgtttctccttatatcttgtatggtatggaaaagctcatccatgtgaagaagtgttggctgcagccccaattgaagtactatagtgcataccaaattgtgatctattggctgcaaatccaaatgcttggatagatgactacactagattttcttgaagttgaaaacctttaaagcttcctagagtagtttgcgcataataatcttgttggtgagcaccttaaaagattgaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtaggtagcacaagaatgttgtaagaagccaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacacc

SEQ ID NO: 11597 - DNA, 493 bp, Oryza sativa
ctccctgcagctgctgacaatgccaataccgatgtcgccgctcctcctgccgctcttcctgccaccgggagaggagaaagagaggaggaagagaagagaagaggaggtatgtggtggagaagagaaaggaagagaagagaccgagagagagagagagagacgcgtgagaaaggcgcagtctcccttatctgctcgatgagaccgaggcgcttttccttatccgctcctcaggcggctcggctcatggctcgatcagaaaggggccagcttttttaaaaaaaccgacacctttaatttattataggtgtttttttcatagaaccaacacctataacatcttaaagatgccttttttatgttttcggaccacggaggtgggaaaaggcttataggtaccggttttagtaaaaccggcacctacagtgccgacacctatttgatgtttatagtagttttagtagatatattagtgtaaaggttagtactttcagtg

SEQ ID NO: 11598 - DNA, 2643 bp, Oryza sativa
tttcaagtttatcaccttgcctttgctggtttagctgtaccaaaagataaaaggaacaatttccaatgaattacatatacattttgtttaacaccaagtgagctttatataatatttatcaatagacttgaagacttatatatatatttgttataccctatgccttattcgaaacgaatccagtatgcttttttgagtaatggcctggactgcaagttgatttactgtttatgactattactattcacagttaaaactgcaaatttatagaggtgttaggaaatggaagaaagaaaataaaaacaaacagctgtttccatgtctcctaggaactctcagttgctacctaaaaagccaggtgtttcacttgcttggtaaaatgccaccgcacaatttggtaccactgcttaggacctggcacagtttggcaccgttgcttggaacataaacagaaggtctctttttagtgttctgctcaagagctttaagacctctcaagctcacaaccattatcatatgcaggttgctaaaatggataagctcagtggttctgcacgtcttattatcgtttcagatcttgaccacacgatggtttgtgtttttcaactcatatcttagacttgttcagagataattgcagcctgttatatgtcgttttaatccttcttcaattcaaacttgcaggttgatcatcacgatgaggagaacttatccttgcttagatttggcgccctgtgggagtccgtttactgtcaggattctctactagtattttcaactggaagatcccctactctttataaggaattgaggaaagagaagcctatgctaactccagacatcactatcatgtctgtggggactgagataacatatggtgaggcaatggttcctgatgatggttgggaggaatatctgaccaataagtgggacagaaatgtagttgtggaggagacagctaagttttctgagctgaagcttcaggcacgttcaatatttcacatctgattctgttaatctacaattatttcgaaaatctgatggctaaaataactagtaacattgttctattgccgtacatttgcatggatacagccagagacagaacagcgtccacataaggtcagcttttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaagctattggacacttcaaactaggacctagtgtttctccaagagatgtggggtttccttatgttaaggaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcagtctagtgcaattcatttgtaaataaaagtaagaaaacatactcctcaataaaaaataatttattt

SEQ ID NO: 11599 - DNA, 490 bp, Oryza sativa
atcatcaagcaactgcgcagttatgcatgcaaattctttattgcaagtatgatgagattgaacactttctgtttacatctctgacaggttaagtcggcgaaatcgaacattacaacaactaatctccacctagcacaaaattgggctggcatccaaaacttttattaacttaacccagaggaatatttgggctaattactcacaaccgtcgcttcgccattcgcctacagaaacatggttatatcaaaaaaaaagttgcatccaatgagcattaataagcgatggtaatgatcagtatatcttagtaaatgaaaacgaatggtttccatggcattgattacaactcaagtcatttccacgtggctaacataaacaaaaccgctgatttatagtgtccacagctcaacaaggtgggaaagcctatcaaaccacactaaatgaatgcatgttggaaccaaacaagattgtttggtttgtgaaatgggatctt

SEQ ID NO: 11600 - DNA, 2771 bp, Oryza sativa
actttctctaatttagtacacgtagcgatttagaaatagggagagctgctagacctagttgttggtctatttgtgtttttttacatgtaaaagtatttttgtttatattttctcattaaatagaaaataacacatgaatgaaaatatggaaagacagaagggaagtgcgtacagtacatacgcacgtacgttcgacattacgtacgttggttccgtatatgatggttccggatgtttttttttctttactagaaaaaatgtccgtgcgttgcaacgggagaaaacatgagaaattaaagaaaaggttaagaaaaatttacattatgtaattaattaaaatataaaatcatacctatacatgtatacgatgttgaagaaaagaaaggctcgtaaaaatcaaggtaaatgtggaaaaataaaattttccaaataaactatggctggatttattttttattaaattctccatgattaattacactatgtgaaattttttcggtattttcagagcaccattgctaattttaataatacaaacattattttagcatttatttaaatgcaaatctaaataaaaccctcctttctccctgggtcattttaagcccattctttctttagcccgtagccaagccggcccattaacctcacttctcctccctttcacctcggcctgcaagcgcgcatccggcccatcaagcaaccacaaagtctaatcggcatcccttctcctcctctcactatcgcgtgggtcccagtgctacaggtccgtccgctacctccgtccgactccgtagcttcctaacactgccggaaaccgccccctccatgaaatccgtccacatccgcggagataatccaaaattgattgaggggttttgatccttatctctttctctttccattttaccaaaattagagcaaaattgcatcatatcgacctcggaatcaagccatatagcaaacaacctagagttgtccgtttcgcgtacggggagagaatcggactgcgcgcctccagggacgacgtacgaaaaaagttggcaaaaacatcttaaacttttataataggtaaagataaagattaaatagatctacgtaaatctaaccatttttgaatgggtccaccaatataagtaaaaatagatggtcagatttttcttatttattatggtgccacttggcgatttgagagtgtttatatggtgccacttggtggtttgggagtgtttatagaaagtttaatggacttttagtatataatagattggaaataaactttttgatatcttattcttcatccattgctcttttgctcactttttcaaaaactgatgagagatgtacaaagttaggaaacggtagttacttgactttgcaaaaagcattctgctctgagctatatatatagaagcaagttcattacaagctcacaaggatagcatcccagattcccggtaaatgatataattagctctggtaaatggtagtagcccttaatatatataccctgtccctttgagaatatttgcttcataccgggagtcagtggtggacgcacccattaggcaggggagggtcagccggcccagctatggacacggtccgtgtcgcctcacgcggctacgcccctaaacctcatttgtagacctatttttaacatattattcatccgtctactattgaataatcagataaatcaaatattttaaatagagacaaaaatatttatgaaaattcatgacttataagtattatttctgtataagtagtaccattttgactgttcctgattttgaccatatataaaatttatttttttatttctatacaattcacaggaaatagttaaattggtaaatatataaaaaaaatatatttttactcacttgaactattttggcgaagcacttaaacccctaaataatttttcatcttgttttataaccccaattgaaagtggttccccatattattgtctaacaacatttctctttttctctctctacatataaatcatatatatttgttcgactaccaattttccttgttaactttctcgatatccgtgccgtgcactgctgcgccagtgtcatgagccggcgactatggtttgtgtgcattgtaccatcacctaattagagttagctctgccgccatcagccagtgactatgggttatatgtattgtgccatcatctaattagggctagctccgtcgtcccatctatattttaatcctgcgtctgccactgctgggagtgattgtaaagtggtcttttttctgttctcatttgtacgaatcgataaaatcagaaatcagggatttcataatttcattagacaaagctgaatacccagcttttgctcaaatcttaccacaaatttaattagacctaaacattagactcctatggattggttggacaacttaaaattaatcaaagttctcgtggagcagtgtagatcttggatgtcgattgttttgtatgcgagaactaatttcctgagttttcttccaatatttatgttgttgtaaaactttggtcgattctactgaatattattattctggtgatacaccatgatagagacgccggcctgaaggccttgggccagtctccaagggttaaattaattttcatcgtggtaataattttggcaaaaattaggctgggccggcacgcaagcggggtcagaaaatgtgggtgatacttaattggaataagttcacttcatgaccctcgaaattgatcgaaatctaatccgtga

SEQ ID NO: 11601 - DNA, 28338 bp, Oryza sativa
gccaccatggattccatttctattctcccctttcttgcttcttctccttcccagcaccggcggtccgggtggtgaggacaagggtggctggcggttggggtcatggagagaggaggtggacgacgtcgcgtgcagtgttaggggagaaccacgccgagccaaaaaacaaggatgggaaccaaaaaacaagtccatagtaaaacaaccgccgcaaatcaacagaaatggttagttgattatagtagaaatccagatagtaataagaaaagctatcatctaacctaagaagaagtcatggagaatgtctagatttttcgtcctaaaaaaagaggcagctcaattataatttcacatatcttgccatgagacatgtgtcttaaaatacccaatcaaactaacaaaggcattaagaacagtttctgacaaaaacatggacgttagtattgagagatttttatggcaagcaaacagcggatttaagaaatttaagaacgatttccagtggttaggctataacctaaataagcgataaactgattaatatgtaccaaaattataaaaatctagaaaaagtgggaaaaccaagaaaaaccctaaaaggaacataatatttcgatacctgtaattttaggcaaaaaaaaaaaaaagaggacttgaatggggtggccgtggatcggagtcacggataagtacatgaaattttaaagtttaagtaattttatgaaaatagaaaaaaagctaatttaaattggaaaaggaatattctttcgagttttttttgctgacagatggccgttggttccaaagggcagtcaggcaaaattagggagaggtatatggggggaggtctactacacgaacgttcgtggatgacgaatctcacaaaccattagcctttcttcgtactaaatcatgtaaatcacacgcctaatcacggtttgcacctattttgtcgtttctgtccgtaaatgctttattttttccaagtttgttttgattggactattttctttttagaaaaatactccctccgtattttaatgtatgacgccgttgactttttaacaaacgtttgacctttcgtctcattcaaaaaatttatgtaattatcatttattttattatgacttgatttatcatcaaatgttctttaagcatgacataagtattttttgtatttgcataaaaaatttaaataagacgaatgatcaaacattggttaaaaagttaatggcgtcatacattaaaatatggagggagtatcctctaaaatttctaattacatataatatatatatactaattggagtatataaagtttttatatagaaaatatatatatagtttataaatacataaagtttatatacataaagtctatatataaaaactttttatataaaaagtctatatataagggtataaataaaaaagtctacatgtagaaagtttccaaaaaaaatagttgaaataaaaaaggtaatctggaaaaaaaaacggtgtgaaaaaaacagaaaaacactatgggttacgtaaaagaggaaactaaaaaacgaaaacttatcaccttaaaagtggaaacggcagtgaaacggaaaaaaaacggaaagagatgaacaatacgcgtacctgtgaagaaagaaatatctgttcccttacctattcgtgagatctgctagtggcgcacgttcgcccacacttgattcacggaggagggaagggtaatgggccggttgatggtctttgtcagcgaggatgcatattagactttgcgttttatgtgtagtgagagactggtggccacgacacgcgagaagtccgacacggcgtcggtcgctcgccgttcctactccgagtccgagtcagtccctcctcccaggcagcctatataattattcttctatcaattatctcctcccaaatcgtgtgatttccttccgccaatcgatccctctcgcaagcaattgttgcggccagatccgatcgcatcgatcgctctctcgggcgagatggccggcgtcgaggtctccgtttccgtctcccctaccaagaagagaaaaggggggagtcttccgccctggacggaggagaggacgatgccctggctcatccatcaaagaagaagaagatgtggctgctgcccaaggaggaggtggactggatcctcgctcagtgcaacgagcccatctgcgccaggttccgggagctgaagcgcgccaacccgtcgctggtgccgtcgccggaggagaaggacgagtacaccatgcttctctacgagtgcacccgcgaatcctacgaggacgaggctaagtacgccaagttccaggactgggttcggggcgagtacgctcgcaaaggatttgtggaggtggactatgactatttcgccaagagggagaaggccatttggctgaacgaggaagcacgggaggaggttttggggcactggtcagatcgtcatcatccttcccacaccgaccttgacgatgaagattggaagcttgtaagatcaattctagaacgatttgatcaacggtccgcaatttcccgattcaacagaaggaactaagcttttgtagtgaacaaatcaattcacctctgtatgattcactttgtgcttccattctctctctggcagagaaattattttgaagtgtcatatgttttcatcatctgtctttctcttctcacctctatatgattccactttgtgcttccattctctgtctggcagagaaattatattgaagtgtcctatgttttcatcaactgtcattctcttctcttggtggtcaaatttttttggtcaaattgaaacatgaatgatttagctatagaaaatcattcgacagccatttagccatttagccttccccttccccttttggtgcaggaagcttccttcctatagttcagagctcatataaaagaaaagtccaatcttttcactaatcggttgctaatgtgatcggacgggttaatcatatagtatatgagttatagtattttcatcagaaactcatagttggaatcgcaactaagcttttcaaatgttcaaagcaaattttctcagatgtcggatggaactaattaatatcttgccaatttagatatatacattttttcactgtgctttaatctgagcagccaaaggtccgtaactcgattcttggatccacaaaaggttttggtcatggggtggtctaaagatgagatttttggggctcaaactttgggtggttcagattgcagttcggggctgatgtaaattggtgtagtgcaaatatgcatctggtcaatttgtaaagactgcatgtttttctgatgtcttctgagtattgatttcgggagagatttttgttgtttgtctaccgttgccgaaaatttatctcttctctccaagaatttatttactgcactgccaaaatgtatatggagattcagaattcttcagaaccgcttctgcaaggccaaaacagctgagaaccgtttatcattagtatgcaatgtttgctttacggacatgaatatagtagtatggacttgcaacatcagtctatgcccttactttatgtcatcttcatgaaatacgatacgtttgcagtcaccaatagcatgcggtttatggttattcagaacttcagagttcttttctttccaacgcagtcagtttttccctctcgtacgtgtttcagagaaattgggttggaggcaaggagtaagtttgataaaaaccgtgaattacacaaaaccacaattatagtcttggcaggtggtacataaccccaaatattatggtcttagtattgaaaaaaaaatcagatcaaatattagagcacaaataacaaaataaccaagctcaacatggatagcatcccagttgatgaacataattatctggtaaacggtagtgttgactgcagaatataccgctgaaattgactacctgcgagtgcgagtagcgcctgtctgattcttttacgctcgtagtccccttgagagtatttgcttcttattgggaatgactggagtgtgattttttttcctgctctcagttggacgaatcaacaaaatcagacatcaggagtttcattagacgacattgaaactaaacttaaacattagattcctaggattgcacaatttaaaaaaacaaagtccacgtggagaaatgaagatcttggatatagataattttgtcggcgagaactaactgcaagagttcctgccaagatatttcttgtgctaatattttggttgattctacaggggtctagctatacattggttgataaattttctcctaaaaatttatttgggaggtccaaatataagtcaatcatagagtaattaaattataacgtatgtataaccacaaaataatttgtatgtaattaaaagtctcacacagtaacatattattttcatgaagcagaggtcgctatgaccaaatctccttacccatgtacacgctatgatattttgtattcctaacttaacggttttaacgtacaagttacattgcagttttatgtaagttgcaatataagtaattttagtgtatttatatatgatgaaattttagaaagagaaaatttatcgacaactatatagaaaaatcattctactgaatattattccagtcatacaccatgatacttcagggactacaaacgcatgggtaaattttatagtgcaaaccataaatacattgaaaatctgaaaactatatcgttggatcgaaaaatagacatttgaggataaatttactcctaataaatttttacttaggaataaatctgcgagttgagtaaaatttttacttgtgatgacgtggataaatctcagacatctatattttatccaacggtagttttatgtttccactccatatgtagaagatgtggcgtctgcccaaggaggaggtggactggatcctctctcagttcaacgagcctgtctgcgcctggttccgggagctgaagcgcgccaacccgtccactagtacagatccttccatctgtgacggcccctaacaagactggaattcgcgggccgtcacaaggaagtaatctcaatcgggccgaagtttcgcccgattgaaatatggtcgcacagccatggtagatcggcataaaactaagggtcataattgaggcccgattgagatgagggttccatatctcaatcgggccctaaaagaagcccgtcacaaatgactgtcatctgtgacgggcaccaaccagaggcccgattgagataagtttaatgcccgtcacagatgacactcttctttgacgggcttttattaaggcccgatagagattacttgtatgcctgtcacggttgattgttttagggccgttacaaatatttgttgcacagtataaataccccccacctaatgtaactatatcccactgttcattattttagtgggaggctgcagggggcgattttttgtcttttttccaaggaaaacagaaaattcccaaaagtgatcaaaatggagcaatcaagtgagtaatattaatcattaattgagcaatttcatcacgtcttacttttgcaatactgatcttataagatgtgcctctgatttgttttttttattttgtagcaattgatcgaagttggatgtatgcgaaaaatttgaaacgtcattctacggagtacagaaaaggcgtaataaattttatgaacgccgcggaggaggatcggaaaagaagaaacaatgattacatgtgttgtccatgtgcagattgcaagaatgagaatatgtttgatagcggagaggatgtacacggtcatctgatacaacgaggattcatggagggctatacatgttgggtgaagcatggagagcaagaatcaggaagtggagcagcaacagacagaagtggtgcgcataatcaggaagatgaagatgagcatgacatgtttataccttctccattgggcggtgaaatggttgatgtggatcacgatctgctgcaagacatgttacgtgacgttgaggacccagcccagaatgagagagattccatgaagttcagcaggttggtcagtgattccgagacgtctctgtacgctggatgcaaagcaaaacacactaagttgtcagttaccttggacctaatgaagctgaaggcaagtagtggatggacagacaagagtttcacagatcttttaggaattttgaaggctatgcttcctgctgagaacacattgcccgagacgacatacgaagcaaagcaggttctgtgtccactggggttagaggtccgtagaattcacgcttgtccaaacgactgcatattgtaccacaagcaatatgcggacttggatgcttgtcctgtctgcaaggcttctcaatacaagcgaaagaaaagtgctgacgaaggaaagaagtcaaagaggggtggttcggcaaaggttgtgtggtatctacctatcattgatcgtttcaagagaatctttgccaacccgaacgaagcgaagttagtacattggcacgccacggagagaaggaatgacggtatgcttagacacccagcggattcgattgaatggaggaatatcgatagaaaatacaaagactttgctgccgaccctagaaacatgaggatatgtctgtgtacggatggcataaatcctttcggtgacatgagtagtactcacagcacttggccagttcttattgcgaactataacctcccgccatggttatgctttaaacggaaatttattatgttgtgcttgttaatccaaggtccgaggcaacccggcaatgatatcgatgtattcctggaacctgttatcgacgatctagagattctttagaaagaaggtgtggaaacttgggatgcatatggtcaggagaacttcaagctaagagttctattgttctgcaccattaatgactaccctgtactcggtaatctttccggacaaactataaaaggaaagaatgcatgctccgattgcaaggaacatacacgaagccggtggctgaagaaatcacgaaagatggtatacatgggtcatcggaggtggctctcgctacgtcacgcatttagaagaaagaagaaaatttttaacggtaagagagaacttcagcctgctcccaaagatttgtccggagatgagatccacaatatggtcaaggacataagcaatgagtttgggaagaaaagaaaacgtagcaagacaaagaagaagggtatgtggaagaaaaaatccatattttggcggctaccttactggaaagatcttgatgtccgtcattgcattgatctcatgcatgtagaaaagaatgtgtgtgagagtttggttggcctgatgttgaatattcccggaaagacaaaggacgggttgaacgcgcgccttgatctacaggacatgaatattcgcagtgaactccagcacatacgagatgcagagacaggttgagtgtacctccctccagcctgccacacattgtcgaaggatgagaagatcgcaatgttatcatgcttgaaggatattaaagttccatcgggctattcagtgaggataagtaagtatgttaaattggacgactaaaacttgttggaatgaagtctcacgattgccacgtgctaatcacacaaatcttgccagttgctatcagaggcattctaccatcgaaagtgcgtcacacgatccaacgtctgtgcaccttcttcaatgcaattggacagaaggttatagatccagaagatctagatgggttgcagaccgatattgtgaataccctctgtcacctgaagatgtttttcccactgtctttctttgatataatggttcatctccctgttcatctggtgaagcaaacaaaactatgtggcccggcttttctaagggaaatgtggccgtttgaaaggtgcatgggagttttgaattcatacgttcgtaacaaagctaaacccgaggggagcatcattgaaggttacacgaccgaggaggctattgagttctgcgtcaattacgtccgatgccgatcctatcggagtttctgcgtctcgtcacgagggaaggttgttaggtgttggcacaatcggaaggaatagaattaggcccgatcaagcgtcgtacgtgcaggctcattacactgtgctccaacatatggcagaagttggcccatactttgaggagcacttagcgaaaatccgagatgagaacttggggcgatctgatgcatggattaacagagaacataactctcggttcaacgaatggttcaagaatcatgcgacaatgtccacggatgtcccaaatgagacagtacagttgttggggatggaaccgtcttggaccctgggagctaaactacgtcaagttcaaggttcctttgttctgctgccgttgggtgaatctacgcactggtgtcaaagccgacaagaaaggatttactttagtagatctatcaagggtgggatacgccgatgaaccatttgtacttgcgaaacaggtcgagcagatattctacataaaagacccttcaaacaagaagatgcacatcgtgagggatggcaagcgccgaattgtaggagttgacaacgtcatcgatgaagaagaatacaaccagaatcttcatgtaagaccttacattgaccttgacgatgatccccaagagtctgtggcatatgctcgtttagatcatacggaaggcataaccttgtgaccgatgcatttgtacttatctattgtaatgaatgaagtattttattttattacaaagacttgatatgtgtactaatttatatggctaattttgttttattacaaatgttgtttaaatatgtcaaatattcaaattgaatttcatgctgttgggaatatagttatacataaaagtgaccaaaataaaagttgtagatcttgacaggatctacgactttgttgttgttgcctttttcatttgaaatcatttactatttacaaaaagtggttttaatttgtcatattttcaaaatcaatttcaagctgttgggaacaaagttatatagacaaatgaccaaaataaaagttgtagatcttgataagctctacaattttgttgttgaccatatttcgatttcaaatcatttactatccgaaaatgtattatgactaataaattgaattattatatagcagctatatattttgcactcacaaatataaagacttgacgggaaaaatagaaaatagtcatcggtgacgggccttattttaagcccgatagagattaatctatctctatcgggcattatcgtagggcccgtcaaagatgagtcatccgtgacgggcctgaatgtcatctcaatcaggcattagtatggagcctgtcaccgatgtgtcatctgtgacgggccctacagcaatgcccgattgagatgactcatcactatactataactagggtttctcagatcagatcgaaaatttttctaagtcccgctacagtttcccgcctccttagaaccctagcgccaccgtcgtcctccatcgccgagcccgccgctgtcgccaccgagcccgcggccgccgccaccgagcctcctctgccctccattcggaccgccgccgcctcctcaccgatgacccccaccaccgccgccaccgccgccaccgagcccgccgccgccgccaccgagcctctgcaccgaccggcgtcggccttccttgtcgtcgccgcccgcgtcctcaccaacgcacgtcgccaacccccaccgagcctgtcgctgcccgcccggcgccgacctgcccgaccggcgtctccaccgacgggcgctgccctccaccgagcctggcgccgctgccgtgaactcctccttcgccgagcccgccgctgccgccaccgagaccgccgcctccaccgaccggcgacaccctccaccgagcccggcgccgccgccaccaagccccaccggccgtcctcaggtgagtcctccatctcgccgccctctgctaactgtgaatgacatgtcattgaaatgtggatgtggatgatatgtgattgaactgtgagtgagacatgttgatgttgggatgaaatgtggtgcatttattaattctgtgatagatgattgtagtgattgatgaaatgtggttcatttaactttctttatatgcgaagtggttcatgttgggatgaaatgtggtttatttatgttgggatgaaatgtggtttatttatgttgggatgaaatgtggtatatgtatgttgggatgaaatgtggtttatttatattaaatagatgaatttagtaaatagatgaaatgtggttcattttataaggatgagatgtccaatttagtttatttaaatgtttcatttatttataagtgacattcaattcattgtaatagattttagcactgaattctgtattttcgttattttgaaaaaaagtagacgatgtctcagcaaggcgaactaatgtcgatgacaactagtgggtcctcaagggcacgtactcctaggacagggaacaaaatccttaaggaacggttccgcataacgacagtgaaccaagtagggttgccgataggtccaaggaaaatattgagccgatttaggtttatctgcggggtcatagggaggcagaaattcagtattccgcaagatgacatcaagcaagtgccggccgcagagaaggatagtgcttggctagcgttcaaggagagcttcgattatcctgtagagcacgagaaccttatcaggcaggctgcttttaaggtcatgggcaacgcttggaagaacttcaagagtaagctagtcggcgagttcgtcttcaacccgacgaatcctaatccaacagagaaatttccttggatcacggaataggtctgggaggaattccatgcgaagaagtcgacccccgagtccatagctagaagcgaggcatatctcttgcttcagaccaagaaccagcatccgcaccggcttggcaccgccggatatgccggtaaggaagaggaatggccgcatgaggatgaagaagcggaggaatcaaacacaccgctcatgtttggcgatatcccacacccttgggctaggaactaggccagggctaggtaccagaagaatgctgatggcacaatcttcatgccaaatgcaaaagatcaacgagtgtacgaagctatagtaagtgtctagtcaaactagatgttcgcattgtttcccatcttgcagtttatttaaccccactaaattgtaatgcagaaggaattggttgccgagcaacaaacctcgcaagaggccagctctcaaagacgcgaggacgacctcctcacgaaagtgttgggcaacaaggtacactgtggacggacacggggcgttgggtcctccgttccctggaagtatggatttccagactacgcgtggcagtacaagaagcggacttccaacaaggcggagaaagatgcacgccttgaagccaagatccgggcgtcgatcagagcggagctgacatctgaattcgacgaaaagctcgagtcgatgagggccaagattaggcaaaagatccaagaagagcaacagaacccgcaggccgccgctgccgttgcgcatgaagagttaggaagtcccacccaaaaacgcagcagttgcgcatcaactgagttggcagaaaatccaacatcggttaacagcgccatcgaccacataatggtaaaagtttcgtacacaatgcatgaaaggcttaacgaatcaatatgatatataatattctaaagaaattgatgaatctatcgcaggaaccaacgagctgcaccctcacagttagggtgatgccgaccttcacagttccagcagccgagggacttgcgtacaagccgaccccagagacaagagtgcatggattgcaacttaggggcgactgtgcaaaagttcaagtcgactcggttaagcccgaatacgagctgttcccactgaggtacccaccgaacgacgaggtcctctcactaggaaatgcccgtggtaccttcatccaatggcccaaggaccacattgagataagggttacagcgaggccaaccactgcaccaggcggtcatccgccaaagagacccgcctctgctccttctgcccctcctgctcaagatcgtcctgcacaatcttacgatgtgcagttgcagtacgacacagattttagggaggaccgaacggaggccgacagcaaggcgattcatgaacccccacctatgaagaagagcaggaaggcacactcttcccctcatagaattactcttgataaacccgaagcaaaggggagaggaaggggaggaaaggtgcaggcctcgcttctagctctaaggaagctagatctgggcaagggccaggaagacactaagggcaaagaggtcaagaagaaatacgtcgctccataggagttccaactaggcatgccattggttggagatgacgtgcttgccgcaatgggcaccgcttgcaaggaccttcacgtatactacatggagaaatctaacactaggaggccaaataaaactaccgatatccttggagagcacgatggaaagccattccttggtccaacaaattatatcatggtcgacttcaaggatctattcgacctctacaggctccgagcggtggacacaagcctccttaagtgctactccttgtaagtattatcgcccaacttaatctggtaacaacaattggtttaactcgcttacaagatcgtttatcatgtgtgtaggttaagttggcaatggtgtcagaagaatgcaccggaagttgccttccttgatccacaagtggtcactgtcacaaatatccagaatgaccgtcaaggaatggtcagctacatctacgacaccttgtggtcccgccgagacaaggagtacattatgtgcgcctataatcaatagtaagtgtgttatctaaatatacacaacagcattacacattccttcagtacttaattaactttcactatattaatgccgcagtgcccattggatccttctagtcataacacctaagtggagtacatgtcactaactgaactccagaattgataagaacacatatgattagaccccaattcaactagcgatagatgaagcgtgggcccaatacgtgcaaagaggatgcctcaggaagacaggacatgacaccctcatccacaaaaaagacttcccggtgaagcaacaaataggtgaccagtgcggattccatgtgtgccacaacatgcgccttctgtacagagaaaaggtgaagactttggctgagtttgaggtcggtggtctcaattgtgatagactaactacattttagtacttatatatgatcgatcaagtaatctggaattatgacaatgtagggcacaataaccaagtctctgcctaccagctttgaggagattcgtgaggagatagccagcttcatcctccgtgaaataattaaccccaaaggaatgtttaggcttaaactaaaatgatgagcaatgttgaacttttatgtctagagaatgatgaacacttattatgcaactgtgatgatgtaactgtgatgcttatatttatgtatatatttcatatgtttatgttaagacttgctaaataaatatttgatccaattaactcggttttgcaggtgaaatacgataaatatttaaatggatgtgaaatatgtgaatggatatgaaatatgagatggctgtcaatgtgtggttgtgtgaaatatattgatgtctgtgtatgtgaatgcatatgtatgaatgggtgatgctggggagctggggatattagatatctgtatttgtttctgtcatttttgcagcgggcatggctagcaaaggcctgaggctagccaaaaaaacaaaatttatttttttttgtggattatactcatctttgacgggccataactaaatgcccgattgagatgatgttcatctatgatgggctctagtttaggcccgattgaggtcagcagtcatctgtgacgggctctagtttaggcccaattgagatgagtgtcacatgtgacgtgctctagtttaggcccgattgaggttagtagtcatctgtgacgggctctatttgtggcccgattgagataggtcatctgtgacgggctatagtacgcttggtagactgggtcaaagctatcggtgacgggcttcaattagggcccgattgagataggttcatctgtgacggccatttgcccgattgagattacttttcacatcagtaacttctagcctatgacggacgccgtgcccgattgagatggggcttactgcctgattgagatgagggtatccgttctagtggtccctggtgccgttgccggaggagaagggtgagtacaccatgctcctctacaagtggacccacgactcctatgaggacgaggccaagttcgccaagttgcaggcctgggtttgtggcgagtacgctcgcaaaggattcgtggaggtggactatgactatttcgccaacagggaggacgcgattaggctgaataaggaagcacaggtggaggttttgggacactggtcggatcatcattatccttcccacaccgatcttgacgatgaagattggaagcttgtaagaacaattaattatagaacgattcaatcaacggcccaaatttcccgattcaacagaaggaactaagcttagcttttgtagtcttctcaactactccgttgttggtagtcaatttttttccccttttgttggtgtggtcaattttttccccctttttttgttgaaagcggattgcgagatacagaagaggatcaattttggagtcatcaagatcaaaaagaagataattttgaagcatgagttctcatactccaaaattggggggcatgttttaacagtggaatttggtaagccccgaagtcatcatcggcctagagtgagtttcagcttcagagtcctggaatcggccgatgaaattatcacgtcggtaatagtcggattcttgctatattcggttaaggaaattaatcaatcaaatgaagtttatccaggagagaccgagttaaagaaggatgcgacaagcagattatctattaattcggaagagtatgtaagtttccttttatcctcaggaaagtttctttcttttccaacaaggactagcatctacccttggtataaatatgtacacccgaggtcattgtaatctatctcaacgatcaatacaactactctcggcgcatcactactctttttgcttttctactttttcgacgagtttatacttctcatggctgtttgcaccggtggggctagggcttcgacactctaatcttgtcaatgtaagcacctatctatcatatatcttagttaatctattttggtagttcaatttacttgtatcggctaagatttgttttaggggtttatgctggtatcggctaaattgctttatcatattagattagctaagatatccactgccctgaagattagtcaaagacttaattgtttagactttatgcttctttgcatactttgcgatatatcatccctagtcgtgcttgaatcggaaaagctaacctgcctttgattataataagggtttcatcggggtttcagctgatgagttatctggacgttgcatcggcttataaggattacatacaagttagatttagccgatcgcaacaaaggtttcgttgtttatctaatcttgtggatttaatgacatcagacctccagccgatgtatgctttaaccttcggatcaatacttattctatcatattgttagccgattggtttctattggattatattgttgtattgttacattattatcagccgattgtctatgtatcattatttactcaagtatcagatcccacattggacgtatagccaatagctcaaaaccttatcgctatcggctagtatcggcatcgaccggaactactccagcggcttgtcagctgatcggctatttgatctactatttatatatcttgtcagttgtaggatcaaactgactagcatgcccgcatgccatcatgttttggacctgcactagagctaagcagatctctcaggccattgtgttcatcaacttagttcgtgccaacacagttccggcaccatcggctgagcgcggatttctcgtcagcagccccccaattccgttgtatattatataatgcggcggattttgctcttctcgaacccgcatcaatctaggggtttctgttttgactgtagaggccactactttgaaatcccctttttccggctaagtctttcatacgtgctccatcgcaaaaactctttcgtctccgacgactccactggtgatccagtccctcggcggcgagctcctttccaacgctctcgcgctctaaaaacacgctaccgacgctagtgtcgcgctaccaaagtgcgataccgatgagcccactcccgtccatgcctctctctttctccctaatcgcaaaacccatcgccacgtggcactctcgctcgataaaatagcgataccgccattggtgtcgctaatccaaaaagcgatgtcgccagctcaaatgcttcacttttctttctcgcaagattgtcgggctaacgtcattgtcttgctgattggtactgcgatggcatggcggtatcgcataatccggttgcgaactgggtatcgcgcttcctaaccgcgattttggaaaaaaaattatatattttcaattttttctcgcaccaatccccaaatccgctggcgctcgcatcgcacgttcgctccggtccgcacgcgagtaaggctgtgtttgggaggaaggttcctcccaacatggaaagcaaagcatgcgattatagtgagatcaattaagtatttgcctaaaaaacttgaaaaatggattaatatgattttttaaagcaactttgatatagaaaacttttgcaaaaaatataccgttcagcagtttggtcaggtctatataaaaacgtagtattattttaacacaaaacaaacatattttcgacgtttgatgtcacgaccacggtatttgcatagtatggggatcgttggtactaggatatttgcgagatagaggtaaaagagatggagacgaggattttcatacagattcgggcccctgaattgccaggtaataaccctactcctgttggccgaagccggtcgttgctcttattcaccataatcacaccaatacaatatttggggtagcctatctaactgttgtcgacttggcggtctgaagtgctgactcgtagtcgacaacagggtagccttccttctcgaatccgcatccagcaagatcaaagacagcgctatgtctctcctatcagtatccctagacaccgtaagggactagccatgcttatctctgaagtcgatatccggcgtcttgtcttggcgtatgttggcttgtatgttgatcttgtgtcttgatctattgttccatcccccctctcctcctagagggtcttgtatttatacccataggtgtttccttttccaagtagaactagggaaaccaatatggatacaatctgagtaatccttgtcgtttccatatagaactctatttatctttccttatctggaactccttctatacccgaaggttgttttcgtatgaaacatggtatgtggtgggtcgtgccgagatttagtcaactactattaggtatgtggtatccataaccctgacagtagcccccgactttaatgcaaatgaacgagtacatattctcaatccgaagacctcgtaataactgttgtcgaggtcacgtgaccgttctcggtgagttcagagataacgctagacttcccttataagccttgtgcaggcaccgtatagggtttgtctgagtcaatctccgacgtcaactaagaaggtacagagcatacgactaagtttcctgtcttgctgtaatcgagaatttggattgaagtcaagaaattttatctcggcgggtacaccatcttttcattccgtattccttgttgagatccaccagccgttctcaaatggtcgagaaggcgcaaagtctgcgacgaaaccttgtcaacatttgtcatactcgccttagtcgatcttggtgtagaacaatagagacatggagtcttcgacaatgtcgaatagaattttcatgaaatcaacactcagaaaagaatattagatagaaatggcccccgagcaaatgctcaaagggtgacatgttataatatgtatggaaaactaaaaatgaattaaatttacaaaccaatgttttgtgtacgagcgtcttctcttttaccgacttcgatcagtcagtttgttgagtcatacactctccctagcccccagccttgtcatcggagataagttctcagaggagaaggctcttggacccttgacctgccttggttgaaaaaacgcttaccctagcccccagccgtgaagttggaaaacccaattttcgattacacggcttggttaatatgcacggtgagaactcttacatgaccggatcttacatggtcattcgtctctgcattacctgacaaggccttatctgctctgggcgtccctagccgaagttcccttaggttcctcagaggccttgccagggcggcgtaaagggacagtaggattagttttaactctaggtgtcgtcgtggtaagggatctctgggtaaaacacttggcgatattgtgtacctgatatcaactttgttggagtagagataatgagaggatcgctacaccgctggtcgaaaaccagttgtagccccaactcaaccacttgaagtaaaggtagtgggagaatcgctacaccactggtcgaggaccatgtagtagtcgaaactcaaccactagaagtggatgtagtgggaggaattgctacaccgctgatagagaaccaggtgtagccttaagaaatagaggtagtgggagtatcgctacacctctggtcgagaaccaggtgtagccttaactcgaccacaagaagtaaagctagtgggagtatcgctacaccgcttggtcgaaaaccaggtgtagccttacctcaaccatgagaagtaaagctagtgggagtatcgctacaccgctagtcgaaaaccaggtgtagccttaactcgaccactagaagtagaggtgcgagagatcgctacagcctactagtccgagaaccaggagtagcctcatgtctcggccgattgatgtcgaggtatgagagatcgctatggcctattggtccgagaaccaggagtagccttatctctcgaccgattgaagtcgtggagcgaggaccactacgctgctggtcgaagaccagctgtagtcgtacctcgaccatctgaagtcgtggtgcgaggaccactacgctgttggtcaaagaccagtcgtagtcgtacctcgaccatctgaagttaaggtggggcgctagagttggtttattacatgtgcatctcatctggccagcatgactcacatacccaacttgtagcatatccggatgtccgtccacaatcatgtcgggtgatcaagccgacatcgtttgcgagtaattatccgttaacaacccttttctcaaatagcccagtcatagccggtgctatgagataggtcgtcggtcttcgttggtaggttggctgcgacaaatctgcatttgtctagaacgttctcgataatggggagtgctcgaccacaacctaatcgagtgctcaattgttcctgaaaagtatttttctagaaggcaaggcatatagcagagaatatcgagtatgtactcaaaaaacttcatggatcttctagtattatcagaatataacgagcagatgtaaatatcaggcattatgtaaaccgtaaacaagcatgattcatacagaagagaacagagcgagtccccagcgttagaccgtagttggcctaacatcggaaacactcgcacaatagatattgtataaataacatgctctaggtaaacataataaattatagatctgacaatgctgtatgatctgaataggtacgataaattgcatataaaatattgcatacatttgtagatacatgtcagatgtatctacgaaattagtagattaatttaaaaaaccaatccaccaattaccttactgcgtactcgtttgatatcatatgatctgacgtcttttggtacgacgcgtatcttgaggcttggatgatctcgataaaccaaattgttgacaatgatggttccgatcttgtcgaggcacgtactctggttagattaaacttcccagatccaaagtagttgaagtagccctcgtcaaaaaatctatagtgacgatgacttggtgaagcttgacgaagatcccgatccgtcggagaacatacttcgttcgggtcatatcacccaacatacgaagtcgctgagtagtttattgttgaagaatccatctcttgaacccatctcgtcgaaatcctgaagcaccaaaatcccctacctggcacgccactgtcgacgtttgatgtcacgtctacggtatttgtataatatggggatcgttggtactaggatatatgtgagattgaggtaaaagagatggggacgatgatttttatacaggttcggttccctgaattgtcaggtaattaataaccctactcctgttggccgaagccggtcgttgctcttattcaccataatcacaccagtataatatttggagtagcctatctaactgttgtcgacttggcggtctgaagtgttgactcgtagtcaacaacagggtagccttcctcctcgattccgcatccggcaaaatcaaagatagcgctatgtctctcctatcagtatccgtagacaccataggggactagccatgcttatctctgaagtcgatatccgacgtcctgtcttggcgtatgttggcttgtatgttgatcttgtgtcttcatctattgttccgtcccccctctcctcctagggggtcttgtatttatacccatagtgttcccttttccaagtagattagggaaaccaatatagatacaatccgagtaatccttgtcgtttccatatataactctatttatctttccttatcggaactccttctgtaccacaaggttgtttccgtataaaacatggtatgtggtgggtcctgccgagatttagtcaactattattaggtatgtggtatccataaccctgacacatatcattaaaaatatattcaatgttagatttaatgaaaacaatttaatattttagatgttgctaaatttttttataaatttaatcaaactcaataaagtttgaaaacaaatcaaacgactagtaatacgtccagtaaaaaaaaaagactagtaatacgaaacaaagaaagagtagtaaaatttctccgttactactcgatgtgttgatcccattcaggagttaccaactaggctattaatacgacgagtgataaggcagaacaaattaagcaggcagacctgcaaagtagcaagccagcgctcgcacctccgattccgacactgcctcggtcgcgcaccacccccgactccgactccgactcctatccggcgatgagtaattaagctatatattcaatatggcggaggaggagtcttccacgtcgacggaggactagacgagcagcatcctccggcgaagaagatgtggctgttgccgcaggaggaggtggaccggatcctcgccgagtccaacgagaccgtctgcaccgtgtaccgggagctgaagcgcgccaacccgtcgctggtgccctcgccggaggaggagaaggacgagtccaccatgctcctctacacctgcgcccgcaacgcctacgaggatgatgccaagttcgccaagttccaggcttgggtctgcgacgagtacgctcgaaaaggattcgtggaggtggactacgactacttcggtgagagggcagaggtgttcaggctctacgatgaagcacgggaggaggtgatgggacactgggatcatccttcagatagcgacgatgacgacgaagactggaagcttttcattagggcaattaggaggaccttcgtctgaatcgaatctcaaacccatcatcacagtttctctaatcttattatttgtattgtaagaacaattcaatgtacggatgcaacagtttacctctgtatgatatctattcacagaaatttaagtgtgttgtgctgatcgacatcattttttgattgttagttattggtttacacgcttgtgcgctctgttgttggtgttcagcctttttttccttttgttgctagaagcctcgtacaattcagagctatgtaaaagcaaaagtccaatctttgactaatcgttgttaaggctgtgaatgggattaggactgatgggattaagcattttttccaaattgtgctgttcttcaacctgaattttgtaagcagagcgagctgaatatgtcaccgagcagatatattcagtagtgtcttcagctgttagcgattgcatcatgaatggttttcttgcggtaacagatgaacaaaatttatttttgccttctgtacatgctacccagccaatctttgaattaaatctcaaattacttgcctcttgcttccgtatagcaagaatcctctgtatttatgtgcttatgatgtgatagatataactgcattgacaggagaattaggagtcatttggttttgtatatatgatttctgacaaaaataaaaactctctgtttgtatcctaaatttggacccgtttatctgcacagtattttttgcatttttcttctcactgcgaggatgacgaagattggaagcttatcaagaggagagcaggacctgggtgtatagatgagattttggggctcaaaatttttgtgcttcggattctttctatcaatggcaattccgggctgatgtatattcgtttagtgcagcagatatgcgtcggccaattttaaagactgcatgtgtttctgaagttttccgaatattgatttttggagacatttttgtttgtgtgtgtggttgctgaaaatctatctgttgttgtcgccaagaagatactgcattaacaaaatgtatatggaggatcagaattatatacagaatcaccttttgcattgccataatagctgagaaccgtttttcattaatatgcaatgtttgcattaggtacatgaacatcgtactagaaacttgcacaacaacatcgagtctatattgatattgtgtatgtcatcttcaggaaatgagcggtctgacaatgacgacttagcattctctatccattgctttgtttatctcatcttgtcgagttaagacttacctctatatatgtgtcttggcttgatcattgacaaaagtgagaaattcttagtacaaagatctagtgctaatttttcttgttgctaaagctctaaagcatgaggattatatatggagataacataaactgaaagtgaacctcccgtacttcataaatacatggattagatttgcaccgcccaaaccttggcaacagacgtatgcaaattaattctgcgaattatatctatatttctgcctgacactgctgcaaatctgaaaatctctgaatctcacgtccgaatcccactaacgatgaggagctccatttttgtctcagggcagaagatggtttgtctactttaacagccctgtggtcattaagctttgctgatggtaactttggttggaagagttacttttcttggaaaatttgatactatttggcttccattccatgtttcttaacaaaagaaaaaattagttatgattggagataacctttttgatatcttattcttcatccagagatgtacaaagttaggaaatgatagttacttgactttgcaaaaggcattctgctccgagctatataggagcaagttcattgcattttaagttacttgaactcttaagactgcatcatgttcttgtgaacactcagtacaccattgctctgttttttctttttccagccggttctctgtttccattcatgttgttttacctttaggctgtgtttgttagaacaaattcccatccggaacagtaatcacggaaaatggagtggtccattagcgcatggttaattaagtatttgctatcttttttcaaaaatagattaatttgatttttttagcaaatttcgtatagtaactttttgcaaaacacacaccgtatagcagtttaaaagcgtgcgcgctaaaaatgagggagaggggttgagaaaaggggcatccgaacacagcctcctaattaacattttgactcatccatttttacaaattcatcagcgacagaaggcagatttgcctcaccaaactctggcctcctaataaacaaactcacaaggataccatcccagatctccagtagataaatataattaactctgataaatggtagccctaaatatacatacccctttgagaatatttgcttcttactgggagtgactgtaaagtgttctttttcctgttctcatttgtacgaatcaataaaatcagacattagaggttttataatttcattagaggaagctgaatacctagctttaatttgctcgaatcctaccccaaatttaattaaacctaaacattagactcctatagattggttggacaacttaaaaagaaagttctcgtggagcaatgtagatcttgggtgtcgatagttttgtctgcgagaactaatttcctgagttacttccaacattgttatgttgttgcaaaactttggtcgattgtactgaatattatgaatattattattgtggtgatacatcatgatagttcacggattagagacgatctcctgtaggccttgggccagtctccaagggttgaattaattttcatcatggtgataattttggcaaaaattaggctgggcctgcccgtaagagggatcagaaaagttgggtgatagtacttcctccatcccaaaatgtttgacgccattgatttttttaaaaatgtttgaccgttcgtcttatttaaaaaattaagtaattattaattcttttcctatcatttgatttattgttaaatatacttttatgtatacatatagttttatatatttcacaaaagtttttgaataagacgaacagtcaaacatgtttaaaaaatcaacggcgttaaacatttagggaaggagggagtatttaatctaccgatccaacatagataaagtagatggcactacttatgattcattcatttgatgaatctactgtagtaattaactgatcaatgagggcactgtacacaggaaagatctactgtgaagaaattgaggattttcgtcaaaaaaaaaaaacaaatccatcagttccctgctagattctcgatacttggaatgccaacttcggttttttcgttcatccacatctaggcgaactcccgcgcaccacaagaatccgtaattttaagacttggtgggttttccttggcaatcggttgacagaataattaatcttaacgattagcccaaggaaatcgtaatattcctaactttctaaatttggtagtatttacttgacggatgctatacttggtagtttttgaccgccaaaaaaattgcagattcttatagtggcgccagcacaaggtatcatgtacattgggtgttgatcgaataaccgggaggagcggacgagagaatgattctgttggtagttttttaaagcggcccacctttttatttagaaatatcaatatatatgggcttttttttcgagagattgatattttcatgccttaaatactcattagagatttccataacagggtttaggggatcaaattttggatgtttgttggccatgctctaagtgaagtagtagtaaaatacaatatatggaggaatatataatcctattggaagagatcacccagtttttagtggtttaatttgattctgaaaccaaatagcccgtatattcctcctggttattaaacacaaaaaatatttgtccagcggtcaaaacatgttttcgcagaggcaaaaccttccgcctgtatccaaatgacgctaaaaatccccaaattttgcaagcggaccaacgattttcgtaggcggcagttcgaatcttcgcaggcgctgtaggtgctacagtagccccgcctgcaaaaatattgtcggtccctagggtttcaaatcacaaatcacaaatcctcacaaatctcatccaagaaacaaaatccaatcacagatagtgtaaagttgcaacacaaaagtattggattcaaatccacagcaagttaacaacaatgaacaatatgtaaacttaaaagaagacatcgtcgccggtgaactcctccgttgcatggggtggccgccgccgccacagcctcctcccccctccgtccggatctgggaggggtgggttggggtagcaagcccacacagccgccgccgacacgtacccctcccctccgccagatctgaaaggggaggggtcgaggggaggggcacccacgtgcccagtgggttgtcatcgtcttcgcgtggtagtcgtcgtaggccccgtcgcgacccccctctgcccgcgcccctccgaccctctccgcccgtgccatcaccaccgccctccgcccgcgccgccgttgcccccccccgcccgcgccgtcaccaccgccctcagcccgcccccccgccttcccacttggcccgccccaccgcgggcccccttcgccggccccctccggccaagcctctgccaaaggccttccgccggcgcccccccgaacgccctcccccgaaagaaggggagggaaggaaagaaagggaagggaagggaagggagcccagatgaagagagagagagggggaggggaatgagtggtggggagaggataagatggaagagaagatatgataggggacttagtttattttatgtaggtatgatttttgcaggcggaccacataagctaccttctgcaaaaattcaaaaatcatatttttttcagacggaccacttaagaggtccgcatataaaaataaaggtattttcgtaggcggacctcttaagtggtccgcctggaaaaattaatttccgcaggcggatgatgaaaattcacctcggtttatattttcgtaggcggatatttggctctgggtgtcatatccacctgcgaaaataaagatccaacgttggcgaaaatgctttttctagtagtgaaatatgtgacgctgcagctagttaataatgccaagtgatacttaatgatcgatacaaatacgagactgtgatactttatatactgtggaaactgatttaccgctcggggcaagcaacatacagtcatcaaaagttggcgcatacatggatcacatgcacgagacaattaacaacgattaatattgatacgtttacatatcttgtcgcaagcttttggcgtttatcgatagatagacatatataaatttctttctctggccaaaaatcttgggcttcaattgattggttgataatgctgaagacttggcaatcagatcgattggagtccaatttgcagatcaacttggcataatatattaatttgatttcgtgcaatgatcgattagcgttggggtgcacgttgaacctggatatatataatactggcaatatgtgcctaaaaataagggtgagtgtgcctcacgtggaccctgtaaaataatgtgctgattgtctaacacaatatatataggtactgaatttggttcattgaatgatgataagataactatttctacaacatttactaaactatttagggccctttgaatcaaagaatttgtagaagaatttcataggattgaaatcctataggaatttttcttatttggcccttttgattcaaaggattggagttttccaaataataaacaattcatatgaaatggctcattgtatataggttttggaggaaatttagcaagatgtccaacttcttcgaaagttcttttgagtttagctttctcatctgattcttgcatttttactgtggcccaatcaaacgatcatttctgtgttttttctgtgttttgcaattctctattttacacatcattttattagaatcctatattatattttttctagtcctctatttttgtattcctactatccaaagatgaacaggcgcgtccaccggcttcggtagtactggttcaaccagaatcagcatcactatcagtttaagctacgaactgacagtcatacacagtaacatcaattctagttcaattcctctaatctctaccgattgcaataggactgtttgattcagactttcgctagcactactaaaaaaccaataataggggacaacctcatatgtaccggttcatccaat

SEQ ID NO: 11602 - DNA, 2525 bp, Oryza sativa
tatttggtgtaatattttatgatttttgtatgaataaagatatcttataattattgtatgactgtcattattgtaagaataattatttgtgtacggtttttttgactcatgtagatggatcggcaatggatgtaccgctgacccggggcggggttccctccaaagagtttattgacggcgtgcactatttttgagagaggccgaagctaacaggcaaaggggttttatttgttgtccatgcaataagtgtaagaatcagaaggagtattctgcatccaggactattcatttccacttgtttgagtcggggttcatgccaagctataattgttggacatcccaccgagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccgggggaaaacaaattgtccgagacaacgtacgaggctaagaagatagtctgcccattaggactggaagttcataagaatcacgcatgtccgaacgattgtatcctatatcgcggtgaggagtatgagaacctagaagcatgccctgtttgcaaagcactacgatacaagattagacgggacaatccagaagaagttgacgggcagctaacaaagaagagaattcctgctaaggtgatgtggtatttccctataataccacggctaaagcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctattcggacagtccaacaaggggtacaaggcttgcactcactgtatggatgaaacagaaagtacgtatcttaagcactgtaggaaggttgtatacatgggtcatcgtcgaatccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattaggaattcttggacgtacgccacgcaatcgacgtgatgcacctcactaagaacctttacgtaaaccttcttggcttcctaggtgtatacggaaagtcgaaagatacactggaagcacgtaatgatctgaagcatatggaaccaaaggagaaaggaagccattacttgagtccagccagctacactcttagcaaggcagagaaggaaagtatgtttgaatgcttggagagcataaaggtaccgtctggatattccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgggcattcatgaacgcaatttcgcagaaggtcatcgatccggatagattagaagcccttcagaatgaagtggtgcaatgtctcgtcagttttgagttgatatttccaccttcattttttaatataatgacgcatctgctttgtcaccttgtgaaagagatccgtattctcgggcctatgtacctacacaacatgttttctttcgagaggtacatgggcgttctgaacaagtatgttcgtaaccgtgctcgtccagaggcaagcatcgccaagggttatggaacaaaggaggtcatcgaattttgcgtagaatttatcgaagaccttcgcccaatcgggagac

SEQ ID NO: 11603 - DNA, 1596 bp, Oryza sativa
agttcgcgccaggaacatcggtaagtccgatgcatggattacacggcatcacattgatactttccccgcgtggctacgacaacatctcatgggtaacgagtcgatcaaccaacaacttgccttcctggcgaggggaccatctgggtcgatcgcgacattccagggatatgagatcaatgggtacacattctacacgagagcccaagacatgaagagcacgaaccaaaacagcgctattcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgatttatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttatcacagacaaaaataatttttcgaggtaattgtcattaatctttgtactttaaataatgttaatgcattaacttctattttataaacacatatgtaagtgaaaatcatatgcagtgctataatctttagtcccggt

SEQ ID NO: 11604 - DNA, 1013 bp, Oryza sativa
ttaagtagatgcaaataaaataagaaagttattagtacatgattaattaaattaaattatcataaatttgataaatggatatatttgatattttaaagcaactcctgtataaaaaattttcgcacggaaaacaccatttagtagtttgaaaaacgtgctaattgaaattggggtaaaatccgaatcttaataagaaaagaatattgtttaaatatagataaaataattgaaaccatcaatgatgaccagtattgcatactgacgtaatcacatgcatttatattttacatgaaccgtcgaggtaccggttgtattcacgtcgtgttcatcgtcagaactcgccgttgtagtttctctctctatcgggaccacgtcattatcggtcacgttcttgctgttatgattttcttcgttgccaatatccatcatctatggacgagtcacatcgtgggacacatcctaccatcttacttactattattggttcaccgaagcaccagcatccatcttcccttctttttgtttctcgcttttggctaggaaagacgatgaacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtgagctttttcaattgctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgttatttttttattatatttctttcatcatttatgccgaattatgatatatgattttaatttatgtcaatgaaagttat

SEQ ID NO: 11605 - DNA, 608 bp, Oryza sativa
ctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggta

SEQ ID NO: 11606 - DNA, 630 bp, Oryza sativa
gtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 11607 - DNA, 1002 bp, Oryza sativa
agctcgggctcgtgcagagagagcggaagaaggcgcgatgggctcgggaaagagggggaaacgtaagaggagagcacggggagggtttatataggctcgggagggtgaaatcgtggccaagaggggcgggatcggacggcaaccggccggtgacgtgggactcaacgtgggcggagtggggactcgatttggcgccaaaaattggggaaaagtgggggaaaatgtggaggagttggaggggaactggtttcactcggtttgggtgtgagggtgcgagcgggagggcgctggatttggcgggacgtgggcagcaaccgccggccatgtcggcttcggcattggaagccgaaggtaggagaagggcctgacaggtggggtcgccgagcctacctgtcggggagggagagagggaggagaacccaggggggttatttagattttgcgcgaggggaaggaagatgggtcgacggcccaaggaggaaggaaggaagaagggaggggacgggccgcggggagggaaggagggctttgggccggaagtggcccaaagtgaaggagggtagatttaattgtttttctttttattaaattggttaaataaactttgtgctattcaaattattactcgagctccgaaaattaatggaaaatttcacagagtattttagggcacagagaatattacaaaatatttccggccaatgatttttaaagtaaaattttatttctcccagtatttcacttgattaaattgctttaacttttatttagtttctagaaaatgcattatttaatgatttttaatttcccgaacaaaaatcggggcgttacaccgccccagtgcgttgccgtccgccgcccgccgaccgttcacgcgcgctgtcgtcacccgccgcccggtccgctgacaccagtcgaccgggcgccttcaacttcaccggcacaatcggtccgtcaagcgcgtgcccaagttgggcattcttgacgtacccaccttcacat

SEQ ID NO: 11608 - DNA, 372 bp, Oryza sativa
attaattcttaaaattttttggggatccccccattacatggccctagaggtctatttatagccttagcacaagcttgcaccttctagggtttagggttacaaaggattttacatggttgcccttatgaaagggacatttacatgggtacgcagtgtcatttgcacatatgggtctttaatgggctgataggctgggcctggtctatggcgaacgggcctaaaaggccgggggcggcctgttgggccttcttgatgccgaactcgtcatggcgaagtctttgtagttcgcccgagatgcctttactttcggagtaccgacgcggcttttcagccttcgccatcttcgcttatggctttcgccatagggcttcg

SEQ ID NO: 11609 - DNA, 10578 bp, Oryza sativa
  unsure (1)..(10578): unsure at all n locations
attggaggatgaagttgcaaaccttttaggcacctccgatttgtatgtaatcaccaaaataaattcaatagaaattttggcatgacctcccctcttttttgaagaaattttgaagcttgctcgggcagctggaggaggaaaaagacatatatataggggtgggactttagtcccggttggtagcaccaaccagggctaaagatcaccgagatctttagtcccggttggtgttaccaaccgggactaaagatcccgggggggcctgataggccctgacagcattcgaaccgggactaaagatcggttggtaacacaaaccgggactaaagatcaaatatgtccgttacccttttgaaccgggactaaagatcatctttagccccggtttttattgcatccgggactattgtggaaatcggccgaccgacgaaagatggtttctccaccagtcctatgatatcatataagtataggtgtattacaaaaccaacactaataatataattacaagattttctaataatcgatacttttatacaagaaaagtgctggtttttctaataaatcagcacatttgctgagccgtaccagcatgcagttgagcgtggagtgggagattgaggacaaaaatccttcaagtatcgtaattctcattgctctcggccttataatctcacatctcatcatctctcatctcccaacccgatcccggccggccgtctctcccagcaaggcaagggtgcgttcgcctcctcttcccccagccggcgagcggcaggactgcctcctttattcaccctgttcactccgtttctcctcatccactacatctcccttatgcaactctccctcttccctcctcttcgcaccactcaagctgacactaggccacgggcaatggccactttctccctagtgtgacggtcactggatccgtccacatagcgcatagtgaccacgagatccagccaactagagcctggcctggagctcaacctccctctcctctcgatatagttgtagtcacgatgatgcatcgagtcagatttttctgattcgtgacctaaaaggtgccagtttatgaaccgtgtcatcgatgattcttcccatcaggctggaatggggtggcttggtaatccggcacctatacgaggtttcgaattgacactcattgggtgttctgtactagtatattttgttaattagcgctatatttctgattacgatttggtctaaacaattaactattgctaatgtgaggtatatatctgactgtgtaggggatttaaatacaagaaacanacacatcagaatggggtggtaggaagtcattaggaacacaaaaaccaaattatttttttgaaataaatataacacaaatagaactaacctgataaaattgagtctaacgaacgttgtaattaagtccggtttaaccggacgtataccatgtctgctggtgtgcctctgttctgaccgctgatagatctttggtctaattggaaaaaatggacaaacataactctttacaagatgatcaacaatattgcatcaaggtgagttcataatacctctaaaccgcctctccaccttgatgtattataaacagatattgagacaaattcttttattaaatggcacatcacggaccttgcacgtaattatactcaatatatatttgtccataaatataaagtattttaggttatttaataaaattttaaggtgaagggtgaaattattctgttgtctcaaaaataagttgattggaaattaaagaacagtctagcgatgtactgctccctccgtcctataatataagggattttatgtccaaatttattatattaggatgtgtcacatccatccaaaatcccttatattataggacggagggaatactaactactactctctccgtcccaaaataaacgcagtcatgaatttccgtgcacaactttaatattccatcttatttaaatttttttaaaaaataaaaacataactattcatgttttataatctaataataataatatgctaattatagaaaaattttaaataagacgggctacgtttattttagacgcatggagtacagggaacgcaacaaataatgtcgttgaatgcatggatgagatcagatcgatcacgtgcaggtacatgcatacagtatgtatttcacgtgggtatacgcatgtgtcagaaaactattgcatcgaaccaaacgcttagttatatacgccctcggaatttgatgcagcgaattatccaccctgtacatttgttcacgaatgctggtgcgaattgaatgcatgtgtatcacaattaattcacagacctgcgggtctctcttgtactacatccgtactaaaatatagtaatttttagctatatatctaaatttatagttaaaaatatttacgtttgagacggaggaagtagtcttaaaaaaaattagtgatcggccgttgcacacttgtacagctgactacagtggctgtccgccatgcttgtacccaatatttttatgtttataacaaatttttgtattgttcttttcaggccggtactacaactaccaaaaaggtcaaccgtatggtgctggtgcaaacaatgtggagatttttacccgtgtgccattaaaaaacatgatgcctgcctctgtgccactaaaaagttcgagcctctctctatgccatcggcaaactttatcgcgccctccacaccattcagtcctttttagtcctaacggtgtcaaacagcgcaaccaaatgactttgttgcccttagacttgagagcccatttggtgaagtttgttttcttctgtgccattcggagggcagccattcgggctcaggggcgcggccggtgcagcggcgaggctaggtgcggccgtcgcggtgaaggagcagatcgcgcggccgtcatggtgaaggagcgcattgcacgggccttgcggctgtacaagaagncgcggcgcggtgncgncaacggtggcgggtgaatggtccaggtgtgggcgccggtgagggacggcgcccggcgcgtgctcgccacgcgggggcagccgttcgtcctggcgtcgcagtgccaccgcctgttccagtacaggaccgtctccctcacgcgcgtcttccccgtcggtggcgccgccgccgccgacaagcaggggcttcccgccagggcgttcgacacggggacgccggagtggacgcccaacgtgcagtgctacggcagcggcgagtacgcccgcattagctacgcgctcatctacgacatccagggcagcctcttcctccctatccttgaccccgacgacgcgagctcccccctcgccgtgcatgagctcgtcagcaccgtgctgcggctccgcggctccggagaggtcgccaacctctgcaacactcttgaggcaatctctctctcgctctctcgatctatctgcaactaagatcaagaaataattagctacagcaattagcaggagtgattagattagtgaactgattaacatttcttgtgttcactgagaggtgcagggattactcgccgtgaaccagatagtgaatccagatgagacccgggcggccatggccgaggtatcgtagctcctaaccatggtgtgtgtctgtgtgaagctcacaagctgccattggcacgcaaacatgggtgagatgcaggagcggcggaaacgacacggagaaggccgcgctgacgaccgccggcgcaccgttccacctcgccgccgccgccgccgggcaaaggaggtggtcgggcgccagttggaggggtggccggtggcgctgtccgctcggctcggcggagacggcggtgacgaggaaaggggagggcggcgtggcggcgcgggcgtccagcaactcggccacgctcggctgggtgttggctgggagtgacgcggacacggatgccgcggagataggggaatcgagagagaagagagagtgaaagggcaagagcgacatttttcctgctcgagcccacatgccagagctactaaacagttaaaaccaaacagaatagtgacggaatggtgtgaagggcgcgataaagttcgacgatggcataaagggaggttcgaactttttagtggcacagaggcaggcaccatcttttttaatggcacacagggaaaaacctcaacaatgtgtgtatgcgatgtttggatgcgccatactttaccacaattaaaataaaggcagttgtgatcggtacaaaagtgcggtgttgttaatgtaaattatatcgtgacacatgaagacacgagagatctacttagtttcagtgtagatcctatcaattgggattagagcgtgctagacagttagtttgatactacaactgacaagatagataaattgatgataaaaaaaccgaccgaccaataagccgatgtagtgatactagtcgatgttgatagggttttgaacaaacggctatatatccaatatagattctgacactttgataaagacaatggaagcacttgaacaaacaattcaatcggccgatgataatatgatgaagtagatgtcttatgaaccaatcgaccgatattgatatataatattaaatgtaagctctatggttaaagcataaatcagttggaagtccgatgtaaaaataagttatcggttaatactccgataaaacgcagcacaaataatatataaacttagcaagacttagattgttagtagtgacctaaccgcgagacagttctaaattgcgtctgatcaaacaatcttggtaagttgatagatcatctatgctaacgtgatagatataacaaatctatttaaaacaaatcgactaaggctgaagatcggacctaatcgagacaatcctaactaaaccggtatgtctctaaacaacacagtgcaattaaatatgtaattgaaacatcacgtagacaaatataccaatcaaaccagattaatctaagaaattgaagtgatgtagccttgaacaacactaaaatagcttatacaattgctagggccaaccgaacttagggcttacgccttcatgggagatcgaagcaatgcagccccgcgtcaggtgccagtttcgtcggtgataaaacctcaaaaaagagggcggcaatgttctataaatcttattgatcgagagataatttataataaccacgagtgtatgtaattatagccataggtagacactagtactctctccgtccctaaatatttgacgccgttgattttttaaacatgtttgaccgttcgtcttttttaaaaaaattaaagtaattattaattcttttcttatcatttgattcattaaatatacttttatgtatacatatagttttacatatttcacaaaagtttttaataagacgaacggtcaaacttgtttagaaaaatcaatagcgtcaaatatttagggacggagggagtccttcttagacacaacacaaacattcctaaagataaagtaaaagacacgagccttgatcggactctaaacaatctctcctaaaaataaaaagaaaactaacagacgttgccaaattaatagataaattaccatgcctcgtccttcttaaactcgacctcttctggataaacttcctttaattaattaattttcttaactgaatacactaataattcgattgctggcagatgatatttttcataggtcaattttagaactctgtggtcgatactgtctaggtcgataacgacttcgggtttaccaaattttaacgttaacatgtgcacaatagaaaagttagaaaacaattgcctctatgggcatgtacagtagagtcgctgcagcatggtcatgttttctcttgtaaactggtactgtgctgtagcagcaatatctgccgaataaaccttacaataacatgctttctagatttattaacattaatataaatatgaaaaatactaaaatgacttatatgtgaaacagagggagtaataaattacggccgtgtaccaaatttaatttgttggagcattaatttgtttacgtaggattaggaagtactagctatagataaaaaaaaccctgaattattggagcatctccgattttccatgcatgaatgcatgacgacattcttgcttgtcctctagctaaaaataattttagttcccaccctaaaatttttcatcctatcacatcgaacatttgaacatctacatgaagtattaaatatagactaaaaaaactaattgtataaattgcgactaatttgcgagacgaatcttttaagcctaattgctccatgatttgacaatgtcgtgctacagcaaatattaattaggcttaataaattcgtctcgcggtttaccaacggattctgtaattagttttcttataaatgcccgaacactccatgcgacaccctatgtaataaccgatgtgacacgtcaaaactttacacccctgaatctaaacagcccctaattctatcatcaccagtgtattcccttcatcaaactatttataataaattattaaattaaacaatcgtgatccacgtgctgacaagtaggtcgcaccaaccacccagttatcctcttcttcaccgctataaaaccccatggcctcctcacacttccccccgcagcttgtttagcttaattagcagtagcacaaagcagcaatataatggcgacggcggcgaggctgctcctcctcctcttcctcacggcggcagccagcgcgtgggagatgaacatccggttgccgacggagatgctgaacggcggcgaggccgtggtggcgccgatcatccacgcgctgcggccgctgctgggctccggcgggcagctggcggcgcgcgccggcgtggcgtgcgacagctggaggctaggcgtggaggcacacaacgtgatcgggtggaagacggtgccggccaggtgcgagggctacgtcggccactacatgctcgggtggccactaccgccgtgactccgccgtcgtcatcgacgaggccatcgcctacgccgagagcctccagctctccggcaacggcaaggagatctgggtgttcgacatcgacgagacctccctctccaacctcccctactacgccaagcacggattcgggtacgtatactatacgtacacgtacacgtacacaccactttccttgcagtattacctatacatatatatcttgtattatacgtgtattgctgcaggtatatacgcctcatttcagttgggacttacaccgcgcgctgacttggttatacatttatctactggcaacttgctggcaagataatactactatatatgaaaaaaatatctaaaaatctagctgatgtgacataattaattaagtgtcaaaattatgatgaactatttaatgtgcatacaaatatacagtatgtgaacgtattattaaattgagaccggcctgcctagttcacaaattaatataggaaatactggggtattacaaaatgtgaagtcaaagatgaaaagtatatatcatccaattaatgaatataacacagtaaaacattctcaaaatagtaaaaaatagcaaggagatgcgcatctatatatgcttagcaagattccaccggacattccaagacctcgcaaagaactagataactttaagcattatattgattaagaggataaaaagaacactatgcacttgtccatgtggctatttttaggcaaaccactgaaacctttattagattcttcaatcaataatttattactagcctgtaggaagtcagaaccctaaaaaaacagattggaccagcagatcaggtaatgagtgatgcaaacatgcacaggctggcagacagtacattttgtcgggcttatattgtccagcagtcatataagtcagatccaaaattcgttctttcaaaaaaaagatccaaaatttaatcgttatacaaattatgggtggatttatggaccactgcatgatgagggcgttagttagatctttcactaattgttaattttttcaaatatgcacaaaagttggaactttattttgaattcctgtaagttctaaattaatgaagagtttcattaatgattttttactaacacccggcagagctacactgtacaatgatacgagcttccgcgaatacgtggcggaagggagcgcgccggcgctgccggagacgaggcggttgtaccggcggctgctccagctcggcgtcaagccggtgttcctgacgggccgcaccgaggaccaaaggaacatcaccgtcacaaacctccgccggcagggatactccgggtggatggagttgttgctcaagccagcagtgcacgccgccggcgagctccaggggtccgccgttgcatacaagtccggcgagcggcaaaagctggaggatgccggtttcaccatcctcggtaacattggtgaccaatggagtgacatcctcggtacaccggagggcgcccgcaccttcaagctgccggaccccatgtactacatcggctaggttgctgagtaacaagtccaatgaggcccagactccgtgtcacgtgcgtttcatctttgttttgtcttgaaatgcttctaagttacaataattttcgacgcgcgtctatctgtacttttccttgtgagattgatgagatttgtaatagcatgtacgtgtaagagcggtaaatctatctagctatgtactattgagcaagcttgtcgcgtgcgtatctttgtctaataattaagaaaaattgcaagatatctcaccaaatatcatccttagtttaagattttcctatatatataaaacgatttattccgaatacctgtcctttttcctacttatttaccttagattgaccccggcccattagatgtagttcacgccctatttttttttctttcttttgcaagtgttatatgacttagcacatctcttgatagacatgaccccaaacattcttttcaaaacaacagtcgcattgaactcatctttctcattttgaatttgtcgaaaaaccagctgccacggaagagtactcgtgactaccgtcgcccaatggcatactggccaccctaagtggggatgctacgatcgtgtaataagcctagcaaatatgggtgacgatcatggttcatcgtctatgagtatttatacgggcacatgataatatatatgaaagggaacgggcagatcgaggagtatacattatctaaaaatacagctgatgtgataattaattaattattgccaaagctagctaggatgaacgtgcatacaatatacaatatatgtgaacgtataattaaaatgaaaccggcaggcccagtgcatatatagaaataatacaagaagtactctgatattgcaaaatgtggagtctaacttgaaaaggtcgtccaattaatgaatattattaagaacgagataattccaggacctcacgaagaacgagataattaactttaaatatattgataaaacatactccattcttaaaaaaaaataacctagatggtaatatgatccatcctattacaataaatgtgaactaatctctcatatcttcacttaatttaggttaagtttttttttttgagggggatcacaaatgcatggtgtatgaggaaggaaaagatcataggttcattcatattatcgatcgagagcacgtgcagtacatttttagaaagatcactgctccctccgtcccattttaagtgcagtcataatgttccgtgtctaatttggatcgttcgtcttattaaaaaaaatttaaaaacataagtcaagcacgaagtactatttatgttttatcatcccataacaataaaaatgctaattataaaaaaaaattaaataagatggacgattaaagttagacacagaaacttatgattgcacttaaaatgggacggagggagtaataatcaagatttaattataagtggcctgtcagatgtcagacctaccttttaaaataccttttaaagaaaaaacgcattgcaccacatcaggcaataagtgatgcaaacatttcacatgctcgcagatggtacattttgtaggctagatgttgtccagctgtcatatgtagcaagtcatatccaaaatttaataatcgtggtcttgagaaaaaaaaacagaagaaacagagtcttttacaaagaaacagagcatatactaacaaccgatagaaaacaaatggaaaaagtatactttgactccctgaactatcgctcaagtatgattcatatcctccaaccataaaaccgggtatatcgactcctttaactattaaaactggtgcaaacaatatccctaggtggttttgactgatgtggcgcctacgtggcggttttgactgagtctttgtcctatacgtggacttgcatggcattagaataaaaaaaatatgtagaacccatatgtcattcacacaaaaaaaaaagtattgtgggacccactaacatatgggacccacatgtcatcctccctctcctttccttcttcctccccttctttctcccttatcccactctctccccctggcctttctcttcaccagagtggcggcggctgcggtgg

SEQ ID NO: 11610 - DNA, 5095 bp, Oryza sativa
  unsure (1)..(5095): unsure at all n locations
ccgcgacagcggcatcgtcactcgagttaggatctggctccgcgacagggagcaccacggtgttcgccgtcgccgactcgatgggcatctcggccaccatctacatctcggccgcctcgtccccaccgccaccgccaccgccgccgtcactccccgccgccatcgtccccatgtcagtcgcggataagagagagataagggagagagagggggaggaagaaggggaggagagggaggatgacatgtgggtcccacattactttttttttattctagcgccacgtaagtgccacgttggacaaagactcggtcaagaccgccacgtaggcgtcacgtcagccaaaaccacctctaaaaccacctagggacattgtttgcaccggttttgatagttggaggagtcgatacccggttttgtggttggaggagatgaatcatactcaggcgatagttgagggagtcaaaatactttttccaaaacaaatactgggggaattccaatactaggatcgacaacttaattatcaaaagaggtccccaaaattcatatgagttagcaacttatagataccctaagccaaagcaaaacaaatcgtcagataattacagctgaatctatccctttttctcttttcttttacagcggcatgtattattttcatatgcagttgcctccttgtatggcagagcgaaacgggcgattcgcagtgctctggtcaaagcgctattgtggttgtgtgcgcgcttgctctcgtgttaatgcatttaagcgaccatgcccggtttgcccgtatataaggggcaagtagatgttcatatttttacataaagactactgatactctagaaaattgcgaagaaatcctcctatcaccaatacctcgttgtgcttttttatggtaaaacattttgaccttgagtgaaatataatgcgaagaaacggaagttccgtttctaattatatcgcactaaatcttaaaagtatcaggacattctcataaaaatacatcaaaatccaacatcaatcctatcccacctcttgtttagcgcctaccgtacccatccctacacccaacacctccctgccttcctcccatacaccatccgcctatgcctcccctagctgaccagccattgttgctctctcaaccccttaagctcacgccctcctcgtcctggcatccatgctgccttttccccttcttgatccagccatggctattctaaggggaggagtctagcggtggacttgctgacaagggagacgatgggtgtaagcattaccgctgagccaccctcaccccacgctggcgcgggattatcctacaccggtgctcccagatcctcgcctcccgccacccactcttcctcggtcacgcctcctaccaccgtccccgcctcctgcaaatcgaggaaggtggacggtagacctcagcaaggaggcgtggaggtggacgtcagcgtcgcggaggacctcgtggccctcgagtcggcatggggacaatgtggagtttgtcggtgatgacgagcaaggccatcggaggggagcaggaacagtggatgcaccatgcgtgggctctggcgccgccactcgtcctccctccagcaccttcgtctcctcttctcctcttccactttctagcggaggcaactgctttggatggcgtggctagagacgataacaatacctcagacctcaatggggcggctcacaaggacgagcttgaaggcaacatccttttctccaccgctatcctcctctagctcgacatgaggcgctctcctctatccctcccatccgctggcgagccgcacccttcaccgttgtgtgaccatgtacttctttcctatcattgggtggggtgagaacctcagtggtagtgcgcgggaattggggagcaactcggcggcctgtttccatcaagctcagcggcgagtgtggcgactgcaaacccttttgacctccccactcctcagcggcgacaacaacgacgacccagtgcagctggagctgctggccaaggcggctttcgtgggtgcggctgtgtgctgggccatttggttaactcgcggaattattggctctttaaaaatgttttgaataaatcctaggtggtgtacagtatagtgctttctccttgatgcaaaggtgcaaagggttatttctattttgaagaaccttaccttatcttcgttgatataaaagttagtcgatatagcggaacgacgactaaccttcctgatcgcttcagtcattgatcacccaagacatgccagatgacgacacaagaacacacaatatttgttaacgaggttcagccgaagcctacatcctcggggctctgattatgggcgctcctccccaaccaatatagctcctagccgctacgagtccatggcctcaccgccatcctctccctacgtgtctacactgcattgtagtcgccatggttacattgtgggtgcccccttctctatttaagagagttgccgggttacagagtttgactctaattccacccctaacacctatatcacaattccaagtcgaactgtaaccaaatagaactagtatatttgacgtctattctaacaaactccacctagaagtagtagaatcaccatgccgacccacctgtcttctagacttgagttgtttccttttcgtagcttcatcacaagccacccgacaagtctgcaccagactcactgccatcaagagactccgctatccctgcaacttcttcctctggacttcacctataacagtgctccaccttctctcttatcatcacagtcgtcttaccaagcgaaattgaactcctccttagctttcttatcatagactccttgaagaccatgttcacctcatcttccatctttgattttatttaatctaatccatggtttataacccgcgtcatcaccaaatagataaatcaaactcactagactaatgaagaaaccatttcttcattgtagtcttatgaaccgagctaataaatccaacatccacgcttttcgcatcctttgactgcgctccatgataacctaagaaaattcaccgtacgcctgaatcacttgaagaattatcatgacagccttcgctcttcctcttcagtgacgcagatttcatatatccccatcatgcaaacccgcaaatcctagatatatcctgtattgccaaacaacctgtttatgtcctcaacgattttcacccactgtttcccgagacttttcttcagttatggactaactccatatatcccaacctcttgtcaagtcccagatatatcatgttcctgccagataattctatatgcgacctaactagcctgcactccaacattcgcatatatatctagtaatttttcttatgggtttggatgtagccgaactgtcttggagaactgcaacaccctagtgtaccatgtgtgatgcggttgttttcctctttcttttttttaaattccttcacagcagggggtttccctagcatgcacatatcaaaccatgttatattgggcgtatgaacaagtacgcgctcgaacttaaggatggatgtgacgagatcgatggaccctatccaaacaaaccagatatgcatgaacatatgggaaacatgaggggatcaggtggcccagcatgctatagctagaagtcacatgtttactgtagcgtcacatagcctcacatatttactatagcatcacataggctagtcatggattaattaggctcaatagattcgtctcccgaattagtccagggttatggaatgggttttgtcaatagtctacgtttaatacttctaattagtgtccaaacattcaatgtggcagggactaaaaagttttagtccaccttgcctatcgtgtaaaacgtatatctgccgatgccgtacccttgccatgaggtcacaaggctacttgggccagttgccagcctatttaatgttttttcctcgatcgtttcaccgaacggtagatctttttccttcaaccattcaggaaatttgtgcttctgttccttcgagacccaagatgccggtcttcttgggttgcaagctctgatctcgttcatgtgttcctcaatgtacggctcgaggatggcgcgctgttgcagcatgctgctatgtgcttccgctacaactttataggcctcatcatagaaccatttcttgcttacggtccccttcccagctaaccggccctcgtgtacaggagggggcataccaatgagtgtggcgtccttcatataatctatacagcattcaaccacctcctcagttatgtacccgtctatcattgatccccccagatgagcttggttacagacataccatttcagaactgacatgtacctctcatacgcccacatatgatgtagatataggggaccaatttcgataatctgagggacgatgtggacaatcagatgctctatcatattgaagtaagatggagggaaaaacatctcaagctggcaagctgtctcgattgcgaatttatgaagggggcctaactcttcaggatcaaaaaccttatgtgatactcgattgaaaaaatagcacaactttgttatcaccaacttagtgtgaactggcttgaccgctcttatagcaataggtaggaagacagttaacatcttgtgacagtcgtgagcattgtacccagagatggtcaaatctttcatagatacaagttttctaatgttcgatgagaaaccagtcgagactttcaaactacgcaagcatgtacagaaagcttttttctcttttggtgtcagtgagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11611 - DNA, 4089 bp, Oryza sativa
tattttattggaaattagacttaatatgacattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggctgtgcgggataacgtgcctgtcagtacggtgtactggcgaagaacaagggcacgcggagatcataagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccagcaacagccaattggccggaacgatcgaagttctggtactatgctcacggtggaacgctcaacccagctgatggctcactagtcttcggcgatcagatacgagaggctgcgcgacgactaacagatgcagtggaagcctcctctcagggcacgttccgaccagacagagatagggacgagctgacactcgccctgcaaactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccctagccgaccattcctcctgcaatggtgagcccgtcaggaaaccgtagcagctgcgcctcaacggggcaggtaggatcacagagcatggacgccatgcaaacacaggacgaatcgacctgtcccattgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcttgcaccgtctcctcctcatgctccggcagcaccgtctccacctcaagctccagcatcgactcctcctcaggatcctgcaccaactcctcctcgtgctcctacacctactcccccacaagctcctcttccggcaccttcaaagtcaggggccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcttatagaccccagtgtcaggaacttctttaggggtatgcctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcagtaaaccgcttgtcaagcctgagctgctgcagtccctacccacacaaatgtacaagttccatcagctgtacatggagatgagcaccaccggtagagagatgatcggagcgacgatcagggacacggacttcttgcaaggagatgacattctctggatcaatttcaggggaatctacgaactataccagctggacgccctgacgtctctattatgagttgctggattttgtaagtatatcgttcagttagatttcttactatacgtctcctttaattaattaggtccttctatataagtagactatagaaaataatatactcccttttatcgttgtagaatggagattcaaagggcccgacggcgaagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactctcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcgacaaatggagagaaagacttaggcggaagttcaaatttcctgtgagtacacatcctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagtgagtactactacgtcgaaatcgta

SEQ ID NO: 11612 - DNA, 9430 bp, Oryza sativa
  unsure (1)..(9430): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctggttatgtttaattttatcactagatcacctcacattgttcatgccatgattattgtcttaatattttagattaaaatatgccgatatatgactatatttccaacaatccaaaaacttgataggtcattttcggtagttagctttgctactgcactgaaaccacatgcttttgatggttctaattataagagatggaaagcaagtgcactactgtggttgacagcgatgtaatgtttctatgtttcacggggtaaacgaagtgaaccacctgtctctcctgaggagaaggttaagttcgaggctttggattgcctgttccgtggagcattgatcagtgtactcgctgacaatatagtggacgtgtatatgcacataccttcaaggaaggacatgtggaatgcacttgaggccaagttcggagtttccgacgccggcagcgagctgtatgtcatggagcagttctatgactacaagatggtcgatgaccgttctgtagtggaacaagctcatgagattcagatgctggctaaggagcttgagaacaacaagtgtgagttgccggacaagtttggggcgggtggcattattgccaaattgccaccttcttggtcagactttgccacttctctaaggcacaagagacaagagttccgtgtttctgatctcattggctctttgggtgttgaggagaaggcgagggcaaaggacaaccggggcaaaaaggttgagggaggttctagtgccaatatggtacagaagaagaacactcatgcatcccacaatagcaagaaagtcaagtctgatgtcaaacctaaggctagaaccaattttaagaagaaaggcaagggaaaggcaaagggagactgctttgtgtgtggcaagtctgggcattgggccgaggactgtcctgagcgcaaagacaggaagtctgccaacatggtcattagtgagggcggaggaacatcggggtacggtaaaattttacctacagttctctctgtttttcattcacctgattggtggattgatactggtgctaatattcatgtatgtgctgatatttccctgttttcttcttatcaggtcgggagaggttcctccttgttgatgggaaacgggtcacttgctaatattcatgtatgggttgttcatggtgttggtacggtcgatctgaagtttacttcgggaaagaccgtgcagctgaagaacgtgcagcatgtcccttcaataaagaagaatctagttagcggctctctactgtgtagagaaggttttagacttgtgtttgaatccaataaatgtgtcgtatctaaatatggaacttttattggaaaaggttatgacagcggaggcttgttccacttttctttggatgacatgcgtaataataataatgttgtgaaccatattagcgagaatgatgagtccaatgtgtggcattcgcgaccctgtcatgtgaattttggttgtatgacacgcttggctaacatgagtttaattccaaaattcactttggtcaaaggttccaagtgccatacttgtgttcaatcgaaacaacctcgcaagcctcacaaggcatctgaggcgagagatttggcacctctagaacttcttcattccaatctgtgcgaaatgaatggcgtgttgactaaagggggaaagaaatatttcatgacactgatagatgattgcactagattttgttatgtgtatctattgaaaacaaaggatgaagcattgcattattttaagacatataaagctaaggtagaaaaccaacttgaaaggaaaatcaaacggttgaggtctgatagaggtggagagtatttttccaatgagtttacatctttttgcgaagagtttggaattattcatgagaggacacctccctattcaccccaatcaaatggggtaaccgaaagaaagaaccgtactctaactgaaatggtgaatgccatgttagacactgcgagactttcccaggaatggtggggtgaggcagttttgactgcttgtcatgtcctaaataaaatcccaatgaagcataaggaagtaacaccattcgaggaatgggaaagaaagagattaaatctctcatacctacgaacatggggctgtttggccaaggtaaatgtacctatagccaaaaagcgtaaacttggaccgaatactgttgattgtgtgttccttggttatgctattcacagcgtgggttatagattcttagtagtaaactctgaagtacccgacatgcgagttggtacaattattgagtccagagatgctacattctttgagaatgaatttcccatgaaaaatacacctagcacttctaatcatgaaactgtcataccccataagcactttgcaccgatagaacacaatgatcaaacgcctgagggaaatcctgaggaggataatattgtagatactcgtaagagtaagagacaaagggttgcaaaatcctttggagatgactacattgtatacctcgtggatgacactccaagaaccatagaaaaggcatattcatctcctgacgctgactactggaaggaagcagtacgcagtgagatggactcaattatgtctattggtacttgggaagtcgttgagcgtccatatgggtgcaagcctgtaggatgcaaatgagttttctagaaaaagcttagacctgatggtacaattgaaaagtacaagacaaggcttgtggccagggttatacccaaaaagaaggcgaggatttttttcgacacctacttaccagttgcccgtttgatcacgattcgagtactacttgttcgagcagcctctcatggtcttctcgtccatcagatggacgttaagacagctttcctaaacggtgagctggaggaggagatctatatggatcaacaagacaggtatgtactagaaggtcaggtgggaatggtgtgtaaactgttgaaatccttgtatggccttaagcaagcacctaagcaatggcatgagaagtttgacaccacacttacatctactggctttgttgtgaacgaagctgacaaatgtgtgtactatcgctatggtgggggagaaggagtgatcttgtgtttatatgtcgatgacatattgatctttgggatcagcctcaatgtgattgaggaggtcaaggactttctgtccaagagctttgaaatgaaggatttgggagatgctgatgttattcttaacattaagctactgagaggagatgagggtgggattgcacaatcccactatgtggacaaagttttaagtcgctttggctatagtgactacaagccagctcctactccttatgatcccagcatgctattaaggaaaaaccgaagaatagcaagggatcaactgagatactcctaaatcattggttcattgatgtacttggctagtgcaacgaggcctgacatctcatttgctgtaagcaagctgagctggtttgtctcaaatccgggagatgatcattggtaggctctggaaagagtaatgcgctatctaaagggcactatgagctttggaattcactatactgggtacccaaaagtactggaagggtatagtgactcaaactggatatctgatgctaatgagataaaggccacaagtggatatgtgttcacacttggaggtggtgctgtttcctagaagtcttgcaagcagaccatcttaacgaggtcaacaatggaagcagaacttacagcactagatactgcgacagttgaggccgagtggcttcgtgaactcctgatggatttgccgatggttgaaaaaaccagtgccagccatcctaatgaactgtgataatcaaacagtgattattaaagtgaacagttcaaaggacaacatgaagtcatctaggtatataaaaaaagactgaaatctatcagaaagcagaaaaactccggagtgatagcattggactatgtccaaacggctaaaaatctggcagatcagtttaccaaggggctaccacgtaatgtgatagacagtgcatcgaggaaaatgggcttgatacccacctaaggttgcacaaaagtggaaacctgtccattttgatcggagatcccgtgaatttggatggcgaaacaatagtctattgtgtggctgagagaagagacccttgaaaagggctcattttcatgatgtacttctcttctattctgcatggtaggatggcttatgccttaatgtggtccaagtggcttttctaagcagagatgttgacttgcagagcatctcagaaggaacacacttatatgagttcgactgctagtcatagtctatgagatttgagcgatctctagatactcatgaaagggcctggagtttgacttatatgctccaaatagaggggatgcaaacggcagcccagtaccagtcaagggtttgactgaaacctgatcacacaagactgacaatttaaggcatagtccattattcaattatggtctgatgtagctcttttcctaggtggaagttcaacttaacagtctccaccaaaacactggtctgtcaaacaggttcaattttgagaacatttcttatgagccatgaaatttggtggggattgttagaataaatgggctaggcccgtttttctattaaaatctcaagggcccataataaatgttaaggataacaataccatcctgagaattaaaagtggagtatctgaacttaaatagggagttattggaggctccctattgaccggttgaggtggggatcggaaagccacacgcgcgcgcgcgctgagccgagcccgtggccgtgggcgaggcgtgcgttgcgactgcgactctctctctctctcattttgcaacggaccggaatccaaccccgcgtgattgcctctgtaatgggcaggcgattcaatacgcattgattgcgccattactgcggcaacgggcggattcctctcctgtgctattaggaaactgagaaccacgatcagatcttcacgctactttcctaacgccggttcttcgtccttgcgcctgtgctgcttctgctttccccgattctgatcgcttgcgcgcacgagagatcggaacgagcagggcctccggaaccacaccttcgcctgagatctacaccgggtaggcgggtgatcaggttttggggagtgtttccgcacgactgctcctcttcctcggttcgtcgtcccttcatctgcatcaccatgactggagctgtcgcacccgcacctggaggtggcgcacccagagctggcgcaccgatcgacaacaccaatggaggcagttctacctcacaatccagcggagggactttcacagggtataactttctaccgtgatctttgtgtttgttgcttctgttggtcgcaatactattgcgttctctccatgatgatgatgcttattctatcttaaacatgctcctagttatgtttaattttatcactagatcgcctcacattgttcatgccatgattattgtcttaatattttagataaaaatatgccgatatatgactatatttccaacaacaacctgttgatcgacagcaatctactcttcataatcagggttgctgacgacgacctctgtttctccttctttcttcctgatcagggcggctagggcttttgcagctccggtgaggtgaccttctagctttgcacctcttatagccgctagaacctgcgccttccatatggcgtggttggattttcctaatttctctgagctgaattggccgaccaggggattcccggcatggttcttcgaggagctcgccatggtacgacagggagagagctagattggatcttgctctgataccatgtgaataaaatagatgggaagcgttgaacccctctcggggccgcacctttgttaatataggcgagaatagccctcgccgtggcacttacaatctcaccgatcggttccagatcagttccaacaaacccggataatcaggaacacaatcggcatacattggataggaacgatatcacaagtgccaactaatctattcatatctctagaaaccatatcatctaacagagacaaacaaagcaattgatagagaatgctaagtcatttattcctgaagatgacatacacgatatcaatgtagactcgatgttgttgtgcaagtttgtagtacgatgttcatgtacctaatgcaaacattgcatattaatgaaaaacggttctcagctattatggcaatgcaaaaggtgattctgaataattctgatcctccatatacattttgttaatgcagtatcttcttgacgacaacagataaattttcagcaaccacacacacaaaacaaaaatgtctccaaaaatcaattttcaaaaaacttcagaaacacatgcagtccttaaaattggccgacgcatatctggtgcactaaacgaatatacatgagccattcagcccggaactgccattgatacaaagaatctgaagcacacaaaaattgagccccaaaatctcatctttacacccaggtcgatcctgctctcctcttgatatgcttccaaacttcgttatcctcgctgtcagcagaaaaatccaagaaatacagtggagatgaacgggtccaaatttggggtacaaacagaaattgtttttttttttcacaaatttagggtaccaatgactagagtggatccttattctcttgtcaatgcagttatatctatcacatcagaagcacataaatacagaggattgttgataaacagaagcaagaggcaagtaatttgagatttagttcgaagattggttgggtagcatgtacagaaggtaaaaatgaagtatgtccatcttttgtcgcaagaacaccattcatttgaatgatgcaatcgctaagagctgaagacactgctgaatatctgctcggtgacatagtcagctcgctctgcttgcaaaattcaggttgaagaaaacagcacagtttggaaaaaatgcttaatgccatcagtcctaatcccattcacagactaatcacgattagtcaaagatttttctttgcttttacataagctctgaactgtacgaggcttcctgcaacaaaagaaaaaaaaaagctaaccactaacaacagagcacgtaaaccaagcagtttagaagaattaataatcaacaatgatggttggtcaaacaaacacacttaaattttgttcaacagatgtcatgcacagctgaactgtttgttgatccataaattagcttcttcctagtgttgaatcggtaaactgcatccattcattttattgaattgtgcttatgtactccctccgtattttagtgtatgacgccgttgacttttcgaccaatgtttgacaattcattttattcaaaatttttatgcaaatataaaaatatttatgtcatgtttaaagaacatttgatgatgaatcaagtcactcccctttcatccctagaacacaggtcactcccctttcctgaccgggcagagcaaggcgacgaggcgtccgtgtgcggcaagctaaggacgtcaatcccctcccctcttcacaccgtgggtcgctccccttcccctccgctttccccacaggcggcgcagctccccctcccctcccccaccagcgcccatcgcatgccgcctccctccgactccgcatcatgcgatgcgcctcctccgctctgcgtagtgcgccataagagagtacgtatcaactaagtatggatcggaaaacgagcgacacaagaaatcgcggacgcacgcggacgtgactgcatggctgcctagtgagagactgctggccacgatacgcgagtaagtccgacacggcgtctacaattattcagaattattcagaattattcaaaatgtatatggaggatcagaattattcagaatcaccttttgcattgccttaatagctgggaaccgtttttcattaatatgcaatgtttgcatgaacatcgtactagaaacttgcacaataacatcgagtgtatattgctattgtatttcatcttcaggaaataagtggtctgacaataacaacctagcattctctatccattgctttgtttgtctcatcttgacttaccactgtatacgtatcttggcttgatcactgacaaaaatgagaaagaagcatagtatatttcttagtgcaaagatctaaagcatgacgattatatatggggataacagaaactgaaagtgaacctcccttacttcataaatacatggattacatttgcaaagcccaaaccttggcaacagatggatgcaaattaatcctgcaaactatatctatatttcttgatggcactctgctgcgaatcagaaaatctccgattctcatgtgtcataatcccactaaagatgggggctccatttttgtctcagggcagaagatggtttgtctatttcaacagccctgtggtcattaagagatttgttccggtccaataaaaagtatctcgatgtatcgataccttaaggtaccaaatcgttttatcattggatctagctgaataggttacgataccaaatcgttttggatctaacattgcacattgttagatccaatgatcgtaaacgatttcgtaccgtaaggtaccggtgcctccatatacttttggttggaccggaacaaatctcggtcattaagctttgcttcaagctccatgctgaaggtaactttggttggaagagttagttttctcggaaaacttgatactatttggcttccattccacgtttcttaacaaaagaaacttgcgattggaaatttagttacaactagaaaggtagcccgcgcacatgcgcgggcaccttctcgtataatgtaagtgaaattttattatgaatatttatgtgtgggtggctttttattaaaatatcttgtattatgttctaaactaaaattaaacttattttgtgtgctttgaaacctggttatatttttataattacccttccaccatataaattctaaaataaattacttgagctcatg

SEQ ID NO: 11613 - DNA, 2094 bp, Oryza sativa
catccaggagtatctgtcttgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactgggggggcatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgcatgtctttttctgcttatcgaaacaccttgcagtgtgtttgttcgccttactttcttgcaccttcatcttactgtcaaccttggtggaccaacgctgccctaactggactcgtttcaaagcttcatcatgtctgttcacaaagtagtcattacacttcatgaacgtaaatgatacgatggccgtcactggaagcttacgaacaccaactagcacgctattgaactgttcagccatgttggttgtcatgtaaccccaccggcggtcatttctatcgtatgcacgagaccacttatctttatccaacaactcatcttcaagccatttacgaggaccttcgggaatacgctgccttagtgcctcaacatccctctcaaatatccacttctcgtcaatctgaccattaatatcttttttaagggggaagagctcttttgtctgatgcttgtccgcaccggccttgtggaaattagcactgaagtgcctcatgtaccaccggtggtgaaccgatggcaatcctggaacaggagtcatcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcacccccgtatttcccagttaggaaggttgcatctatagctagtactggcctacaatgtttaaaagcctcaatggaaggaccaaagcaccagaatgcacgcataaaaattttcttggtcactccatcaacgttgacaaccctatcaggatgagtatcgatatggtagaccatactgggattcctctgcttaatggcttgcagcaaagtgggcaaacggacatacgcttcaccccattcaccgtaaatgagcttcatagcctcctctcgtgccctccaagcctt

SEQ ID NO: 11614 - DNA, 758 bp, Oryza sativa
ttgacttctattaagacagaattgtgaccacccctcaattcgacataaaagtaatcatctggattcacatattggcctgctacttctgtcgggaatcaagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttcaccctccaagtcttctcgtaccaactcactcttacttgcaccccctccacgacgagaataatatgtcacaaaattcttctcaacgtaatgataagaatgagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatagtcttcaatgacatatcctcaaactcaacatgtccaccaacataaggttccaccactctaccaccatagtaaacacgaacaagtctatccatctacaccaaaaaatcaaatgt

SEQ ID NO: 11615 - DNA, 467 bp, Oryza sativa
aagctctgccacacagtactattgctggaatccttgattacaagattgccggtgtcaagaagggtaactgtagtatgcttgcctgaagatgtcttgctttcccacaccgtcgtgccgttggtatctgtgaggactaggttgccatcatggcccagcgacaccctggagccgtaaaggttcactggggagtatcccccattcgccggagagtagggattcgccgtccacacggcagttttctcggtggtgtgggtgtaccagatcgagaaggtgaaagcatttgtgccaagctgatggaagccgcaagagaaggtggtatcaggtgagaggaggaagatcttgtcatggtcctcagctctgatgtgtgagccggtcgtcatggttcgccatggggaagcacaagagcagaggtggaaggagagtgatgagaggatggttagatacagcagcgcagccattatctcctt

SEQ ID NO: 11616 - DNA, 1662 bp, Oryza sativa
aaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagttcaatcaagaggaatcaacaacagaacaactaatcaaacgtattatgaagggggttaagatgctgatacatagcaagaatattacttcaaccccgatttgtaacggtatttttatttgattaatcaccggaggggagagattcctcacctgaatctttcattgccaaagaaagatagttctgagttacagagattgggctataccagcggcaagccattacagattaaacagaaaaaggggaggagatataaagaatccaaaagagaggcccccaccttcccaaagagacaacaattgatgttaggcacctgcaaaaaacccaaccaaaaaccagagcaacctaaagctatcacctaagctcatcaacaaacattttcttatgcagacttggaaacgccagtactcctcactgaagggcctttctgccacaaggtcagcttggtttaacagcgaccaaaagactgtggaagtcaaaaaccacccgcatcagccatcaagaattcaacttaaacttgttgctgcttggatcagtgcttgctgacgcaatttgtgggaaggaagccccagaagagggagggccactgaaggttgcggccataggccgcccgtatcgagtcttcttcaatccgactataacaattgcttgcaagttccatgacctccaaggtcctttcagggaaggaagcctcaaaggaggaagggccgctgaacaatgtggttgaggacatgccaaggtaaagagaggagacgaacagggagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtctt

SEQ ID NO: 11617 - DNA, 15216 bp, Oryza sativa
tttaaaactatttctcgagctccgaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaattcaaatgacaagtaattccaggaaaacctgcttgacctgcctttcgtctgtactacaactgtcctcgctgttgcttttctaagctaaactgttgacatgcttcacaggtgtaccttagaatcgaacctgtcgacctgagattggggtgactctgctgacaccttgcaactggcttcttcaagtactacccggattgttgcactgggttgaaccttcaactaaaacagcgacgaagtgagccaaaactcatctccgagacctaccccccttacatggagtagtcttactttctcctgactaggaacaattggactattgtccttgaaaaataaccaacacttctcttgcttacaaaggccctcactttgaaaactgaaacttcacggattcatcaaaatagagtaatgacggcgcactttcatcacagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactataggtagcatatgttactcctgggattggtggtggcttagctgtgctgctttgctgaggacttggtggcgtactatctgaggttgtgggtgcttcctctttgaaaacaaattggctttggctctgatcctaattccagcttgcatctaggcttgtacatgttgttggagacactggtgttgcatctgctgcattggactctacggttgctgtatcaacatctgacacatccatcatctgacattggctaaccaaaatctgcccagagagaggtgctctgatttagcttgtagctggctgccttgaactgatccaatggctctgaccgcaacacactactgctggagttatttccgctacatttgaccaggtgtcgaacctgcatctcccacatcgatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttgacaaagaaatgccgaagggcgagaggagacatttttcaaatagggttttcagaaagcttgtccttagggtttgaccgtttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattctcgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctgaagatggcacgttggttccggtcagatatatgccaggcttcatcctaaccattacaggcaagatattgtatgaagaagggcgaacatgcagattgttaaactgacacgtggtggacaagaatgaccggtctgaccggtctgacaatggtcatgtcatcagcagacagccatgtttccacgtcgcgcctgcttccggcggaagtggaggtaggtatgggccgtcccgtcagaaggtcattcggacgacggcgatgcaaatctccgtccgttaatgaagagaagtcaaattggagggaagagaggatgagtccccacacaaaagaaagagagggagagatggtgcatgtgggatccccttgagatataaaaggaggaccttgcccactgagagaaaaaagaagaaaaaggatccgagcttaatcgggggctggctggcattttgtagcttcttcatacacagatccaccaaaacacaggagtagggtattacgcttctcagcggcccgaacctgtatacatcgcccgtgtcttgtgtgtttccacgatcgcgaacttttcacatacagactaggagcttagaatctcacccagggcccccggccgaactggcaaaggggggcctgcgcggtctcccggtgaggagcctcacgctccgtcaacagttatagagcacctcaaagaggaggaaggacaaaggagggaagatgttgctgggcaaggtcgcaggcaccgaagaccgcattcgtcgaggccacagcccgccgccggcaccacagagctgaccacgagccgctgatcggtgcaccgccagccgggaccagctacggtgcacaagctgtcgaggccaaagccttcaccgccggccgtaggggggtgggtgggtgggggaaactaggcccgccgccggacgccatcgtaacctccgccaccgtggcctccgccgctagccttcgccaccgctacctctgctgccagtcaccaccgcgtcttccgtgcgcgccgacctcctgcgccggctgccgccagccgccgagtcgccatacgccgccacctccgcctcacatagtcaccgcacgggagcggctcgctctagccagatccggcgtggaggcgtcggatccacccacgaggaagccagatccggccgcggctgcgtcggatgcgctgcctccaccccacgtcatcggactctccttcgcgcgccggcccgccttccacgcacagagacggggcgccatcgagtcttggcctcgccgccgccatcccggctggccgcacggaactctggtagcacactctggtggcggcgaggggagagagaggaggagaaagtggcggtgggggcgctaggttttcccccgagtcgcccgctccccgagtcgcccgcgcgcgggcgacgtgggggccaacagtttcttcatttgtaacagtattgatagaccagagtctgtcgcgcgggcgacgcgggggccagcagtttcttcatttgtaacggtattgatagactagagtctgtaaccgtgcatgtatagtcagcttccttgcgcaagtggatcaggaaggatgacgactccgtttttacatcactaaagaaattcgcagggaatttttctaaaaaaaatggtgaggaagatacgagaacagaataatctgagaacccaagcaatggccttgcggcttgtttggttattaccctgataagaatttgcctgacctaaaactagcctgacttatcttagtccttgtttggttgccacactgagagctcttctcctcggccttggcctgacggacccgggcaagtgattagcctgagctctacgcacacgcgcgcaacataaattaatgataacccattggagcgagtgttaggaaacgatcggcagataaacgataaaaaacaatagaacgattggcagataaatgataaagaacgatagatcaatcacgaagacacgagatttaacgtggaaaactctcctaaaacaggagagaaaaaaaccacggttgccagtcagcaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccgcggacgcttagctaggatgttgattcgctgagttccggtcacgcggcctgcctttccgcacgaagcacgcaacaggtcagcaggtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaatatcccggctgcgcaaaaaataagggggtatttgggagagaggggctaaactctcaaaaacataagtccctcccataggaacttatatttttgtgagagagactaaattgtttagccccactttagtccctccaaccaaacaccaactaaagctcatctgtcaggcatgaagaaaagtgtcaggcatggtgttcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgctgaaatgggccgagatcaaggcccattaaaacgccacgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgcttcacgccgcgcgccgacgacgtggtccttgccagctaccccaagtgcggcaccacgtggctcaaggcgctggccttcgccgccatgacccgcgccgcctacccggcggacgaacacccgctgctccgcctcaacccgcacgacgtcatcccgttcgtcgaggacgtcttcaccgacggccacgaggccaagctcgacatgctcccctcgccgcgcctcatcaacacgcacacgccgtaccagcttctcccggagtcggtcgtcgccggcgacggcggcggcggatgcaaggtcgtctacatctgcagggaccccaaggacatggtcgtgtcgctgtaccacttcatgcggcgcctccagcccgacctgtcgctcgccggcgtggtggagtccgtcgccgacggcacggtgccgttcgggccgatgtgggaccacatcctcggctactggcgggcgagcgtctcccgcccggaccgggtgctcttactcaggtacgaggacctgctccgcgacggcgccgccggcgagcacgtcagggcgatggcgaggttcatggggcggccgttctcggccgccgaggaggccgccggcgccgtagcgagcgtcgtggagttgtgcagcttcgagaggatgaaggcgctggaggtgaaccggcggggcacggcggggtcgtacaagagcatgccgcgcgacgccttcttcaggaagggcgtcgccggcgactgggcgaaccacatgtcgccggagacggcagcgaggctggacggcatcttccgcgaaaaattccgtggcacagggctcaccattgttccatgacacggatcgagcagttggccagcgacgtcgtcgtcagtcactgacatgtgggccatagcaaagtggaacccacatgtcaatgacccaactgcatgtcagaggatctgcttccgtgtgcttcatttcattgtgattttgctgctgtttcggacatttttgtttggcatcgcttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggttaaatagtccggtagcaagttacaattatttttgctggcggcccacttaatcaaccgccagccaaaattgatttacactggcgctcttaaaaaaattcgcacataaaaaaatcaccgcgcgcccatacctttatccacccaccactacagaataaaaatatctccacttctcccctccaaatccagatccacttcctctcctccaaatccaagcaccctcctctcctcttcccctccagatccacatctcctctcaggcggcgactgcggggttctcgggtggcgacagcggctccggcagctatgcgtggtggcgacggcgacgggaggcgggcacgtagctgcgacgggaggccgtcgtcgggggggtgcggcgacagcaacgggaggagccgtcggggggcgcgacgagctccttcttctcccctcccccttccacagtggcttggtgctgcgatggttgcggcgacggctcgttgttgcgggacatggcgagctcccccctcccctcccctcccctccccttcctctccctctccctctcccagatctagccggaggggagggggtggcggcgaccacggcggtaacggaaggcaggcggtggtggatctgacaacggggtcggcggcatgagagcaaccgcgacgacgacgaccgtgaccgcggcgacgacgacgacgatgctgcgcgccggccgggagcacggctctagcggcttcttccctcccctccttctccctttcccaaaggagaggtggaagcggtggccgtagcggcgacgacaggtgggcggcggcggcggatctgaccgcggcggccataattattagaaccggaccggaccggcggtccggccaggaaaaaccggaaccagggcaccgcccggtaccgcggcagccatagttattagaaccggaccagaccggcggtctgaccgggaaaaaccggaaccagggcgccggccggttcggttcagatataagatcagcgcgcaatcaaaccggagagaaaccggttgaaccgggcggtttactgcagaaccggagaaaaaccggggtggttcaaccgcttgaacggcgtcacacgtgaggtggcgacgctgtagagtacatgcgtcacatgaattagagaaaataggtaaaaaaaagctgtagaacccaaaacctccatgcttccaccgagaatctctaccagcaggctatgtgatgggttgtgaaacaactataacacacacctatttgaacctctttaaaccgacggtttgaccagtccgaccaataaaccagtgacccaagtgacttaacggttcgatcaccggtctggtcttaataactatggcggcgacgacgacgacgaccgcaatcgtcgaccacaaccgtggcggcgatgacgacgacgccgctatcgacagctctatgcgtgggcggcggttgtgatattgatgtttgcttgttgaaaatgtggtgaaaattgatgtattgttttctgcatgtggatttgaatatggatctgatgccgatttgaattgattttgagtatggattgaaaaaaatccaactgctcaagaggtcgattgctatttttttattggaaaaaaaatcttttcgttggcggtcctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccatttattaaaaaaaaaaccccccacttttttttttgtggggggggggtttccccccccccacataagaaaatttaaaagaaaattccattagcctcaaatgtacaaaaagttactttggctttatcacagagtatgacaatatc

SEQ ID NO: 11618 - DNA, 24932 bp, Oryza sativa
ctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccattataaaaaccatttgtcgcacataagaaaatataaaaagaaaattacactaagctccaaatgtacaaaaagttactttggcttcatcacagagtatgacaatatcgatcacaactattactcctctctctgtaaaaaagataaattttataactaagaatatgtgtctagactcatagttaagatgaggcttaggatatgggatatagatcgacgttcagagtcgcaagaaggcctcattcaatacaagaacgagagaactagagaacagaaaattttctgaaatactcctccgtttatatatatattagtttcaaaccattacagagcaacaaggaaacaagcagccatcccgatcgatcgaacgaacatactcgaccatgcaagaaagcatctagcattaataggtagaagtagaaccacaagcaacgatcacaatgcgtgcgtacgtaatgtcgtcgtcgtacgtcgtcacgcggcggcggcggtgcggaggaggtagtagtagagcttggggttggcctcgaaggccacgcgggagatgaggtggccggcggcgcctggacctttcatcatcaccaccggcgccgccaccggccaaagcagcaggctcaccgccgcgccgaccacggccgcggcggccgctccgacgacgaatcccagcgacaccatggctagctctcgatcgatcgcggtctcaacctcccaaggtcgactacttctgaacttcccaagatcgagatgactagtgctagacgtggtatatataggcaatttagtctgcattaatttgcttgttttcctcgggaaggggatgggttggaacttggaagctgatcacaatttgaaggacggtatagatcaaacggctcgtagtaaaatgtgtgaagacgatgggacgatgctttttttttttcgcaaaaactaatcagcgaggcctcttgatattgtcttatcgggcgacgccaaccatagaagccgtggagaagccagcgcacatgcatgcctttttttctattacacatcatgtattgttttcccttcttacaaagttttctctcaaattaattatccgatctataatccgattacaccattgtgttcgttgcaattaaatcttcaaaactagatcttacatgattatactacgatgaaaaaatatttatacttgtaaattacttttgttatatacttaagttacttttatcatatatataaattacttttagatttaattaattactttttatatattcataatgctttaagtcgattatatttattatagtttttagtcaattctataatttatggactttaaatttaatttttagatacaaaatatttttctctcgaatttacttctaatgttgtaacaacttacttctattttgtgctaacttacttctattgcatagctaagttacatctattgcatagctaagttactactacaatttaaataaattacttttaaattaatgaaatgtttgaatatattcaacatggatttttttatctcatattttatgtagagtacaatgatgtaaatagatcatgaaaataatatgtgatttaaaagatataagttattaaagagcttaaatctaaaagtaatttatgtataggacaaaagtagcttacatatataataaaagtaatttacaacatagatatttcgtgtaagatcttgttgtaaagatttaattacaacaaccataatggtgtaatcggattataaatcggataagtaatttaggagaaaattctctaggaagaaaaaaaaggcatgtactgttgagtgtactagtaactgtttaagagaagggcgtcgctggttagcgatatgccgctagcgcgcgcgatctagccgtgtctttttttcccacgcttttttgggactccggccggtaattgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagcccctctctcccaaacaccccctaaatctgtgagcagacgataaattctagtagtagtgtgctccttcccccaaataaaccatctcatttataaaaaatcttagagcaagtttaatagtatagtccactactagttttaaatcatctatagccaatgtaatagccaattcatacaatagttgcttactatactattaatacctggtcccacctatcatacacacattccgttttggagtccgtgctacagctggctatagacttatagcccgctgctcttctctcttcctttatctatttaaaatatgcttatagctggcttatagcgtgctattgtaattgctcttacatagacgtaggtaatagtatagtaggctagtaacaccctagttttctccatcctaacaaaaagtgaatctagaactctagtacaactaatctatatgtgttacattcaatactagattatttttttatgggatgaaaggattaatttttcataggacggaagaagtggtatgaaactcaacgtagcacaaaaaatctagaacattctcatttataaaaatcctatatagatgtaggtagtagtaggctagtaacaacatagtaacatatgaaactcaacatagcactaaaaatctggaaaggaagcttgtttggttggtttagaatatagtaaaataaaaattaaaaatcaccaacatttgtaactaaatttcactcacactaaataagttgtcactcacatccgtggaccttttaacttctaacgataatatctaacttttaaaaataaaattagatatgcattttttatccagatcgatagatccgttaacattgactcagactcgttcgttcatgatttttataatctatgggcatgtttaaatcaattttctgtggtaaaagttttggtgacaaaaaaaaattagcatttgaagttgaagttttaatagttactgtttagatgcatattctaccatttttctggtagagagagcactcccaacgcacttttcgacaaaatttactactctagattttcaaattttcaaatgacaaatattaaattgataacttttactactagtgtttagattcattttgacaaaatatgcttcaaaacggtaaaaacttttaccattttagaggtttggaagaactaaacaggccctaacttcaccaataaacttcaccaataaattgctcgatcgtgcatccacataatgactttaagttgatttttttatatgaagggattaaagttgatttttataataggttaaagttgatatattttataggatgaagggattaaagtttatttttttaaggatgaactaaaggagtacgcgatgaccaattcgaatggaacatactatttgggcgtgtatccatgcaaagctaggatgcacgatctgttgagattatagacatataatgatttaatttattccataaataaatcatgacattacagatgaaaactagcatgaacgcatcattagatctacatatgtaaactatacagtataacataaacagatcaaatatgcgcaacatattgaacacgtaccgaggtgacagaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaacttattgccgccttctcccggtgcaggacgtcgaaagcaaaggttccggagacctgctctcccgatcgccggtgcacgctggcgagcgggatggagtagtctacgagcgacggcgcagtacagagtaggaggcaaaccctagattgatttcgtgtgtgttgcgtgaagacggcaggtcggtttatatagagaagggtcgcttgatcagggcgcccgcacgatctctactgcgcgtaaccgaaccggataagtcacgcgtaacttatctggactccacgccgtttgcacgcaccggatttttcggaagaatctgaatttgcagcaaaacaaaactgcaaaaagaggctgcatctgcgcaagggtgaggagccaatttttcggaccattcaacgcgtacgtcgtgcacgcgcgccgcctgccctgccctgccctgccaggccaggcgaggcgaggcgagcgagcgtgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatactctgcaggacaacatcttcgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcttcaacagtagcagtatccagtgccgttagctctgctttcatggttgacctcgtcaaaatggtctgtttgcaagacttccatgaaacagcaccaccacccagtgtgaaaacatatccactagtggctttgatctcatccacatcagagatccagttagaatcactataaccctccagtaccgcaggatacccagaatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctgtgatgagcatatcccagaaaaacacagtccacagtcttaggtccaagtttgcgcttcttcgttattggtacattgactgtcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaggcagtcccgcggcgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcttcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctggtcagacgggagccactaacaagattcctgtcgaaaacaaaaacgaatccgaatttgcagcaaaacaaaactgcaaaaagaggctgcatctgcgcaagggttaggagccaatttttcggaccattcgacgcgtacgtcgtgcacgcgcgccgcctgccctgccctgccaggccaggccaggcgaggcgagcgagcgcgcgcgtgtttcccctcttctctccaccacacatgcttcaagtgactgggagggtatcctcccttttaaggaggtccccctctcctagaataagcaagtggtactaaactccacatgcatgccatcccatgaggtgggcttttgtgattttccaaagaattaatcttcgagtgggctaagacccattcattaattccaacacgatcaaccacactgcttaccctacaacaaaaccagcagctttttcccgtacgtacgtggaggataactatgtactagtgtagctacatagtacttactagctagctatagcctataggtgtgtagtcgtctatccagcagcagcaatagctaacggagtggagtacgtacgtcgccggcgccgtcgcgcgcgtcaggcggcgacagcaaaagcggcggcggccgccttggcgcctgtcacatcctgattttcgtttcaggatttataaattatttaataaattattaatagaatttatattaaatgttctttaatttacaagtgaagttaaatgtgggaaataaaatttccctaatataaagcatggatggatttaatttttattaaattctccatgattaagtcaactctctgaaatcttctcaaatttttcggagctcaattcctaatttttaatcatacaaagaacatttcagtaataatccacatattaaattaatcattaaatggtctggttttaatattgttaaatactttgagtgtccaagtattttcatgatttttcttgaaattatttgagcattggaagtatttttaacaattcaaagatcatttaagtgattattttaattgggaaagtaataaaaatcctcctcctccgcttgggccattttcggcccattccttcctcttctctctcccttgcgcgcgtgctgtgcagcccaagccggcccaagtcaagtgctctgttctgttctcagccaaccgaaaaaagtctagtttgcctccctggcactgttcatcttccagctctggacagagcccgagccagccgagcctgtgcacagtgccgccttcttccaccaaatccggcctcctcgttgctcctctttccaaattagttgaggggaaatattcctcttattctcctcttccttttccccaagaaatccccaaaattttatatggaaatcctttccaatttcgcggatcaaatcctttcctttttccggcgaagataaactttcccgagtttttcccgtcgttttgggcccggacccgagcttccaaggctataaataggaccccctagtcctcctctttcgtttgccccctctcccgagctctctagtgcctcgtagcctcgtcgccgcgcgcgtttagttcgtcgccgccgccggccgagtgcagccgcgccgccgcgccgcttctgccgtcgccgccgcttgccgccgtcgccaagaggtgcgccaaggggtggagaagcccggccgcccgtccttcttcgccgccggccgccgtagctcgccgtcgtcggtaaggtccaagccgccgccgcctcctctcgtcgccggccgtcgtcggacgtcgattgtcgttgtggtgagtaccgttgggttcgcctcgtcgtcctctacgtgtgcatgccctccaaatccgcagccggccgctctatctccggcgaggtcgtatcgtggttcgccggcgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgccctcggttgttgcctctcgtcgccgaaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctaacgtcatcatcgtctccgtgtgtgtcgtcatcgctgtgtcgtagctgctgcttgccgtgccgctgctgcgcgtgtgccggctgagccgcttagctgcagctgcttgccgctttgccacagccgcagccgtgccggttgcgtttttgctcatagccctgctgttctagccgtgcatggttgctaccggctgtgccgtcaccctaaccctagctttgtgtatccgctgagctgccgcctagccaagccaagtcgccctagtgccgccgtgtcgcagttgtgtgccgcttaaacctagccgctgcttttagtcgagttgtgcagccgtaggtgcaaccctaggttcctaccggtctatcgtttgtcgtaccggggttttaccatgaatcgtttctagtccaccggtttagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttgggtgatcccgtgtcacgtagaattgactcgttgagtcggtatctcgtgaggcccgcttgccagatcaatctaagccatccgatcttggtcaactctcggtcaagattaatctcagccgtccaaaatcaatataaattcgttctatcttttcaatggcatattagtcctttttctttttatcatgtcatctaccaatataatctaatcttttccggaggttgctttaatcttctgtctccgttataaatcatttgtaaattgtttaattaatttggaatagtcttttctttaataggtttaattggaatttaatcttgtaaaattcataataaattcatatgaaatcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgcttgcattgattactttaatccttgataccttgggttattataatttgactagttgagctttatatattagttcagctagatattagatgtgattgcttagccatgcttagaaacattagcacactattgggataacttatgattcgttattatttaatgatggtttaatggtagctcacgatggtcaaacgtgattggttaattaattacttgccaactaaaacttgataatggtgggttgtgagcacatggttttgagagtcgtgctcatgacaattaaggaccggttcgcgaggtactgttgtgaaacattaaccgtaccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcacaataattatggatgctataactggtaataatttgcttagctcctggtttggagttaaatctgtacagccgggtatggttgttcaggatggttgggcctgtgcagcatgggtgtgctgtacagtgttgattaaaatttttaattaattactctactgttttactactcttaactctttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaagaatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagcgcccaccgtgcgcaggaggtggaagtagacctgcgggttcgccaggaacgccgcgcgggagatgacgtagccggcggcgcccggcgccttcatcatatcatcgccgccgccggcgccgaggccggccacagcaagtacaagaaggcggtcgacccgacgcccacgggcacggcagcgatcatcgacggcgccgcaaccatcggcactacaagtttgtaattccagatcgcgcgcgtggagaccaacgaacaatggaggagatcgacgaagagatcaagcagagtgaaaggtgcggccactggtggtaaagctagtggtaactggttttatagaggattgcaaaacacaggaaagacatagaaatgactgtttgattgggccgcaggaaaaacataggaatttgaggagaaataaagactcaaaggattctttccatgaggttctatctcatgtcaaatttcctccaaaacttgcaaaacttgtatggaaaaagataatccataggaatttcataggattttataggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaggttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaggcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaaccacttttcaaacggccacccgggcctagctgatcccatcacctgcagaattttcaaacattgaaccccttttcacaacagtaatttcacaagcagtagtcaaacaaaactacgctaggaatcacctcacatccgcccatgaccgtgggcacggctgttcgaacagtttgttaacctctgcagagggggtacactttactcacacgacattactaacccggatcacccagcccgtggggatcagccacgtcgggagacctccaagctttcatgacaaggcatttccaaagccgacacaggtttaccatatgccgacgagaggagtcccagaccaacaacaggttaggtcccagaccatactgtgccaagaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaatcggtccttaagtgcgagagcgggaaaccgtacacccggtacgttccccggtccgcggttttggaaattcatttagttcgcaagcaccgacccaggtgtcgggttttccaaatcttttgtaaaacccaagttttacgcaagttgttattcagattttaagtttgaaggcgtccgtcgatactcgcacagggtgcacgaatatcgagacgcaactagatggttacaaggggacatggtataacaattaacaaaagaaggatcaaatacaacaaattagataggtccgccaatctgccttgcagacgggacaaacagattaagtgcgatcctatcaatgcataatatttttcaagcaacataattaaatttcaaatataggctcaagatgttcaaaggtagcttgccttgctcgagatctggagcttgatcctcgaaatcctcgcactgcgggtcttcgggctgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttcttgggccgtcggcccagtccacccgtcgcccgcgctcggcctccccttgtgggccggcccgttcccctttcccctccccgaagttctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgctctcccccccccccacatctcccgcgcgcgcgcgcccgcaagtggtgggggatttgaatccctctctctctctctcttcctccccactcccccacatcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccacgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgcctcggcatcaccggtcgtcgccgccgttttcttccttcgcgccggccgccgtgttcgccggtgaggaatcccctctcctcctccttccttccctccctcccatgagcgccgccgccctccgcgcgtgtgccgtcatcttcggccgccgccgccgccttcgcactggccgccgccgtctcccgcgccgccggtcaccgccggtgaccgcgcgtgtcgccgccggtcgccatggccgccggtcggctttgaggccgagccgagcccggccggcgcctccctcgcctcccctttgagccaccgcctggtggggcccacctgccagccgccccctccctctccccttgtgccgctgccagtggggcccgcatgtcggcgccgcccccccccccttggatgacgtcagccctggggcaatattgcgcaataattaattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagataatgacaatgatgatgcaacagatgcagcaacagtaccatcaggtgatgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccggctggggcagaggttacttggacagagtttcgtcatagtttcaataaagcacaggttcccgagggaattgtgggacaaaagaagagagagttccgttccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtgtaacaaaatgaaccgtaagaggaaggcagcccagttcaggactccccaggggaagtgtcagaagcctcgttacacgatgggacgtcacggtggaccttccaccatgattatccgacagcaccgtccctaccacccgggtagcttcaataagacccaccatagtgatagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaaactagaggatattcctatagtcagagagtatccagaggtttttccggacgatctgacaacaatgccaccaaaaagggatatcgagttccggatagacttggtaactggaactgcaccgatccacaagaggccttacagaatgggagccagcgagttggcggaagtcaagaagcaagtcgatgaacagttacagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgttgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtccccatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatccccgacagcgaagatggttggagctaattaaagattatgatatgggaatacactatcatcccggcaaggctaatgtggtagcagatgccttgagcaggaagagttactgcaacgtcgcatgggtagaggaactatgctgtgaggtacaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggcagtaccaaaatgtaccaagaactcaaagaaaagttctggtgggtcagcatgagaagggaaatagctgaattcgtagcactctgtgacgtctgtcaacgagtaaaggcagaacaccaaaggccagcaggattgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattaggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcagtctcggcagaaaagctatgcagacaaccgccgaagggagctcgctttcgaaacaggggattatgtgtatcttcgtgtcactccgctcagaggagtacaccgtttccaaaccaaagggaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcaaatcaaaatccaggaagacttgacgtatatggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttcttgggccgtcggcccagtccacccgtcgcccgcgctcggcctccctttgtgggccggcccgttcccctttcccctccccgaagttctccctccctccctctgtctttcgggcgccgacaggtggggcccacctgtcggtcgtcttcctcctctagccggttggagc

SEQ ID NO: 11619 - DNA, 24729 bp, Oryza sativa
agcgagttggcggaagtcaagaagcaagtcaatgaccagttacagaaggaatacatccgtcggagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcacccaacctgatcacaaaagtctaaagtacatcttcacccaacctgatcaaggttgctctggtttttggttgggttttttgcaggtgcctaacatcaattgttgtctctttgggaaggtggtggcctctcttttgtattctttatatctcctcccctttttctgtttaatctgtaatggcttgccgctggtatagcccaatctctgtaactcagaactatctttctttggcaatgaaagatttaggtgaggaatctctcccctccggtgattaatcaaataaaaataccgttacaaatcggggttgaagtaatattcttgctatgtatcagcatcttaacccccttcataatacgtttgattagttgttctgttgttgattcctcttgattgaacacatggtggtttctctccttcaatgttcccacgtcagtagaatgaaggttgtttttagcccttgcttgtggaggcgtcgatgtgtttcctgttccatattcccacggtcccaacaatgcagtacaccagtagtgttgtcactaattctagggacatttaactatttaccactttttagattaagcattttactatttaacacccatatatcaataacacatgtgtccacatgtatctataagatatgggtttagtgataaataattaattgtcccatctaaaaataacaaatagtttaatatatcgcttctcccagcgccgcgttgcctccccatcccccgcgcgcgccagctgcgccttgccgcttctccttccccagacgccccaccccctacgccgccacgctgccacccgtctgttcatcttcgtttccaaatagccgatgcttctattaatttgtttgtcgcctcctcatcccatcctctcatacatgtcacacacatgttgctgtttgctgctaatgatgatgcaggacgaaaagcagtgcaaaccttggtgctgtcactggtggagaaatcatctttggtcggtcgaccaaattcgacaatagtccaggttccatttaaaactgggactaaatacgattttttagtcccagttaaaaaaattttgatctttagtccctgttggtattaccaaccgggactaaagatgatttttggtcccgattcatcccctgtcagaggcatgtcaggaggccgaggatctttagtcccggttcatactaccaaccgggactaaagattaccactttagtcccggttaccaaccgggagtaaagatcatttagatctttagtcccggttggtattaccaaccgggagtaaaattaaacacgtagtatataatctatagtccttatcctctcctctactcgcaaccactacctcacccacatatcgatcctcctctcttctacccctcctcccttctcctatcttatacagatcctccccttcctccttcattcccctccccttcctcctccctcacctggagatggatcttacacagatccttccctttctccttccttcccctccccttcctcctctctcacctggagatagaggaggccgcgccgtgcggacgcggtggacggacggacgcgcggcgtgcggcgcagacgtgctttgcaggggaagcacatgcgcgcagtagtaacgatagcggcagccggcagtagtgggattcatattttgtgattgatttcttgagtagtagcacatccgacagcttgttttctctctttttttttttgatattttgtgattcactgagatgtataattttgtgattcattgtatggatttaagatgtataatctgtgttatatttgatttgtgtgtaaattttttaggatttgtgatgtattatattggtgtgtataagtgactttaagatttgtgatgcggatttaggatgttactttgatttggggatttggtgtttgatttgggatgtgcatgccatccgattcgggagaaaataaaaaagtaccaaaaaaaataaaaggggaccatccgggactgtccctatcctctccttagtcccagttgataacaccaaccagaactaaagatgcctctctttagtcccggttggtaacaacaaccgggactaaagattgatctttactcccggttatttcaccgatctttagtcctagattcatagtcccggttagaaaactgggactacaggggggagtatagggggtttacaaatcgggagtaaagacagtttctccgccagtgtggtgcccatctgagcacgcatgttattggatccatctgctgggccaacagggaggttttttcacttcatgttgatctctattgttctgggttcatccctaatccagataagtttctctttctaagcaacattgattggcgtagtctgagcagcaaactaatctcttcgcaattaagctatcaatttcgaacagaattaagtatccccatctagctcgctcctcttttttttttctccgcacatacgtatttgctcccgcgattattcactcccttcattttcttcacaggattaatttatcatattctttacatatttattgctggatttagtagctatgatgttgaattgttggggcaaatttcttttcacggtatgcatacattatatcttttttcgcttgatgcatacattgtttttttagataattgaaaaaaatatctttttttttcacttgatgcattcattgtatttgattgctaactacatattttttttccaattttgccttgcagctgtccaataactactaatatatgtattatactgttttagtattctgtattgcgcatggagaactctgagtagtgaacatgcctattgaatcagtgaaattatttgatctgcagatcattttgtgcaatgcagctataaaatttcaatgtatagacatgagaaatattatgtacctataaaaacacctcacatacaaaaatgaaatacttcttgtagtgatttttttagcacactatgctaagtggtcaataaagttgagttgataaaatgataaatgataaccattgatatttaatttctattggatggttgtgatgacacatggaactcttattttgtgggtggtgtgattcaatactccctccgggctgataatacttgccgttttaaacaaggtttgaaggtcaaactttagaatctttgattataaatcatttttaaaatatttgtctttcaaatatggtgattacatgtatagattagtcttaaaaagtactttaataaaattatatatttgttaacaaatttatacatattataatgaaaaataatggttaaacttgtttttgataccgtgttcttatctaaaacgtcaagtattattaatccggagggagtagatatgccttgtttagttgtctcgcgggttagtaggagatcagtttcagtgcacatcatgataataagaagaccaaaacatgtctcagtactctctcaaataaacgggacgacgaacgtacgacgatgattaatacaagtggtccacgagcagtgatcagatctaggctacacggtagtaggtgctaaagaaaaccttgcacaatcttatcttcctgacatcatgtgatatctggaagaaatgaaattagtgagtgtttagacacaaagaacttctaacaacaaggcttatcgtaaaaattagaaggcgaagacttgaatcattgtaggagtaaaagcattaggtgggtataatgccttatagccctcctttttttttattttaaacctatatagggcttcactcgttcagttttttcgtgttatatttaatgaaattgatacatctgtgtggggttggataaagataaagaaaacatgggtacctttgcttgcacgacactacagtagtactagtatgtttagttcactagttcacattaaaattagaagtttagttgaaattgaaacgttatgatcgaaaaattaaaaatttatgtgtgtaaaaaagttttgatgtgataaaactgttagaagttttaaaaaaaagtttagaaataaactcgaccttggtcaaagaaaggacgacagatgatgcactactgttacggctgccccctcacagatttttttttggcccggtctagttcccgactttttaaaaaaactttcaacttttctatcacatcaaaacttttctacacacataaactttcaatttttttcttcaaacttccaattttagtcaaattttcaattttggcgtggaactaaacatttgtgtgttttttctgaggctatgggtgtgttaatttgcgaaaataaaattttttgggtgttacatcatacgtttgaccggatatcggaagagattttttttacatgaatgaaaaaactaatttcataacttgcctggaaactgcgagatgaatttattgagcctaattaatccgtcattagtacatgtgggtactgtagcatttatggctaatcatgaactaattaggctcaaaagattcgtttcgtgatttccatgcaaactgtgcaattagttttttttttatctatatttatactgcatgcatgtgcgggtagtaagatatgactgatgtgtaaagcaactattggctagaaatgagagagaaagtgagagatgggagagtttaatattttttatgctcttattactagatagtagtgctattgcctggtataattactacctcctctactacccacccctacaatagtaaagtagatagtaagggggtcttactacccacttttcatccacattgcggacgccctaagaagcgcaagagcacactagacgcaggagactctcaggatgtcaactagtatacaaacagtaagtagctagcaagactggacttgcttgtacacatatatatgaccaaatatgtgggaaagtgttttcatccctcgaggagatatctctcgttttgtgcgtgttatctaaatagttatgaaaaaattaaaaaaatcacaagatagattattatgaaatatatcactccacaaacatgtatgttaaaattcaacatttacaaattgtagcaaaaataactacgaatgtacgagaactattttcaaattaatttgttcttttttgcaactggcagaaatcgaatttggccttacatgctcgtggactgatatatttcatattaatttatattgtcaatttttttaaacttttttttgataaatatttagatggcatgcaagcaacgaggggatatcccctcgtgagatgaaaatccacatcccaaatatgtttatatattgaagtgaggggtgtcacaagattaagaaataaacatatgatatttattgatgtcaccaaattttcccttaaggttgcatatgcaagtaaaagttttacttataatgacgtgaacaaaatctcatacgttcatctttttcttcatacgataattttaggttttcacggtacatggtttacactgtatagtttactattcaagtgggcgtatcagctgcctgttttcctcatcggaggtaaaacttaatactcccttcgtcctaaaatataagggattttggttggatgtgacatatcctagtactttgtgtcatatccacctaaaatcacttatatttttggacggagggagtacgtaacatagagcattgagacatgcgcatgcctgcaccaaacatttaacgataaaagtaactgaacacatacacatcaagtgttcggatcggaggctaaacatacacaaaatgaaattccaaatgcatcactccgcaaaagtaaaccctgatccataaaacttggccgagagaaacttatcaagactatcggccatctctggcgtgacgtggttcacccaatctccgatgactcccttcctaaagaaagactcatgtgggtactcattggccatcatatgtagggagcctgtgctgttggcacccgaagccttcatcttctcaaaactgcaaagctcgatgatgctctcaacgatcccggcttccttctcggcgtcagagaatggctggccgatgaattccgtgattttctcgatgttcttcgtaggatcgcgtagaacctcctcgtactttaggaatagcaccttgtccggctttgccttactcgtgttccaatacccaaggatatgctcccagattgggcctcccaagtatgcaccctcacggatggactcccacacatcagataatgacatggtgatggactcccactgatcatcagataatgatgaggtcttagccttagaacagttcatgaaatgccataaagaaattgccatgtctttcggttgcctgcaattaataatataacaagaagaagaccataaccattaagactatgctttgggacgaaatggttggaaaccataaaaaaaatagtcccaatgattttaataaccatattttcttagaaaacaaagtaaaaaaaggcagaggcggatataaaaatggtattggaaatacggaaaattgaaaataaaaagatatggaaaaaaatgcatgtatcgatcggaaacatgactatgtaatatctgaaacaataatctgaaatcacatatttaacttgacatgattatataatatgaccacgtgaattcaaacttacactattctaaaaaaaagaaattcaaacttacactacgtaaatcacaaaccatctcttctttaggcatgtactcaaattaggaattgggttgaaaagttgatgggcctctagtaaaatagagacatggtatttagaaatatggtaattaattacagtattataaaaactataattttcgtgcaaatatggtaaataagaaaatggcaagtagaacatcaaaatcattttcgtttccgtattttcttgccttttgttaggttaccatttccaagctatgttaccccgatacgtcgctgagtgtcgcgtatctgtatcggatacgccaacggatacacgctccgatatgcatcccgtacgtatctgacattttctcgattttcaaacaaatgaaagaattacggatactttgctgattcgtattgatacgcccatattttcacatgactcactcccggtctccccgcatcgtcttcgccgtcgccatcgtcgggcccagcaccgccgtctgtgcagccgcaacgcctccttcgcggaagggcactgcgcctccacccccaccgtcccgcgggcaagccggcgcatatcttcctccgccgctggcgtcaggggctaggggatgctggggccgccgtccccagaacaacgcctccgcgcgcagccgtctatgcggtccgcggccagcaccacagtagcgcctccacctccgagcagtaggcacaagaccaccaagcagtttttcctttgttcccctgtgaggctgtgagtaaatcactgcatgtttgtgtttgggtgtcggttgaactaccattttagagcaagtttaatattatcgcccactactagctctaaatcatctatagccaatgtaataatcaattcatacaatagttgcttactacattattaatacatgccccacatgtcatacacacattacgtcttggagtccgtgctgcagctggctacagatctgtagcccgctgctcttctctctctttctttatctctttaaaatatgtttatagctggcttatagcctgctattgtacctgctcttagtgaaatccggtggttggttggtggcttagtgctggcgtgctgctacttgtgtactccctccgtaaaaaaaatgacaaaccctgagttttcgtgtccaacataaatattaatttttttacgattaatatttttattgttattatatgataaaacataaatagtactttatgtgtgactaactttttttaattttctcataaatttttcaaataagacggacggtcaaacgttggacacggatttctacggctgcacttattttgagatggaggtagtattaaaatcaaaattattatttcttgtgttgtcaactcgtcacccttctccgcgtgcacgctttcaaattgctaaatgatatgttttttcttaaaaaaattatatgaaagttgctttaaaaatcatattgatttaaaaatcatattgatttatttttaaaagctaatacttaactaattgtgtgttaatgaaacaatccgttttttatatggagttctcaccttcacctcccgaatatagcctaatagattgcttttcagtgaaactacgtgcacatatgcatgcataaacgggttaccggcaacccgtaaaaatgattttttttttggaaaaagtataaattaccccccccaactatcgaggtcgactgaattatacccccgaacttgaaaacagacattctacaccccgaactattgaaaccggacaaataacccccgactcaatttggagcggttttggatccacgtggcagtccaatcagcactttttaaataaaaaaaatcagtgggccccttttgtcagttctccaccacactctatctctctctactctatcccagaatcttcccctctctttgtatcttatcacctgcacggcggctgtcgacctagggcgggagcacgcagcgctgccggcagctgagggctgatgagaccgaggcggagtgggttgccggcagacttactgtggtgtgggctagcaaccacctcctctgagacagccacatcgcggtggtgctcctccagtcgtggtcggagttcgcgcgcacggggacgttcgccggaggcctgaaccttgactggtcggtgctgagccgtccccactccccgccgaggtacagcgccgccgtcgacgggatgttcgtgccgtgggaccacgagcacgagttgaacccgctcacggcgagccgcggaggcgagcttcgtcgagcggctctactacgtcgaggccgctgacatcgccaggctgcgcgaggaggcgcgcgcagcgcgcgacgagcggctctactctttcttgttcgtagctaattttgctttcagtttttttggcggaggattttgggttggaaagacaaggtcgggatctcttttaaagtttgtttttcttttcttttccctcttgatcggtggatcgatgtactatcagtatcagtaatcagccatgccatgccatgttttgtcgagctcacaagattggaatctcccgctagggaatcaattttcaactgtaatttgccccgctttctgcggtgagatttgcaggtgcgcaatatgtaattcaccattttcatcgctcatcgctctcttgctcatttcacccggttgtccgatgcaaagtggcaaagcatagtacaggagataaacatgtctggcattgaaggggcgcccacagccgccggcgcgcggggctcggggtggtggaagaagggaccgccgaaggcaagtgcttggggcggcgaaggggcgcccacagccaccggcgcgcggcgcgttgaggcagcggaggggatgcttgcagccagcggtgctcagggaggtggagggggcagcgggcggagctccggcggcggaggaagcgcccgcagccatcgccgcgcggctcgtcgaggcgctggagccgtccgctgccgtcggcgctcgagccgcaaccgccatgatttgagagagagaggaaagggaaagagagagtggagagatatctgacaggtgggtcccttcgttttttaattaaaaaattgctgactggaccgtcacgtagaccaaaaccacttggaaaactgctcgggaggggggtttcatccggtatcgatagttgagggtgaaaaacgtccggttttaatatttagggggtaattcatactcaaccaatagttcaggggtagttcgtactttttccttcttttttttaaccagtgtatgaactgagtgagtaactgaatgtgccaaattcaccttgtttgaaacattgtttatggcaaggttactgaaattttgaattggaacattaatgaacagtaaacatttactaattacagattaattaggcttaataaatttatctcgtggtttaccgacgaattctgtaatcagtttttttattagtgttcgaacaccccaatataatacccgatgtgacacgccaaacctttatgccctagatctaaacacccccctgatcagcacttacctgcagatgtagatgattttacagcggtcgtcctcggtgatggaggccggcaggtttgggtacgacgcgtgcgtgctcatcagccgcggcgttggcgcggcgtcgagcttggcctcctcctcgtccaagtagatcccctccaggaacgggacgcactcgtgtgggttgagccggagcagcgggtgccggccatcaccgccggcggcggcgggcgggtacacgccgcgcgccgccgtggcgaaggccagggccttgagccacgtggtgccgcacttgggcaggctcgccaggaggacgtcgccggcgcgcggctcgaagcggcgctggagcgccacgatcccggggacccacgtacgcctcccggaaccaggcgccctggtactcgcgccaccgctgctgcggcgggtacagcctgctcgggagcgccgccacgacgtcgccgtactcctccgcaaccggtcgccgtgcgacggcgacggcggcgatgtccttgaacgggacggggcctgcggcggcgctggtcggctgcatgtctgaattctgatcgaacgaaacggccggggagacggtggagacgagccggccggcacatgagtcattatatagcgtggcagccagccaggcggtcactgatcttctacacttctattttaccaagggcttgtttagttgacaaaaaaaattgtccctgaacatcacgtcggatttatgaacacacatttaaagtattaaatatggtctaataacaaaataaattacagattccgccaggaaactgcgagacgaatttattaaacctaattaatccatcattagcacatatttattgtagcaccatattgtcaaatcatgacgcaattaggcttaaaagatttgtctcgcaatttacatacaatctgtgtaattggttttttcctacatttaatactcgatgcatgtatccaaacattcgatgtaacaacgtaaaaatttttattttgagaactaaacatggcctaagataaaactttcttaattcaccgtatctataccctataattaaccaactcactcttacatgttacatacttcatccatcaaatccaacactctgtattcgtctacatccgatcgaacggttgagattacctcccccatcacccactaagccactactcatcactctgccctgatcccacgcaccctccccctatgcaaccgctctcctttcctcgtcgcatatttcacgccgccctcctcgcatctcctctctcagcgccacaatcaccgggagcgttccatcctcctccgccttcttagccaccgcgctacggaggcgacgcccttcaaccctctgccactcccctcgccctcctccgcgccgtctgcgccgccgaggccccgacgatctttgcctcgacgaccggctctgtgccaccactcctcgcgatcccctctcatcctccttcgcaccactattgatctctgccgagcgctgctgttccctccgccggaagctccaccgctgccccacgccgagacatcgacgcccgcctcgctaatcccgtcctcccgcatatttttagatagacccataatcccggccccgcaaaggaagtcgtgtgaaaaacatcacctttccccgccccccacaggggacccggcgggtgaccggggcctgcatcatccggatggagctaatacttcataaaaatattgcaatacacttaataatattacgataaaattttaatagcccccggttgtgtgggttggttgaaggaaggaaaggaattatggttgaggagaactagggtgttgagcttttatatgtcaattttgaatgggtttattggctctacattattgcaatgagctacttttagataagtaactcacatcggtggcccctccaagtcacgcgcggattaattccaatccccgcccctatccccgaaagtttgcggggccctgtccccactcacccgcgggtgagaattctcctcggtccccaccggatcccggcctcaacggagaaattaccaaccctaccaaacatcacacaaaattgagcagatcatctcccattcagactcatccacccaaccaaacacaccaagttaggacttcggatcgttttgatgggcctcgatctcggcccatttaggttagccagcctaaccggcccgtatcatgcttcggtttcagcccgtttcgcacggggaactcacgcgacgcaaccgccgccgtcctcctccccgcgccaaagcccaacgccggtgagggttccggttccccaactgcggcggcggcggtccgggcgctcccggagcggagcggagcccccgatggcggagggggagagggagctccatgtccgggccctcgacgggcggtccaccgtcgtcgcgctcgccgccgccgcctccgtgcgggatctcaaggccgcgctccggagctccttccctcccgcgcaggtctcccccagcttccacctcttcctcaaggtacgcccgctcgcttctcctttgcgtgcgagcttgatcgtgctggtggatggatgcggcctgcgggatgccgtgtgtttcgtctcgcttcacgctcgcggcattgaggggtttcgatagggtttagggtggtttcaccatttatgttcatagtaatggagctccgaaatgtgctaaccactagtgttctcgtgatgaagggcaccaaattgcgcgtggaggccgagattggcactcttgctgttggtgagggggaatttattgtccttgttccattcgcaaggaagtcgcagcagtgttctccggtggcaatggcagaacaagggcagattactgaatcaccaagatcatcgcaagtgtcaactggggcgaattcagctcggagaggcattacggataacctctcatcaatcccaagcagcccacatgctgaaacggcgtccagatatttttcgagtggggctaattcagcttggcaagaaattatggatgatctttcatcgatctctagcagcccacaggatgattctgcatccaaaaacttttgtgcccaaagcactatcccttgttctgggaattctgtagaggatgtgtcaacagatcaaaggttacctactgggaattcaaataaaaggaggaagccatgtaaggaaaatggaaatgcattcaacgaaatgcctacctctggagcgaacagtgctgctggccagcctagcatagataagaaaagtagcattgccagatctgctgcaacatcttgccatgtaggtcactctgccgttatatattcccctgccaatttcactttttgactttcacattcatagaagaaatccaaattgcagcctttgtgttgcactgttccttgagggaggaggcattaaccacaacatatattacatgtttgtttgttagattgctttgagtaatacgatgaaaattgcagggcacgtgccatttagggcctgctgaaatggttgaccatctgaaacaaggacttggaaaggagggacaggtattcactcaatgaacttctggaactaacaaggccagtaaaaccatagtatttatgttgttgggattatattttcagattgtacatattgaagagataccatgtcgagcggcatcttttgcagaacttcctaatcatctttcagaggctacgagggaagcattaaaaagtattggagtatctaggttgtacagccaccaggtattatagggtgtgccatctatttggtgcattcagttgtagaagctcaccgattatgttgatcatttacttgattgcagtctcgagctatacactcttccattgctggaaggcatgttgccattgcaacatcaacatctagtggaaagtctctgtgctataacattccagtccttgaatctctctgtcaaaacctgatggcatgtgctttgtatatatttccaacaaaggtctagacaggaactttctgttttaggcttgattgtctgaaatcgggcagaaattcatctgtttgttgctttgcaggctctagctcaagatcagctaaggagtttactcgagatgaagaatgcacttcacactgatattgatgttaacatatatgatggtgatactcctagagaagaccgtacgtggatcagagataatgcccgtctggtaaacatgtgcttctgaagatatataattataaacagttcgtttcttttttaaaaagtgcatttgaactcaccatctacctccttctcagttaattaccaatccagatatgctgcacatgtcaattttgccatgccatggtcaattccaaaggattttgtccaatctcaggtggaacttattggccttttgtagttttgttttcttgatagctaatttcatcatctgtggtcaattatcttttaacttttagatgaatgcttattatctccataaagagtttccatttctgcaatactatactcaggtatattgtcattgatgaagcacattcatacaagggagcatttggctgccatactgcacttattcttagaagattgaagcgcatttgttcaaacagtatgtataccatgttgaaccagttcttttaattgttagttgacatgatgcttatatatgctatataccataactgtgaattttcttgtttttgcaaatgtgttagtgttacttcagttttcttctcaattaccaatcatcagctacctaaaatctagtaatccctgcaatttctaacttctgagttatatcttggcaaatttatggaatataagaagtatgatctactgatgcaaattaacatataattcttaaaagcatttgcttgttcgatttgcagtttatggcagtcatcctactttcatattttgtacggctacttcagcaaacccgcgtgagcatgtgatggtaggcttgatcttctctttatgttagcttagaaaaaatggttgcacacaagaaaaaaaaaaccagctgttgttaactactgctctaaagcacaagctatcctccaaatgtgtttcttttttctgaagagaaatattattatcactgttgcttatgttttcgtgcacatactctttcgagaatattggccgaacaacaagcatttttccttttgcaaaattctgttaatcacaggagctagccaaactggataatgtagagctgatcgagaatgatggaagtccttgtggttttaaatacttcctcttgtggaatcccccgctacatatgacgaaggaggggagttcaaaagatagcttattaactagacgctcaaggtattgacactttcttttcccttgaattaagctacttatttattttcattgtatttttacttttcaaatttgcaaagttccagatgattttattatagctcaataactgttgtctttcagatatacgcaaatttgttcactggccatcgatgcaggaattctaagaagttgtcctattaaatagtttcttggcaggatgatttgatagtcaagatagagaatacttctttgccaacctgaatttgaaaattttgggccaggggccatactgctttgccaacttcatctctgtactgtcctgtgatccttgagtggcatgttaatttccaacactcaacaacggatccttttatttgatgagatacagtaattgttgtggacttgaaagcaaaagttatgagttcatcacagtacaaagggacgatgtttaatttttaagccaaaaattgtaaacatataattgttctgtagtggcatgtaaatgtgttagttattgcagtttaacacttcagcattttgtttcttatggcatgccagtacagcagtgtttgtttctatattcataattttcttataactactatgtgtaaagatacactaataatttgtatttcgtgtattagtccaatagttgaggtttcttatctattatctgagatggttcagcacgggcttcgctgcattgcattctgtaaaacaaggaagctctgtgagcttgttctagcatacacgtaagaacccattttcttctctgctattcatttttgtgttgttttttcttgttttacattacttgtattcacttatttcttcatatgtcattttgtattgtaggcgtgaaattcttcaagagactgccaaagaattggtagatactatctgtgtatatcgtgcaggctacattgctgaggtcagtattctgttctgtctcacctaatgtcttctttcattgtacttatcaaattttttattgtttcttagaatgaattttggtttgataaaatatgacctcatttagaatttcatcggtgctctcgaactgtatggattcacacaaactgcaatgtatattaccagcttttgttttcttctaaattccatctagtagaatatatatcatctgaatgctgtagacatatcaaagatggtaatgttactaccttctctacttaaaaagaactaagaacttctgttactaatgttacagtgtacatatgcaaatcaagctttcgttttgtcctcttgaagagtatgctgtttgttatgtgaggggtggtgcattgaagcgcttcccacaaaataaagttgtgtactagccagaaactgactcattttctgataaattgagaaaattctaccttctgatatttgcttgctgaatctgaacattttacggttcttcatgtgttgactgttttgttcctgttcatttgaaaacaaattatttcaggacaggagaaaaattgaggccaacctttttcagggaaaacttcttggtgttgctgccaccaatgctcttgaactagggattgatgttggccatatcgatgcaacattgcatcttggatttcctgggagtattgctaggtaagtgagaggtggtctctccaatggatcctatatttctgtctgaagccctactaagtcatagaaacaatttaattttagcctgtggcagcaagctggaagatctggaagaagagcaaaacaatcattagccatttatgttgcctttgagggccctttagatcagtatttcatgaaattcccacataaactatttggcaagccaattgagcattgccaagtcgattcacataatcagaaggtttgtacatcagattttgttggtaaatttaaatgcataaggatctaaaagcttccttcttaatttgaacatttattacagcttttggaacagcatcttgcttgtgctgcttatgaacatccattgtgtgtgcaatatgatgcggattacttttgttctagcctgaacagtgtaatgatggccctgaaagacaaaggctgtctcataaacaatccctctggacctttctcatcaagcatgtggagttatgttggacctgaggtttgttcctttttatttgttatctttacaatacaactcttttggttattatgcaagaagtattttggttttctgcagaaaagaccttcacaggcggtgagcatacgggcaattgagcatgacaaatacagagtaatagacaagttaaataaccggttactggaagaaattgaggaaagtaaggcctttttccaggtaccatgttctaaactgttcctcaactcaaacgtgtgatgaactgtcatacttgttggatctttgaacatactctaatgcccgtaaagagatagataaatttatgagtttgttgaagaaagtcataaaatttatgaactcataagcactatatactgtattgttacctaattgatatactaattatagactgcatctgccactgtgtgttttcatattggtaacttgctatctgaattttttaagcattttcttcattcttaggtgtatgatggagctgtatacatgcatcagggtgtcaattacttagttgaggaacttgatttgtcatcaaggacagcattctgtaggaaagctgatttgaagtattacacaaaaacacgagactacacagacatcaatgtccttggaggagagtttgtaagtattcaaaaggattgtgcattagcctcatatacattctgcttataatcgtctatcattataatattaatccctgccaaattttattattagcaccatttttttgtttaaatctcttctatcctgattttctaggccttatcctgctcattaaatctgaggattattcatctagtctgtcttagcactaacatcttcttttccatgccatgcttattttgactttttaaaactgttttttgagttgttttaactcaatctagttttattcagcctattttttcatctttgttgtacgttttccctacattttttagaagcccatactctcttgaactaatgaaacaggataggacaaatgtttatggtactcctaccacagtaataggtctactaaaatgttttaccatcatttagtcaagaaactttccttgcctgacatgtgcatgagtgatttccatgctgatatttaattaccaatgatctcttctactctaatacatcttgaaggctcatcttccaccaagtatgtgtaaaactaacggggtgaagacaaccgcccaagcaaatgattgcaaagtgactactaaatggtttggtttttatcgcatatggaaatcaaacaacaaaatatctgatagcatagagcttaacctgcctccatattccttcaattcccaggtttgtatctaaaatatatttgtgtgaaccttatcaatatcatggtgcattgccgtccatgattgataccctcatttttcttctgcgatgcctaactaggctgtttgggtgcgaatcccgcactcggtgaaaactaatgtcgaggaaaggaaactacagtttcgaggtggctcgcatgctgcttcacatgctctgctgaacatagtgcctctgtaggtttttcagttttagctgcatcataataaataatcattaatgcagatagttgaatgtgcatacatttgtgcaggcatatgacgtgtaatgcttctgacctaggaacagaatgtgcaaatcctcatgaaacccgtggtattccagacagaattctgttatacgataaacaccctggtggtatcggcatagcattgcaggtaaaatgtttgatgatgtgtagcatacccaggaacctagcgcggttgtaaatatttaccagcaatgctacctctgaactatattatctcgtttatgactatgagatgatattgttcgttgattcggtaaaggttgaagtctagattttcatttatttaatggtgtagatcaaatcactctttggggaactactacttgctgctttagaacttgtttcagaatgcaactgtactagttcagccggctgtccaaattgtatccaagtaagttccaatgctgtactaaactcaactgttgatggaaaaaaacatcttcaagatgataagtttctctcttttttttcagacactaacatgcggtgaatataatgaggttttggacaaggaggcagcaattttgattttgaaggttaataatctgtgcttgctaaagttacctaaccatcttccatcctacacctttcaacgtaaaattcgcttgctctaagatatatattcatgtgcagggagtaattgaatatgaaagatcatattttgaaaaagaagatggttccgaccaaggagtgagatgaggttttaacttttgacgtcttcgtgaagacgagtgaatttggttgacacaggagccatattaatattttcttcacaaggctttctccattggaaatggtagaattgtttggttatcatacggaaatgtagctctaaccagagttcccattcaattataaattatttctggttcaattgtatattttattttgttgccatcctgtaaccaccacctctgtttatcctgaaccaggtcatgggatccccaaattgcctgccacctgcgatccccaagcttctgtgaagaaatatgtcgaaagatttgaacctgtgattaagatatctgcagttttcccttctgatgagatggaagaaaccatcaatttctgctgcgggtactgcaagaaccacatcatcacgtgtaatctaaacaagcctttgaagagttggttgcaatgtttttataagttccatgtttattatctggttcttttaatctctttttgggaaatctgggtgttataatctaggagattaaccaaccacagcactaaaattcaaacttctcagaaggataatacgttgattgctgattaatgaaggatggcgaaaaaccatgtcatagagcgggtggacctgttgcttcatgtggtttctgcacggcagtgcccggcaagaaatgggcctgttcggttgtcgtactgctgcagctgttgtcgatgctgtagagattggtagcggctggctgtattgccgccacatttaggcctatcgggcaggcccaatatatactagccgtttaatagcaagatggttctggcatcaaagtttgtaaacggacgatgtaatgggttaccactaaataaagcaaggttgaagcatgaacataaaacaaatattgaagcttagtattcttagtttactacctttcatttttgttttgttgtattcctcaattacgaggcttcaagtttaggtaatatttggctgtatgtatagaggccagatttctatatattatgatcgcaaacaatgttaagagaattgttttagttggggtgcaccacgcttaggctgtagcgcaatgcttaaatgacactagaggacgctccctctcaaaaaaaaaaaaccgaagtaagcatatgctctctccgtcttaaaaaaaacctaacctattataggttaggtttttttagacggagggagtagctcacatgtaccgataagaacatatgctccctctttctaaaagtctaaatcctatttatttttcaccaaaaccaagtgtagttaactcattcatcatgtgataaaaccaatgaacatgcaaacaataaatactaaaatgacttcttggtttccgataaaaaatttaatatagcacagtgactacagataggacttagacttttggaaaaaccaacaaatgaaataggtcttagacttttaattaaaaggaggagtactacatttgatcttagtgaaaaggccgaaaaagatatgagtggtaccgtgtaaccacacggcctcttgtagtgtgcccctccctgcttgaatcgtcgatgtggtactactcatctccgcattgtccatggatgcgatacgcgatacatatacgacccgtgtgtgacgcgtgacgatgcgatgcacctcctctggtttttcctttttgtttcttccttgggttcctggctacagggaactaggaattttttctgattccaaacgaccggccttgccaggacaggctaggctcttggatccaaacgcaccctaagggaagctcgatggcatatgccactaccttaatttgcatgcagcttttcgcggttcttcgttcgttgacctccatcgatcgaggcgcgacgtgttttagttcggtcgagtaaatatcatcggtcggccactgataatatggatgcatgaatgcagccacccagacgtatccgttgcatttgcatttgcatgcatccatccaagtttggctggcctagctagctctccacatacgcattcgatcattttgcatattgttcgtgcaaccactgcatatgcaccgagcatttcatttgatttgatcgatcgatcgatgtggtgcgctgcccattttgccgtatgcgatcgagtattatatgcttcgtccaccacccaggccgtgatcgagtgatacgaccgctggcgctacctagctagatgcaatcacacaactgcaagctaatactccctccattctagctagttccatcatcatatttcaaaaaaccgaattttcaaatttgaacgttacattcgtagtcggcaagccgttgcatctcgatcgatctcgtccgacgtgctggccgtttcaattcgcacgcgaaatgggagcactccgcgcgcagaagcctgttgcatatgcatgcgaaattaatagcatttatagttgactacaagatagttggttctgccgcgatcgtcatgcatgcatgctggaccgttgacctgggagatgatatatatgtacatttgttatccttggtctttgcatcaagtcaaaatatgatgatcaaacttaaatacactagaagataaaaacgagtgaaaacggcatcatgtctataaaagtagttcttggttgattgggaattttccgtatgtactaatctactagttatttagggacaatatcaatatgacaccgatagatttttttttaaaaaaaaataaagttagcattcctcagtttagaaaaatactacatgacggtataccgttaggacagtataatacctctgagatatcggccaatataccccgttcagacgggataatacgtctgaggtatcgctgatacttgataggtatcggctgatacccaaatattggacaatatttctgaggtatcacgttcaaacgggatatcatcacgtagcattttccgagttacaagcctttgcacaattcgcctctgctctcgataaaacaagtcagaatcaattggcaaggggtcgacgattacgagaattgtttagaatcggagatggtactacttttgcgaaacgacagtcggttggtggagaatttcctccggtgttccattacgtgcaagctaacgttatcgttggctggatgaattgagcactagctagcaccaggctgctatatagcaccggagcagctggtgtttttctgcgctggatcgaggccgtgcagtggtcaaccaactcaaaggcaccggccactgatctatagtacttactttgttgtgctcctttgctactagcatctgccactgctgatgatcgatgcagttatctagctagctagtcctctcttgaatatctcgtcaaattacactgttacagaaggctgaaaatgatatcgatcgacgtcgtcgtcgccatcaaaatggtctgccgtgtactgttcatatatatagtggttgacctgtccatttatttttcttatggtaaaccgcaacccccttaattttcgggggaaaagatatacgtgtacaaagaaaatttgcaaatgttttagatgttgatgtatcacacactgtaagtaaaatcctgattttctttattacactttcaactaactaaatcgaactgtcaagatctttgtttgcaagaaattgttcaagtatatatgtatatcacttctcttaattttctccctggatcaactcaagcatgcttgcttgtagttgtagaaagtctcggatttttcctttgctttgtacttcttctacctctaaatacaaagaattttaattataattacaaatatgcacatgtccagattcaaaaaaaaggtgggcaagcgaaaattgctcttgcaagagcaacatcaagatataggtaggtggtggcagtcaggtaaaggtaggggtgaaaacattatgaaaatttcccgaccgtaccgatacctttcctgtaaataatacaataataatatttttatcgactattacagtttctaaaatttagtttttctaacttctatcaatgttgcgttgaaatcaacactaaatagtaaaattcataaatacatatatttcttgaccgtttcggacttctcgaaaaaaaataatattgtttccgaccgttttcgtccataggtagaagcccttgctcagatctgactcaaaacaagccccagatgctgccagtacaagcaagcaagcactattacatacaggtactgtacctgtcatccaattagaccggggagatctttccctggccaatggaatccagcctcacttgaccctgcccccaaaagcccagtggaagaaacttccacagtacacatatcacacacactagtgctcactcaattcaggcttcatccatccttatcctccctgcctttttgcctggccctttcctgctgcctacttgtctgtgactgatgaaagctaagtgcaactaactacttactactctatacttacttgctgataagctgattcatgccatgctatgacagggaggatatacagcaacaagaaaagcaaagaaaacatactgcatggtgacacctagcttgagaattatatatataagtgcttaattaagcagcattaaacttttatgttagcactgcataaagtatatgtagagggtcaggtggtgactgatcacagatcagcaatttggatgtcatgtcattgcttgcgcattaaggatgtgcatgcaagcttgagta

SEQ ID NO: 11620 - DNA, 710 bp, Oryza sativa
gccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccggaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcaacccgcgccgacacgcgggccccacacgttagcgggtcaaggagcttcgtgcaccgtggaccgggaccacaa

SEQ ID NO: 11621 - DNA, 690 bp, Oryza sativa
ggtagacaccaagtgaattagcatattatgattaagcattcgaagttggggttgcacaaactgaactagcgacgaaactacgatgacagaaataactaagcaaaacccaactctaaacgataatgactactgaataaatatgattagggacgctatagggttagacttaaggcgtctatctcttggatttagtccacgacctgatcattacaagacccaatgcctaaatcagagtcgggctggatgaaatatgtggcctgttttacagagtcccgactaccgaggaagaattttagcgtgggaccaaaaacatataaaatcagaccctataatctttctagcaagtacacatggactgtagcgcccgttccgtcgtggcgcctagcgggaaaattaattcctaaaaaccctaattgcgaaatttgtttcttcgcttgtcgtctagtgtccgtgccatctcaagatctcaaatccccgatctatcgtcgagttcaattccgaatccaaatccttccaaatcaaattcctccgtaaaagtctattttgactcccccggggtcgatgggccgaatttcgctcggaccaccttctcccctcccccggcgcgctcccgctctccctctccctctctagacctctcccctcccccggcgcactccccctccgctgccgccgcgccgagcgcccccc

SEQ ID NO: 11622 - DNA, 1349 bp, Oryza sativa
tttggccgctagccggagcgccagctcgcgccttgaccgccaaagtcggtttccaaaccgacattgccgccccctataaacccaggcgccctcccttccccttttcccctcccaatcttccctgtttctcgcccgcgccattgccgtccttctcgccgaccgcagccgtcgcgtgtgtgccggaggagccggtgcgcactaggacgcggaagggaacttcggccgcgccctctccttcctcttctccggcccgaggccggagagattactcccgcgccatcggcctctcgtcacagcgccccgacccgcacggtagtgcccctctccgttcttcctcctcgctccatctcccccttagtcttcggtggtagcacgagtagactccccgtagctagccggcgccgccccaaccattgccgtcgctcgccgtgtgctcgccaccgtcgccgctcgagctccgtagcacccgcacgtcgccagcctcgatcggcgtagctccgccaatccgacgctagcatcggattcccgtggccgcgtggatgctctcaccgccgggaatcggcccctcgtggcctcgtcgccgtttccctcttccctccccgccgggttgtcgccgccgcgattcgccgccgtcaagcttcctccggcgaatccgagccgttggctcgtctcccctcgtctcgtgcaaccacccggcgtgctcgctttcgccggtatcgccgtggttcgctccgccgctcgccgctgttgtccgccgtccgttccggccggcgtcgtcgtctacctcccgccagcccacgtggcagccacgtaggcgccacgtcggcgccagctcagccgaggtcgggacgggccgaccccggtcagcccctcccgtgcgcgcgttccaccgcgagccgtgaggctgcgcgtgggcccgccgcatccgttcctccgcagaccgcgcgcgtgcaccacgtccctcccccgcccgcgcgcgtgcgccgcgtgctccctccgcacggtgagccgagccgctgacaagcgggtcccacccgggaccgcgcacggtgagcccggtccaccggccctctctctcctcccctcccgcacgcgcgcacttgggccgccttgggccggccggcccatttagctcggccggtccgctccttttcccttgggccgcgccctaagccgcccgaggaaaagtctataatccctccctctttccttttcttttctttttcttttccaaaaaggatttaattaaatccttttcctttagaccaaaaatccaataatcttagaaattcaatatcttcccaaccgtaaatccgtttgactccgttcaacttccaaaattcctcaaa

SEQ ID NO: 11623 - DNA, 853 bp, Oryza sativa
cccgatcggcttggcccgatctgggccgtccatcccgtggaccgccggaggaccgtccttgaggtcccggtccacggtgcaccgagctccttgacccgctgacgtgtggggcccgcgtgtcggcgccggctgccccttgctgacgtcagcgagatcctttttcctttgtaaaaataattaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagtttagaagatccaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctgtcctttgtcaaccttgggtgataaatcgactagcttgtgttacttatgtgacctagctagaactatatgcttagccatgcttaattaccactagctcagttgatggggataaatttaaccaagggtttttttttttaaaggggagaaaaaacccccccccccttttttttctttagatcttggtgagctgcgtgctcgaaacacctggccatgttttatggtcgtaattattccaactaaaatgcgactgaa

SEQ ID NO: 11624 - DNA, 528 bp, Oryza sativa
gttctaaactgttcctcaactcaaacgtgtgatgaactgtcatacttgttgtatctttgaacatactctaatgcccgtaaagagatagataaatttatgagtttgttgaagaaagtcataaaatttatgaactcataagcactatatactgtattgttacctaattgatatactaattatagactgcatctgccactgtgtgttttcatattggtaacttgctatctgaattttttaagcattttcttcattcttaggtgtatgatggagctgtatacatgcatcagggtgtcaattacttagttgaggaacttgatttgtcatcaaggacagcattctgtaggaaagctgatttgaagtattacacaaaaacacgagactacacagacatcaatgtccttggaggagagtttgtaagtattcaaaaggattgtgcattaacctcatatacattctgcttataatcgtctatcattataatattaatccctgccaaattttattattagcaccatttttttgtttaaa

SEQ ID NO: 11625 - DNA, 575 bp, Oryza sativa
ttgggaggatttgtggcagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgctcacgcggtgatctacgcgttcagagggggtgtgcggcacaaccgcatgctcgagaagatcgcctccaaggagccccagaccaccgcggagctttttcagctcgcggactgtgtggctcgcaaggaggaggcctggacctggaactcctccggttccggtgtggcagctccggccgcccccgggtccgccgctcggtcagggcggcgggacaggaggaggaagaagaggtcggcccattccgacgacgagggtcacgtcctcgccgtcgagggtgcttcgcaggccacccgaaatgggaggcctgcgagcgacaaaaagaaggaggccggcgctcccagcagggaacgcccgaccggcaagtggtgttccgtgcacaacacctccctccacaacctcgcggactgccgcg

SEQ ID NO: 11626 - DNA, 795 bp, Oryza sativa
cccgccgctgcgcgccctcgcgtccagctcctttgcccgcgcctcgagctcagcggcccgctgatccagtgcggccctctcggcgcgggcgccttccagattgcggcgcgcctgctcctcccgcgctgtctcgcggagggacaggctgtccgccagcctttgcgccgcggcctcggcctcctcgagagctcgctcccgctcggtgagcgcatcctcgcggaggcggagtgcgaactcctcttcggcacaggcggcctcgtgcgccgccagtattgcctcccggatggcgacggcggcctcgcggtccgccaggtccctctccttcgcgcgggcgcgctcttccagcgccgtggcgcgagcctcaagggcctcttcgcgccgccgggacgccgcctcgttctccgccgcccgccgttcccgggcagcggcggcgtcaaggaccccccgtgcggcgtcgagcttcttccctagctccgctgcctggctcccgtattggaggcggaggtcgtcccgcgcctcggaagacttcaagatggtgatccaaccggtgctgaatctcagctccgtggaggcatccctcatcccccaaggtgtcctccccctctgcagcgatccagagcgcgccaacatcctgaccatcatgcaggcggtcggggcgtcaggggagcgggcccctcgaggccacgatggcgcgggcgtgagccacaggggggaacaatctaccccgggagggggtcatgcttctaggccccgcgacgggagcagccgccctgccgacgcccgggggaagaggaa

SEQ ID NO: 11627 - DNA, 1971 bp, Oryza sativa
  unsure (1)..(1971): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattgtgaatgtgctgcagatatttaggtccattctttttttagtggatttatgttggttctaaagatacgctgaacctccctcttaacctggacctagtcctaagagcaaagttaatagtatagccaactactagctacaattcatctataactaatctaatagttaattcatacaatagttgcttactatactattagtatatagtcccactgtcatatacacattatgtcttggagtccgtgctgcagcgggctacagaagctgttcttctctctcatcttttatcttattaaaatatgtttgtagctggctaatagtatgctattgtacctgctctaagagcacccgcaatggtaaagtaaggtgctctctataaaacatgtatatctcagtaatagattagattaatagtaaaccacctcaatagtatttctacatgggtatctatagctctctcatccattgtcttgtttttctctatagactctccaggttagtagatagctttactctctctctccatttaatctcttacaagtaggaaaatacgattatcttttatagagagcatatagataaccattgcgggtgctctaataacactagctaagcgcaaactccgagttatccatttcgcagcatttaccttgacggagtggacctgaaacgctaaacgcatgagcaaacgtgtacggaactcctttggtcaatcgttggattatccatctgaaactccttttgttttcgccgggatacccgtatgaaactcctgcatccgtcgccttcattcgcaccggtgataccgtactcatttggccggcagaccaaacatagtggattagtggacacttatgtgttgagaataccgtgccggtcctttgcgaaagcacatgtaacgcctaggaaagcaaggagcagaagcaatctgcttgtcttgtgtgcgacaacgaggccagtgcgttgtcctcgcaccaagcgaccgcctcgccgccgattgttccgtgcgacgccacaccgaaaccgaaccgggacaacctatttaatctttcaacaaatttaaaccttcaaatcttgaaaagttttcaaccaatggatgcaattcattttaaataaaataattaaaaagcatatcaaaaataataaatctagatataaaaagagttgtataatctaattccactatacttacgtagataaaacactgttttacgtaaaacgatatggcattaatgtataattaatagagttttaattatcataaccttaaaaatttatttatagcaactttcatataaaaagttttttaatgaaatataccgtttagcagtttgaaaaacacgtgattatctaaatttttatccaatttttattacataaaaaagacctaaatttacaagaatattctctctctccgtcccataatataagttattttggagagatatttattttggagagatatgacacaatctaatactaccaatctagagtaccagattattatgatacattcctttaaaattaattatattttgatataaaatcctacgaacgaaaaatacaaagacagaaaaaacgaaccgaataaacccaagcaaagcaagcggaaatccccgcgtcgcgttaaccttctcgcccgcggtttcttcccttcctcgcggaagaagcccaccgttccttccgccacgcttcaagcaaccgctcacctcccctcccctcccctc

SEQ ID NO: 11628 - DNA, 45920 bp, Oryza sativa
cccctcccctcccccaccactctcaccaaccacacccccccaaaccaggcgccttctggtgctctgacgcgcgtggatgccgcggcggacggcgagcagcgcggccgcggcgcccggccgcggcgggatggagtgggagctggagcgggagatggtgctgatggcggcggccggcggcgaacaccagaagaagcagaggcagcagcagccggcgcggcgggcgttcgccaccgacctgctccagaactgcgacctgcctcctcccgcgaagctcttcggcccgctccccactctgcaaaggtaggcgccgccgcgttcccatctccctctctcacacgatcgatgccgtggaattcgcgagtgtggcattgcttagagcggcgcggtgtttttttttttgttttttttaccctttttgttgatgtggaggttggagaacgcggcggcgtggacgagcacgagcccggatcggaagggcggggacggcgaaggcggtggtggtgacggcggcgaccgcctgatgcgtgcgctgcggctgtcgcagtcgcgggcgcgggaggcggaggagaagctggcggccgccggggcgagcaacggcgagctctcggcgctgctggtgcgggactcggtggtgctgtcggcgcaccgccggtgggtcatgatgctggaggccgagaactccgggctcagaggagcagcaggagccgccggctcggccaaggaaggcgtcggcgaggacgaggacgaggacgacgacggcggcgcccggcgcggggccgctgcgtggtggctcgcgctcgccgtctgcgtcggcattgccggcatcggcctcgccatgggcaagctcctctgaaaactaaccgtttcttcacctttttgttaaggggaaactgcacattggaggatcagatcagacatcatgaaaatccatcgttctacgaaaaaattctgcacaaaaaaaaatgttgctagcatctggaacatttcgatgattaggaatcacttgtaaatgatgaacatgatgaacagagaggggtgatgactgatgagaactgtagaaacttaggaatcactgttttcagaaggaagttgggttgtgactggtttggttgtgaagtttgtgtagataggattatcatcacgcaaaattggcatcatttctattcccaaagagaagcttggatgatggggaatgggctggaagatgccgtatctattgctgcacgctaccacattcatgactgcgtctgcgtgtaggataaacttttaaaagagagtagtaataccttgtttggataatccgtcccaagataagtgtaggataatccgtcctaaaataaatgtagttttgcatcgttcgtgtctagcggttgaccgtttattttatttatttttttattgttattagatgataaaatatgaatagtattttatgtgtgaatattttatttaaatttttgtcaaataagacgaacggtcaaatgttaggcacggatatccaaagctacacttattttgggatggatatagtatattgtttggataatccgaagaattctatagaatattcattgctccctccattccacaacttagtacaaattctatcttaactatatacttataaaatatggtatttacagctaaagagcatgtctaatggttgttaatactgatctctcagtgttgattaggaatattcgttgacatggaaaaaaaaggagacaaaacatagttgctatgggtaataacggttcaacaaccattcttagtctctataatatggaaacacgattgggtgagagtaaaaaaaagaaagaatagtaaaaggagaatatttttagttaatttagagcctttttgcctttcaactattattataaaaacacgaaaataattttgtattatctcagagattatactcgtctctgccgattgactagctcttggttttattaccaagttaactaatccaggttcacacctcacccacacaaattttgacaatttgatcctttgaaaaagctaattttacaaatgaaccgccgccaaaacttatttaaaaaatgactttttttcagcgccaaatcatatggcactgaatttagacatctcagtgccacgtcaactggcgctgaatgccttgccaccacggatggaaggctaagtcagcgtgccaacgtacattcagcgccgtactatttagcgctgaggtatctaagttcagcgccatacgatttgacgttgaacaaaagggtcatttttgaaataagttttggcggtggtttatttgtaaaaatagtttttgcaaagagttaaattgtcaaaatttgtgcctcaaccactggtggaggcaaaataagtatttccaccctttttaatagctttgtttatgtagaatgttcttttattttattttaggatagggaaagcagctcagccgagtatcgttgctttgattctcttgatggttgtatctctgctgctcatacggcgcaagtatttctacaaaagaaaaacaattgagaatatatctatttgtttaataatttatgtttatatatctacacgggaagaaatgtcacaaatatacgagctccgcagattgaatacataggagcaatcacaaatcgcgttgcgggaatgcgggagcgccaaccagggtgttcccgctgaacgagcaagcagaaccgctagtccgccacggtccggtgggctgaacttgcgggaccatgacggtcctgcggaccaggagtgcggcagcgtggcttcattgcgtggaaccaactctgtgaacagtggcaaacaatgttagacggtactcaatagtgtttttgaacaatattaaaaacgcatgtacgtgttcagatgccggtgccgcggtgccgtgagaccaatccacaggaccacgtcggtcccgcgcaattgccccacgacactacccctcttgtcggtttcgcgccttcgagttgcagtgatggcgcgggccgcgtatgtggaccgcgggaaatgtatatttctataaaattttcatacgcatgtatatatatgcaaaatcaagaaaattacttcttccgtcctaaaataaatacagttttacactgttcatattcaacgtttgaccgttcgtctttttttatttttttatgactgtacttttattgttattagataataaaacatgaataatactttatgtgtgtctaaatttttgttagctttttcatattttttttcaaataagacggacggtcaaacgttggacacgggtaccaacgattacacttattttggaacggagataataatttatattttaaaatttaatttgtatttctactacttaaacatggagtcatcgatcctttccccacctcgtgcaaagcatggaacatccaatggggattttctgcggtaccgctagtgcggtagcagtggctgatgtgtgggtccggacccacatgtcagcctttgctactgcatcagcagtactgcaaaggatctgtatcctggactatcaccctaataaactagaaaaaaaatcaaacgacaaaaaaaagagagcaaagtatatatctacactcacaacccatcctcaagtcatgggtctagttcgttataattcacggatatattactaatgggagataataggatgggcctatacaaagaaatatatccgaaagacttggtggatattttgagtaattgctatctcgatgattaggaatcacctataaatgaaacatagagttgtgagggtgaaatatgtagaaagatactaggaagcgcaattggatttgtggggatccatgccattataaatttatctgtttggaaatataccactataattcgtgaaattaaaactataccattacaatttaacatgtatttaaggggtagcactgcttaccccttcaatgcaatttctaagtttttctgaccaaattaccctcctttctcaatcatcttcttccttccatgtgctctcgtcgtctgctggtcatcgcctcagcccctggcgagctcgtgcagccaaccgcagcgctgccctgacgagctcatgcagcaggcgtccacgacgcacgaagagctgctgctggaagggaccggcaggaactccaacgcatatccagcgaccttggtccaaagcagcatgggcgagttcttgttgcagttggacacgagctcgatggctcccgccgtccctggatgtgctccatggccgctgcccacaccagcaccgacgcccccgccgttgccacccccaccccccacccctcggctgccagatctgagtcctaacagcgacgtgcgtccaggcgtcgctggcgtccgctggtcctcctcgcatcactggcatcatccggccaaccaactcgcgtcgtcgccgccgtccggtctgccatcctcacgccgtcgtccgctcgtcctcttcgcatcgccgccgctgtcctgttgtcctcctcgcgtcgtcgccgccgtccgtaaccattctcacgctgtcggtgtctgcccatcttcctcgagtcaccggcaccatctagccatcctcattgtgtcgccgccaccgtacgctcgccatcctcacgccaccatgttcttctcttcctcctcgcgtcgtgtcctctgctcgtcctcctcggcaggcgggcggggcgcgaaggagcgcctagaggcatggtttaggccggaggaggaggagcttcggtggaggcccaggcctcactaggcgtgagggagagaggagagagaagaggggagaaggaagaaagggaggagggagcaaaaagacgagggtaaaatggtcaaaataatttttataaatacactgaagaggtaagtagtggtatatcttaaactgttgtaaaattataatatcatcgttacaaatatatgaattataacggcatattttcaaactgaagaatttataatgtcatggatccaattaaccctcgcataaagggagtttggttgtggttggtggtaacgtttgtgtagctaggatcatcatcaggcaaaattggcatcatttctatccctgaaccaatcgctgattcgctgcacggtgcacgctacgacgactgcgtgtagccgtgtaggatacactttgaagtcgcatcctgtttggatccataatcggaaattcggaagtctcaacggaacattcaataggttatatctttatgagcctcagttttcaacggaacattcaaacgtttaatatgatagggtgtaaaatttttacgtgggaagtaaacatagcctcagtttgtacgagggaggtcagacactgctaattgtacatggtcccacaagatcgatgtaagtgccgaaccaaagtaaaggtttgctttcgtgcacggccggtaggcctatagggacgatccactgatttggtcatcgacatcttgaggaataagttcatctgaggtcccttaacttgtcaacgaattcgacttttgtccctcaaccgaaaaaccagacacaacgggtccctcaactatcaaaaccggtgtaaattaagtccctcgatggtttgagggtggttttggctgacatggcgcctacgtggctaatttgacttggtcttcatctgacgtggtgcttacgtggcaattcgatctagaaaaaaataataaaacccatgggacccacatgtcagtttcacacacaaattaataaaaaatggtgggggcccacgtgggacccacatgtcatcctcgcccctcctcttcttcttcctctctccccgactccccttcatctctctcccctctcctttgtcctctctctagacgcgagtgaggaggggcggcgcgcggcggacgacgggtgaggagggagcgacgcgcggcgccggcgggagacggaagagttggcagcggcgcgcggcaccagtgggagaggagggagtgactcgcggtggtcgacgagatacgggaaagaagggagtggctagaatgagcgagctcctcgccctctccactgcgccggtgctccacgcgcagctccagcaggcggaggctgcggcacaggcgaggggcaaggcggtggaggacgacgacaacccacgccggcgccgcggacgacgtcgagcaaccggcggccagcccacaaacgacgacacctccttctcccttttcccctctcctctcgtcgccgtggatccaaagggaggagacggcagcctcgctccccagatcagcgtcggcgactcggcggagctcggcctaggcgtcgatgacgccgcgtggccacgatcctagcatttgggatggcatccgctgagaaaggatcgtgtccgcgtaagttgggtcatcgtgcccacgttctgtaatcgcgtatggataaaagggaaagaaacagaaaatgtcgcaagcaagtaatatgcagcgccaaaaagactttcccaattggtttgttcttctcgcgtccaagcgtgtgtgtgtgttgcaggtttcactgcagttgccggagtttagctaacatcgtcccccacctcttcattgacggcggcggggattaagacgacgacgacaatggcgacggccgtgaggcggtgccgtggcgcgaggagaagcacccgaagacggccaatacccatatctacaccaccattgacgcaatcccggtgctgttcaatggtttccctctcctcaagggtgtggacaagccgtactggttcgaggacaccgacgatgacggcggcgtcctttcagcctcatcccgtcgccatctccaggagctcgcctgccactcgccccctctctgcccaccgcccctctgctgtgcccgccacctctcggcgctgcggtgccgccgccccttgcccgtcgcttgtgccagcttgctccagccgccgccgcttagctccgccggccggccactccgctcagacctgctccgcccaggtgagagagagagaggatggagagaagagggatgacatgtggggccaaatgggtcccaccatttattattattttgtatgtagctgacatgtgggtcccatgttttttattttttaaaattaaattgccacataagcgccacgtcaatgccacgtgggacgaagacctagtcaaaggagccacgcaagcgccacgtcagccaaacccgagcataatactgccgagggacctcttttgcacggttttgtaagttaaaggatgtgttgtacctggttttgcacttaagggatgaatttcaaactcggcgacaaattgagggacctagaatgaacttattccacatcttgattggtatgttgggccgggcccgtcaggccatgggccaagccgatgccaggtcgtaccatcccggcctgacgcggcctagtcacctgggctagcacaatgggagggctgggctttctgtgccgtgtaaacggcccattcttctcgtctcttcggccttgagctctcgaggttcccttaattattttccgtttgccttttcagttcccttattctacatttggtcaattggctgctttatatattttgagaagaaagtgaggaattgcttcgttcgtgctattatagttctcttgatccttcttaatatataaatccggaccaccagaaaaaaaataaaaaagaaaataaaaagtgaggaattggattctgcatcgaccaatctcctttgatcattttctatatacgaagggcaggcagtggtaggtggcacccttgctttggcagcttgggggcaccttggcagtcaagcgatgccatggccaagactaatagctcgattccagactttcagtagctgcattgcatatcaggttctttgatttttttttcttccttttcttctaaagctgcggtgttttaaccttattctcggcattgctgcattctttataggaaccgaatcccgtgcacattaagtttgacaaatttatactctaaaaattgtcttatattattgtatggctaaaatataatgaatgtgaagctaagacttaacaaatactcctatatacatatatagtacattttgagttcatgtacattatttttttcttgaattttcaataatatttgctagttaggtgtgcacatacatacgtacatttggttttgtgaaaatacactcactgaaggttgatatggatctagaagatgtgtgaatcatgtgtggttcttgtaaagtaaatatatttggattatgtatcagcgtatcactatcaaccatgtatgtcgaatatacttatatatgtacataaacaatggaggagcaatttgcgctcccatgaactgttaataatctgactgaagagtacttataaaaacagcccatattagttcatggcttacgtatgccagacgacgtgcaactgcaattcttacattgacctgcacatttcctcccttcccaagcttcaaggacggtcaacaagagggtatcataaaaaaaaatgaagctaaaaatattattggcaatttggcatgcaactaacatgtgttctagcacagtagcagggaccttatacaaattcaactgggtaaaattattgccaagcaactatcatgtgagtggcactgtagcagaggccttatacaaaataattcgacagtatgcctttttttcccccttcaaattcacagtgctaagcgtgtgcaagaaatggttctttcaggggtgggaaaagggaaatagggtgtacggtacagccagtgaacaatccaaaattttcttctctgaaactagtatttttaaaaacatattcttctcgatcttgaatcatttcatgaaccttccaaaattattcgtctcctgattgaagagactgacataaacctaatctgctgatctctatacagagatgcgttggcactgtttacatacaccctgccggccatgatgttatcccatacggcagatccttcctttcggtcaatgcattaggtgaaaaccgagtcgtcttacatgcatgctatcacatatatagattgcaggagcagatcgaacaaaatgattaggtcaacatgccgtgtgtccatgtggatcggagtacgctagaaatttttaacctggaagctagagttaactgtgccattagcaaaagatcactttattaaccttgcaaacggcaaggtcaaaagctctttccaaaaaacgagaaatatacttttgacattttgacagatgagtgagctagcactagtgttcttcctgcttcgactactaccatatatgttgccttccatttgttgctcatgccactacaggcggctaaagaaacaattcacatgcattatgttattttttttcgcaaattgcatcagttacctaaccactcctcgttctgccatagtttcattagtttaatctctagtttaattgagctttctgtgcgttcattaagtaaagtacaaggacaggcaggccagaagtattctcgttggaccatgcatgtattaataagcagcagtgccggtatgcgtagtatagagtaattcgtctgaacctttctcttttgtgcaatgtgcgcggagaaaagaaatgcatggctgtgcttgatgtcgaccattgacgatgacccacctaccgtgtatgaacaatcgcggaaatagaggataattagagataagggtagacaaacttggatggaccatgatcccgaacaacacttggcattttggcaatgatattagggcccacatgttaatgagcagtattgtagtatgtattgtagtatatctctgtttccctattttgccaattccttttatctttgtcggttatgtttctataaaccggttgagtagataagggaggtttcgtgtctatatgtactccgcaccgatatcaatccaattttgtgttgagtctattccgcttttatggtatcagatttttttcgatctaccgctctaagcctaactccaccaacaccgccatgtcgacggctacctcccccctcttgccagagtccctcgtcaacgttgtttccacgtccgttgccgacgccgtccgcgcgtcttaccaagccctgcccggctcgacaattgatgacgccatggccaagacggtcaccgactccgccgctgatcgacagggcatccgccgccgacccgccgtacatgctgccctcaaacagcacctgccggcgctctccatagcgcccaccgccacctcgtctctccccaccatggacatcgctccttaattatctctctcggttctgtttctataaaccggttgagtggataatggaggtttcatatgtactccgcgccaatatcaatccaattttgtgttgagtctattccactttcagtttggttcatgagatgcattaagtctgaaaagtaatatttcttgaatataatataagggttggccttatctttaaaaaaaactagtggatcaatccagcccatttttctctatcactaacatgtgaaccgtcacttaaaaagtaggtcattttatctctcataccaaacggataaatgcgatcttcctattttcgaaatatggatgagttcaaccaatctcatctcgttctgaaatcaaatacctctgtgtaaaaaaaaaagcggccgctgtattttttcagtagatgaaggagaaaaagaaattcggaattctgaacgttcgtgtgtgatttgactgatttatcatctgaaatatctgaatgaataatgattaggatttctggaggaaacgaagaaacgagcgagcagaaaatgagtgaaaaggaacgaacacaaacgctgaccatcctctgctgcgtgtgtaaaactgcagccctgtccaacaaagcggccggccgcgtcgtccaaaagactgatcgctcatcgatccgtcacatgcaagttgccaaccatgcggtgaaatggtgatggttctctataaaaagagacccttccaacctcaccctgtcaattgtgcagcgagacaccgatagctagctaactaatcttccccttcgtctccggcattattccacttggacgaacactagctcaccggccggccatggcgtcttcttccgttctgatcaagctgctcgtcgtcgtcggctgcgccgccgcggcctccgcggcgacgctcaccgtgggtggtagctccgggtggacgcttggccagaactacgatacttgggcaagtggccaaaccttcgcggttggagacaagctcggtgagtccttgttttcttttggcttaatttggtagtagtgatcagaatgtttggaatttcaggctggaatttagtcatatttttgttacaatttcttgtttcatgcttttctatacatcaaaagagaaacaaaagggtagaaatttattggagggagtagcacataagtgtacttcttttgccgggtcggccgaccaaattccattaagatagagggtatgcaaatttataaacctgtgaatttcgacaaaaaaaaaagctatcaaaaccgaatggagattggtacacaaacaacctcccgaaaacagaaaaatgtgctacggcttggctgttcctctcccaaatcctttaaaacttcagcttccttccagattatgatttcctctttgacgattctagaacacgcgtgcattcctttccttccaaataagtggagtactaattaatactcgtgactaatcaagcataattggtaatttcccttttcagtgttcagcttcgttggggcgcacacggtgacggaggtgaacaagaacgattacgacaactgcgccgtcgcaagcaactcgatcagctcgaccagcaccagcccagccaccctcgacctcgccgccgccggcatgcactactacatctgcaccatcagcggccactgcgccggcggcatgaagctggccatcaacgtcggcagcggctccggctccggctccggctccgggacgccacccagcaccaccccaggaagcagcggcacgccgccggccaccccttcttccccctccaagccgaccggcggcgcgtccgccggcctgcaggccagcgccgccgtcgccgccgccgccggcgtcctcgtcaagctcgccctcttctgatcgggcccacctgccaggatagaggcagtgcatatgattcttgtttcttgatcatttcgtctgacggccggcatgcatgtgtgtgagagagatgagtggtttgctagctagctagatgatgatggtgatgatgatatggggttgttgttccgttccatcgtgtacttagtactgtaattacgagctgtcatgtgatttgttttctcatctccatggatttgtataattttcctctgaattttatcatctgcatattgatcggacactctatatcactctatatcaatcttgcaaaaagaaaaaccggtggttaaagtgatggttaacggattggtcatgctgagcaatgcatgatctaagcttgcctaggccgatcactgtagtaagaatgggaccagaccgacctgaaagaagagcaatgagacgactactaactactaggacactagcctagaggaaaagaatcgaataatagatcgaagggcaggtagtgcgtcgttttcagagaagggaatacctcacatttctgcttctgttagaacaaaagtttcctgcttcaacacctgctccgggggtaagagtcagacggttagcttaggtaccaaagttctctgatgctaattagccgtgcttacctttgaaatgagcaactgaatctgtcatgtcagtgtctgaaatgagacgacgacgacagtggacacggcggattcaacttcttgatttctttagtgatggtgggagtaggttgggtttggtgaggaggaatacacctttcaatctcaaagcatcaaggcggtgtgtatagatgactagatgagtgtgtgccagccgcctcagactccttgaacacaaggaaagaattaaactccttaaagaaagaaaagggttgagacaatgagaccgtccgtgatttggagtatatcaccgttccagagtatcagtcattgtcatacaatttgggatattaatttgttagcgagaagatcacaacatgttcgttgcaatttttcaggtctctttaccagactttggtagaccgcagtgagagctccaatccaaatgacagtaggctgagaggtaaagagaaaaaaaaaccctcaaaactaagttgacttgtgtaaaactagtttcgactactcttgagtataatgagttgagtttgattttgaacttttgcttcgtttgccaatatgtgttcactatttcggaacctataaatatttcaacgacaagagaggaggggttgctatatcagagactttgaataataattaaactcaaaatttgaacactttactttaataaaattttttgttaagttgcatagtttcaagctgaaaaaaaaatcctattggaactttatttcaaacctgaattttgaaactctagatctcaaattgtgagacctacaaggttgcacaacacaaccattacgagtgtaaacacgactggtcactggtagatctatgattcaaaattatcattttaacctctactcaatctgctctatattatagttcatttttaagtttgtcataagtcaatatttttaatttagtgaagcttactgagaaatataccaacatttttaacacgaaacaaatatactttaaaaatatatttaataaactaattttttattataaatattatcatgtttttctataaacttaattaaattgaaaaaaaataaattaggataaattggacggaatatatcgatcggatgaaaagaaaattgagatgaaaataaatcaaataaaacagtagtgagtagtagcactagcagcttgctttctactccctgaattgataagtggtggatatcctcgcgtttcattggtgcgcgctggaattgtgcgtgaatattataattccgttgaaccggtcttcgcgtgctggaaattgtgcggctactggcgttgggaatccctggcgttggcgtttctttgcggttttgacaacgaccagtcgactattcacgacgacccggccccctaccatgctgtccatgcatgatttttttcgccggactggcgtgaagagtgtccatgcatgatgaactcgatcaacccaaattccaaatttgccatcccaaattcccaatccctgaacacacggcctgccccacacacattggctgcattttgccatgcaaaataatgtgcttctgattttctgaacctcgcgcgtgcgctttatccaaaatgagaagaatacgcgttgacagacaactgcgccagcttgtccatcttggcggccgataatggagtaatggtggtcatgaggctctttttttttttttttttgagaattacatattacaacgcagacactcacaacgcacgcgcactcaaccctctgtcgatgggtacgtcgcctaccactgaaagcacaacgccgttaaatcctagaaaattcgctcccacggggagtcgaacactgaggctcttgtaaccactaggctacatgccctttcgcatgaggctctttctttgatcgacttaggaacgtcctaaggctgtattcgggaactccacctcacctatgaaaaacgcagtccattaacacatgattaattaagtagaagctatttttttaaaaaaggatcaatatgattttttaaagcaactttcttgtaaatttttttttgcaaaacacacaccatttagcagtttgaaaagtatacacgcgaaaaacttttttttttaattttgagaatttaaatcctaaatcgtgaaccatgcaatagaatatttatacctcgatttaaaaagtgagctataaatattctatttaatttaaaagtaaattgcatcgtcggtacacaaacttgtcagatggatacaaacttataaaatactcgttttggtgcacaaacttgtgcggtgcatgcggggaagtaaaaaggacattacatgactaatcttgttgatttaggggtcgattaggatactatgggagcgttcattctggtgacatagggtgagaaaggacatcgtattctgggcgtacgcttcccaaactactaaacggtgtgttttttgcaaaaactttctatagtaaagttgctttcaaaattcatattaatccatttttgaaatttaaaatagttaatacgtaattaattatgcgctaatggctcacctcgttttgcgtatcttcccaatcttctcaatcccctcctcctcaaactcaccctatgtaaacatatatatgagaaggttaccattatacatacacctattcaataaaatatagaatataatttagtgatagtagaaaaagattaaaaaaattgaacactgatataagggttagaaatatatgaaattcatcatttcaatgataaaggataaagtagagataaaatttataaatattacatgtcttatgcatattaactatgcgtatacacgccacatcctaatcaacatcaactttataaaattaacattgtcaagttattttggtcctcgttcgcatgaactagacaagtttgtgtactgaaaacgagcattttataagtttatatactaaattgcacccacctaacaagtttgtataccaccaatacaatttactcttaatttaacaacagtaatctcctccttatacaaagaatctgccagacaaacgtaagagttgaatcattttttgaaaggactttactaccaggacttagcctagtaatgtattttcgtaaaataaaagacttatttacaaagttcgaagcagatacaggaattagaaagtttgtaaccatgaaaaaactatatgcttaagatgtcattcattttgcacgtatgcaaaagaataagagttgaatcaatatttaataacgatcaatttacaattatatcacacaatcaagtgagttgtattggatttggatcctactacatatgccttgtttagttccaaaaattttttacctaaaaacgccacatcaaatctttggacacatgcatagaacattaaatatagataaaaaactaattgtacaatttgcataaaaattgcaagacgaatcttttaagtctaattaatccatgattagtcataaagtgttacagtaatctacatgtgctaatgacagtttaattaggcttaataaattcatctcgaggtttccaggcgagttatgaaattagtttttttatttgtgtctgaaattcccttccgatatctagtcaaacgtctgatatgacaacaaaaaattttctttttgcgaactaaacgcacccttagctcaaatttcaaaacgagatgatttttggttgatacgagagcagcgtgcatgatatccttgcgtttcattcgtgcgttggaatgctgtgtgtgaatcaatataattccgttgaacggtcttgcttgtgctttggataagataacgacctttgacgacgacccaccaaaccatgcatgcatgaacatgagcacttgctcccacacgcatgggctgcatttcgcctcttaaattaatcaaaacagtcgacttctcaaccttgcgcgtatgctttatccaaaaatgcgagaagagaatgcgcgttgactggacaggctcctgctcctgtccaacttagcggccagtagtccccagctgcagctagtactcatggagtggtcgtcatgaaactctcagtataaaaggaccctgcagcctgatcccctgtcaatacaaccagctgcacgcccattcgtctcaaacacacattctttgattcttccttcaatttccccttttcaactctgtcatcaacttaattgttagaagcgacctaaagattttgcggccgatcgagcatggcgtccccttcggctctgatcgcaatgctcctcgtcatggtcgtcggctgcgccgccgtggcctcggcgatggagctgagtttcattgtcggagatgcgcagggttggaacaccggcgtcgactacaccgcttgggcgaagggcaaaaccttcgaggctaacgacacgcttggtgagtctttctcgataatcaatcacttcattcgcacaatgctgctaaatgctaatgctatccagtttgccaattggcatttgaaatcgaacgctgattttatttggtgtaattaactgttttttgccttttttgtttcttcagtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcggccgttgggatcctcctcaatctcgccctcttctgagatcgcattgacgcgtcgagcggcatggacgttggcagggtggaggcaatgcatgattctttgtagcgtttctgatgaaatttgtttgattattttgtttacgttcgatcgtgtatacgtgcgtaataatgatttattggtcttgtgatttattttctccttatattcatttgtatatcctctgatataattttctgtacatctcagcattctgtatgccattcagtgatgtaggttagagtaacaaagaactttgctgtgatgtctttatactaacttaaaagtgaactcgttatccttccatccctttcttctcccaccgtgcttcagtgcttgcacgcagagcgtagtaggtgtgtcaaatactcctagtaaatgccaaggaaatatgcctccagtccggtcgcacccgcacaaacccgttccaacccatctcgagaaaggcccattccatctgcttcgccacggcaaaaggcccgcctcttaacggcccaaataggcccttctcacgggggactacgtccgcgcgggccgttggggcccaggtaaacccccgcctgggaagcccagcttggatcgggaaaccctagccgccggccgccatcgcccatcgccactatacatcacgcggcgaagagagggagagtgattggccgcggccgccgagaataactggagattcgccgtcgagcgaatgcagcaggctatagcggcgtagcggcgacgaccgccgacggggatggcccctgtggcgacggtcttgacggccgccatgtcctcgtaggccgcctctgcgcagtaggcgccggcggtgccgtcgcttcgactacggaggttcgtagctcgcgctctacgccttctagatccggaatgattctaggggatctgcttgtattctgcatcttgcgcgtaccacgttttttatgaaattattgacgaatattttaggtctcttcagtttctgcgtgcttacttcaagtttcggcatggagatgtatttgggttttcgcgttgatgttctttgtattgcttttaggtctattgctgatggactgacatctgattgtttaaagtagctagtgcgtatttattcatcctcaatgatgagagatgcattactgaagattttttcctaaaaaaaactgaatgtatatgtggcaaaggcatatccaagtgggcttttaattgtaaatatgttcattgcacttctggtccgcattagtgtgacagcaaacaacacaataagcatattacttttgatctgattgatagaccagacagctgtctgatgcttctattgcctatctcatgcttgattatagcatatttgcattgtggtcttgattgtaaggctgtggttgggattcactagtttcacatacttggaaagaattcttggagctacctttctgggaaaaccctttaataaagcaattctaactcttatccattaacaaaaatgccttcagttgggtgtaaaaatttatgtattttctgcttatctgactataacgtgttatgttttcttggacgtttttatgattggtgccccaattttcaccatcatattttctgaaaacatctgtggtgttttgatgaaatgcaggttgtcagttgtgttaattcttcagtcatccgaattgttgagattccatattgtttggtcataacataaccagtatttttatttctgtcattcaaaactctattgtgctctttattgcttatttatatctaatcaacacttgatatagtgccagcctaaaagtaaactagaaacctactaacctagtgatggcacattgttgtcttgtggccacaaaaggatttccttttttgtcttagcaggtgtgcttgtggcaggaagtattttgacgaatttgttgagttttttcttttggggtttacattgtaaacttatatgtgatttgcaggtttctggaccaaggtccttattgtggattagatttggatgattttaaaactctttaaacacaggatgcagaacagctcaataacagaagcgctggaccctggaggtattcctatttccatgttgatattaatgcagcttgatttttagtgtcatcattttttcattgaaaccaattggctcggtagggctatctccaatgctggtggaatatgaagtccggagcatattgcttagtttaaatttgttgtggtgaatagcgaggaaatcagctctttatgagtttgctcaagattgattgaagccagaccttttggtgaatattatcaaggacagttcatatggctagaggaataaacgcagccacacataaattatctacctgtaggaggataacccctgaggattgacaaggaatcaaggtgatattttgctacctaatgctcttcaaatagttagttgaattttcttccgcctattaagaaaatgcattgcatcatattttgtggtctcctcctccctagtccctaatgctgtatgcgtgtggattgtgattagtgttatggcaatgaggagaaatgaaaggccggtcttacggctgcctcccattcccttcccgattcaattagtctctggtatgggacgggatggtagtagcatgatgtgcagttcggcgaaaggttctctgagccattctttctttacctccacttatgttcagtacactttatttcgtgttctttttagggtaaaaatattgcaggttattagggtcctcattcagtgtgcagatatacaacaatgcacgcacgttggaatttgcatagtcttgcgattttgttcttgcatactcttccagaagcattgatagcttttgtcgaactcctgattttgttcatagtttcagttatttgctggttatgggcccttccagccagccttcctctggattcttgttcttcgttactatcatcactgggcatcataggcgccatattggggcttattgtttgttgatttgagccgtctgtgccttttttgcttatttgttgtgtcgagagctgttgctttacttggaagtagtagatgtgctgatatgaaacaattacggtgtaatactccgtagtccgcaaatgactaacttatttgactgtccatgtcatctgttttgtattattgagctggttagagcatgtttaatagtagataaccggctataagcttatattagagctaacttgtatatacatcgttctatgggctgcttttcgatgacgcggctgtggcctttccctatccagatttctggaggaccagaaaagtagaaacggcccgtgctagccactcgcccgaacaatattacggagtatttttacccctggttttagaatatggcgaagatcgacgtgacgattatctaagaaacgtgaatctcgaatactatcgtacattcatagattccagaatgccacattgtaccgtgatgattcgtctaagaaatgtgaatataccgtgttgccatcgcgggattgtttgcctgttccacacgtacccggccacctcacccatacgcgcagccacattacaagtggtacaagcaagagcccgacggcacagcttgcaagagctccaccgtctcaacctcggggctaccaccgacggctcacacgacgacttcttggcagcagtggtgacactggcgatgcaagtgcaacaacaacaacacgacctcgtcaacattgataacacctcactcgagcacagcaccggctccaactccgtgtacaatagggacggcggctacatgatgctgatgagcaccgcatcggccacgacacgcggtggcgagaaaccacgagtagcaggtggttcaagacggccgagggatcacggcggcgacatacaaaatgtcttcgcatcgtgccgttagaggccaatggctggaggataggggcaaagataacataattgccctgcattgttcgctcgatgtaaagtcctaccccctctgttttttaatacatgacaccgttaacttttaaacatattttttactatgtcttattcaaaaaaaattgtataagatataaatcatgcttaaagcattttaagtgataaaacaactcgcaacaaaataaattataattacataatttttttaataagacgaatggtcaaacgcgtgataaaaaatcaacggcgtcgtctattaaaaaacgaaagtaatacattttttttttacttattctgatttaacttgtggcgtgtagtcaggatggaacgaggaggctttcctgactttgtgtagtcgtcatataaatcaggatggaaggataaggctttcctaacttgcgtgtaccgtgtagtcacaaaatggaaggatgagaggatggaaggataaggcttacctaatttacgtagtcagaatggaaggatgaggcttttctaacttcctgtacttcagtttacagttgagtcatgaagtcggagaattcacttctgggatggagccaaactaatcaaacgtgtgccaccaccactggtttcatcccaaaagtgtcatcgctaccggccaaacccgccccgcccgcgcacgcactaaccgcaccgaaaaaccgcctacgcgagcgtgtcggccgcgggcacgttaccaacgcgcgcagcccaaacgccacgcgccctcccctcgccgcatgtcttgccgtgctcacccaccccccaccaccaccacctccagcaccggacgcctctcccatctcccatcacacgcgagatgctgtgctccccagctggccaccaacgtgacaacatcatcacgcaacgaaagccacagcggtagaatcgaaacaaagcaaacaggagtagaatgctacagtaatacagcagagggggaaaaatctgagcagatctgaggagctagatcagaacagatcaagcaggcaggagcaatcggatgacaaaatctctactaataatgtccgaaagtagattaaagaaaagaatccggtgggggaggattatacaatggcaagcacagtctctctctcactcacaaaagctagatctagattaaaacgcaatgggattagcaaccccagagcgaaggggggaaatagctaataataacaataataaattaacggcagtaatggcggtgatgatatcggcggcggcgaggaactcatctccgggagccggatctcagtagaacgccgcgacggctgccacggcggcccaggcggcgacgacggcggcggcggagggggagactccggacgcggcgctcggtggcggcggagacgtcggggcctccgtcggggactgggagatcgaccccggagccggcgcgggcggcgagaggacggggggctccgcggtcggcgccgaggcctggggtgacggtgtcgcggcggcgctcggggcgggcacgggcgcgggcgcggaaaccgggggaggcgtcgtcactggcggctgggcggcgggaggagacaccggcgccacggccggcggccgagtcggcggggtcgccaccggtggctgcgccttcggagccggcgtcggggaggcgctcgggccctgcgccaccgccgcggcggcgaagagcgcggccatggccacgaccacgaggtggaggcgcgccatgggatggcggcgaggagagctagggtttgggtttttgaggttggtgggcttcgctttgcaacttccaagtgggggaggcggcgaggcgggcgatggatgatggccttcaggtatgggggctataaaaaagggggcttttaactatttgccacggttagttttagcaaataactatttgccacccctatctcaatgacatgtgggtctacatatgtctatgacatatgggtccaatggcaaaaagttaattgtcacatctaaatgtggcaaatggttaaatatctcaaaaggggggaactgactacgcggtagaaacgaaaaaggaagagttatagatagcgattaaaaattggagattggtttatttggaggatttatttaattcgagattttggacggtgattacgccatcctttttaagtcggttcggccgtcggatggaggatggccgttggattggctgccagggtgcagatgatatgggtacagaatgttgaggctacttataatgaaagcaaattctgcaaaacaaacgaacggtgcaatatcttcatgtcaaagcaaaagatattttccattcacgtatttaaaacagttgacttgtccgaaattttaaaccaggtagatatatttggaacttttacatatatctcatattcgaactaaagcctagggatgtcgatccaattccgggctttttggattataggactaaaaaaaagtcaaaataggaaaagaaaagataagagcatatgcaaaacaaacatatgaattctaaatagaattgtaaaacatgcgtcaaacaaagcaaaagcaaagaaaaaaacgtaagaaatgaaataaagacatgtcagagtgcatgaatttttttttctttgtttctagtagaatccacatgatttttcttgggtttctgtaagagatcaattcctttgaaccgaacggtgttacagtcacgaatccatatgaatccaaaactctcttttttttttcctttgttttttctcatatcagaatgggtatttttgtcaccatgggcaagtgaagtaattttttctcatcatattctctttcatcatgttaaatgttatttttattcctaattaagatttaagaccagctctgaagttttggccacaagtcaaggtcggttgccttttctatttgtgataatgcgcgtccgcctataacaatgccgcgtcaatcttaatgtcagtttaaaattgccagagaagtggatatactagaatagacaggctatttccttacttaaaatgacactagatgagtagtaggagtatgtttttggttcttttatctaaaaaattgttttgtttggttaattgataaatattagctttgagaaatctttggtcaatttaaaaaaaatcctttaatcggaagaaaatggacatgacaccttttggaaccatggatcgagtcttatggagctgtgctcaattattgtattcacatccgtttacttattcagattttaagtctagagtagtcgccgctgaactttttgacagtgactgtttctcccccgtaattttgataaattgaccctttgaaaaaacttattttgatattgagccgtgtcaaaaactaattttaaaaatagaccattttctcacggcatcttacttggcgctgagataaggtccgacgtgtcccgcaaatcacacgtcatgcgatatcagggccaaattctttggcgctaacttacatggtctggattgtataaatagcatgcatgtacacccttactgtatggaaggtgtatcctggtggtggagggctgcctctcataagtcaagggttcgaatcccgtaacttcccatttttctttttttttcctttgaggaacaatactgcatacataattatgtagcaaaatagagggtgaaaaaaaactgaaatatgtaaatttataccgactattaatctataaataccacatacataattttgttccttccatatttaaaaataaaataaatttaaaaaactaagctataaatactgcatacataattttgttccttccatatttaaaaataaaataaatttaaaaaaacatccatatttaaaaataaaatgaatttgaaaaacatgtgagatttttaaatagaacatcaaaagatgcttgtacttagatggaaaaacttgcgtggctaaggattgaacccattacttcacaagttctcccccaagctatcttgtctttgtgtgcaatggaagcttgtagataactaatatttgtaaattgaacagagatctttggtgctgacctcggatgacgtgtaaaatccgtgacacctcggatgacatctcagcgccaataatagtggcgccgagatgttatatctcagcgccaatctctatggcgctgagaaaacggtctatttttgaaattagtttttggcatagttcaatttcgaaataagttttttaaaagaatcaatttatcaaaattacgggtttctccccgtattttattatagcttagccaagtctttagtggaacatgtaaacgatgaaagggtattatagtggcatcacacatcaggtgattaaggatcgtgctatcaagaagtcaacattaactggacgtctggaataccagagtgcatggcacgctaggcgtatttacgagctgatgcatccagagaccaaagaccttggctgtggtcttaccccaagttttccaactatctcccttgtttttcaggcacacacttttcaaactactaaacggtgtgttttttataaaaaaaattatacgaaagttgcttaaaaatcatattgatttatttttgaaaaaaaatagctaatactccatccgtcctataatataagataagaagttttagaattggacacggttattaagaaagtactatatccgtttcacaatgtaagactttctaacattgcttatatttatttagatgttaataaatctggacatatatatttgtttagatttattaacatatatatatatatatatatatatatatatatatatatatatatatatatatatgaacaatgttataaagtcttacattgtgaaatggatggaataggtagaagtgagtgatggagggttgtgattggatgagtagtgaagataggtggaaaaagtgaatagttgagggttgtgattggtttggaagagaatgttggtgaagaagtggttatattttaggacaaatcctaagggctaaaagttattatatttttgaacgaagggaatacttaattaatcacgcgctaatgaaccgttccatttttcgtgtgcactgctctggttgtgacaaccttgctccagcgaacacttcagtgcaaatttgcagccgtatgaacagctcagaaatcagcgtatttactactcgatccgtctacgtatccagatatagctacatatccgacaaatatgtccagatttataggtgaaagatgttatatttttataatggagataatccaagataatgatacgtaaatgaaaggggaagacgaccaggcaatgtagaccggacagtagagtagactacaagagcacaaaagtctttacgtgctattggatgtagcagtgcgccaccagcatcaatcttttgctgctgaattgcccataagctgacagcagagtcgtgcatcactgcatgacctaggatcacggaccgataagccaccactcaggcctgtctctttacatttggagagttgatacaccaatctcagctagatatacaaatcatcagccaaatatctaccctacagacattatccaagaggaactttggataaccttcttctatgttgaatgggcacacggcgcccttgtacactatgaagtatgaaaacaatcttccaaagtgcaacttctgaaggatcttccttcaacgaacacagttgcaatgtttggtaaaactccagttttttcctttatgttcacttctatcagcatgtcactgaaagaatcttctataaacgaaatgaaaccatcttctgtcttgttccaaaacactgcagaaaggttaaaaacattaataaaataattgcacaacacaaagatgcaaaacacacccttgtagaatctttattgttctaaaatactacagagttcagaggaaacaagaatgtatgcaaacgttatgataggaacataaatacagtaactcagcagtcacggatgaaatgattacttacagaagtatacttgtttccgtctgtacatggtttgcctatttcacttggtcacctctcgaacttacagcctctaccatttcttcactactaccttcagcaactcccatttccttcactttttcaagttgcctgaggagatctaacctctctggagcataggtggatgggatctacaaaataccagatgcacaatgtacataattaaatcatgccacaggggaaataatgaggggtcatacaaagttacgaaccatggaaggcacatatctctggatgaaagccaaaatagcagcatgcccaacagcagttacctgggaacattatgaacttgtttacaatgctgtatccatgaagatatttgcactgaacattaaagttcactaactaaaaaacatgactggttatctttagtcaatgtggatgaagtaaagaagacaggcttctgaaaccaaaattgaaataaacaacagtctgggcctagaaggctttatgcttgttcaggaggggtaaatcgaagtacaacaaatacttactggcagaagcatgagtattcctataggaacaacagaggctaaatctgtcagggttctttgaagagcctgcttttccttatgagttagttcatccccaataagagctcttcttaacaaacccatagcagctcctgtgtcaattgctaagagctgtgtcccttgcacaacagtctgtgtagggaaaaaaatagagaaaaaggaaataagttgcaggtctgcattctagacattttttttccctcaaatatggaggagagctgcattctggatttcagtaatggaagcattcaaatatgatgatgcgccctggtggcacaaaggcttcatggcaactaattaaattatgtagggccaataccaaatatattttcaagaaaatgtaaatggccttaccgtcgtggtttccttaaccttctctactgatttggtaataacattttctttcttgctagctggaccagaaggcattgatacaggagatgatgacacggaagaatccaatgtttcatttgcgacatatgtctcctggaaaatgacaaaacaataaataattcttcaaaattgaaaacggatgtgcatttatggtcaaaagcaatagtgagaatatcatatgaaacacataactcagaataaagtactctgtccagcattgttgcttaagtgctaactcaaataccaggtgcattcatgtcaacatttagaaagcatatattaagaagcatacctccttttgagcattatctgcgctcttttgaactcttttctctaactcaatcagctcacgtcttaactgttcaaaccggaggatatcatttgattgtgtgtctttgttatccacattagcgacagaaacctttatgagaaaaaaaaagaggtaaaatctgttaagtaagaacatggtgcaacaagatatctttgcatcaatggtgttgttctcaagaacagaatacatgcttccgcaactattatatactatacagagagactgttagtaagaataaatcactaatcattgatgatttttgtgatccccatcattgttaaatacaacacctaaaaaatttgctcgaaatataattgctaaaaggacagctcaaatattcattgcaagatggcagcttctattgttttaccctattgttgtttgaaaattattaaatgcacagtaatgcatgctacagaacgcatacattttgatctgaagtttgttggacaagctgaactctccttccagaaggcctaccaaagaggtcccaaattggacgacgtttgttctccactctggtgaaaaaaacaatagcggttattatccaccctgaaatcacagaaactacagcagaatgttacctgtttgctggtttttgtggtgttgagctctcattagcattgctagctgtctttccacggccttcctcgacagcaggagataatggtctgctactagcatcagcctaattgaccatcagaaaactttaggatagccatcatagtagtaatgaacagttgtaccaagtagaacatatggaacctctattatgttgactcacaaacatattaccaaaaaaaaatcattatcaaatattgggtgggaatcttagaaatatggtggttctacatggaatcaactaacttcgttgtgtaaaatgtcaaccatgttaatcagtggaaggagaactgacacacctttaaagtttaaacacagtaaacaaaacttaaacagtccacccaatgaaactactctcgggggagtagaagaacctaaattatatcaacagaatgtccctaaagaaataatatctcggttttaaatatctaaaatgtgcaacatatctacgtgaatgcatggccaactggagcgtcaggaggctgacgttgaaggagatgataccactttccacttgtgttatctttagttgttatcagtttatttgaagcggatgttatctttaggtaactagttggtacccacgctttgttgcgggataagtggataaatgcatgttattcattatagaaattatagattatagatgtacatgtttaaataatgtgaaaatgatgtggagataatgatttgacattacttgcatattgagttctaaaaatacaacaaaattgtaaatgatatgtcatgtttgcatgatatttaaaatactctagataataactgctagtgggtccacttgcatgtgatttaaaatactctggatgataattgctagtatgcgatgatgtggcacacttgcatgttgagctttaggagttagtgggcatcaactttatagtaaagataggattagttagtgaagctgttaggaatgtaactgttatactgtattagttagcacatgttaggaggtggtctaaataagccaagccatcattaaggactaaggagaaatatatttcaagacttcctactctcgtatatccctgcccttgtggtgatgttgtcagtcatcagctggttgcactgcttgggtccagggccatataatcagggcatgtgataatttggtgttggcgtcaaccaccacagctggtgcagaaagagtcagccctaccaggcaacaccaaagatcaacaaaaccaccatcagaacggctgcaactatcattcactttatcgctagcacaactactggctttgccatcaacttgcaagccccatggacgccaaaaaggcagccctgatgtggtttcaacacttcaccatccagcgacttccatgctgacaacatcaatgacttgaaaagcgctagccccatggggcatgccaatgaagactttttggcatgactgcaccacctgttgatcttgtgactgtagctggtagaggtgcagcaaccggccatggtagatacattgacaaccttcagaagcacagtctgtgtgatcttgacagcttggtgctctcacatgacaggatgcccacactgcaacctcttcaccgtggagatttcaaggggtgcaactggtcaccaccctgcaggttgaggacaaacagctagaaaggaagggtgaagttccatgatacacccattattggagatgtgatcaaggcaagaggccttacagccaatggaatgtcatgaacagcccaacaggagcttaggaagcatgaggcagctggatgcagaacatgtatagttggttaagataaggagataagatatgtggctcgttgcgtggttaatgctgccctatttaaaaatatatctggattttaatcagattaagcaagaaataatcataagtgtttggactaggtaatcatccatagcccatgtagtgtggcccctggtcatcagcatggttgtgttgcttgggtctagggccatctaatctatacatgtgacaattgttatttcagtcattgaggatgttgtttctattattgagaaatagctggcccttaatagccattgcagttattggaatgcactctcctgagtcctatgatggagaaattaaagtgtccacatacttgtagtaattccttttccagatgaaatgcaggctagtaaaaggttgtatgataattaagctcacctcaagaaattctgtttttgctcgaaaggaagcctcaagaaactcagcctctttcttcagccttctaatcatttcaagatcagaacatgcagcccttagatcctccttaccagagttggaactggagagatgcaattcttggagcaaatcttctaacttaaccaaagcttcctcaacactttcaagtgactgcaattattgagactaacttcataaattttcaccactacaatatatattcagaagtaattaaattagcatttgttcaaattgccattgtaaactgaaaacaagcatacacaactaagcacaaacataagtaagactgaccataagctttttggcaaatggcaagtctaattgagaacataaaaatgcatataacttaacagtccgaaaaatattttttttaaaaaaaaaacacatctaacatatgatcttgtacagttattaattgtaaacagatatacattaaatggatcaatccttcatctcttgcatatctcagaatacatctaatacatgtcacgctttgaatgtgtaagcatatcaaaaggagacggtggcatctccctgcatgtgcagccttgcatcgtaatgaatttgatgtctgagcttatagtgttatggccgggagttactatcagcatgaggcctgcaatgatgtttcgcatagtgccagcagtgcatcaagttgcttggagcttctttcacagtttacccttatccaacaaggctatttttcaccaaatattatatattctcattaggggctactcatgaaagcaatcttaacatcttattgtttgcttacagagaaataacataagtccactagtcatatttcttgtccacaccaatattctggcaacagccatgagaatataaggcctctcaccatccatcccaccctccaccccctcccaccacaccaaaacaaaaccccaaaacacacacatgcaccaccgcttccctctgaaactggcatataggttccatgaagaaactataatataattagcagtttagcactgatatcagcaacatcatcttggaacatgtcaaatgcacaataatttaactaactcctcacaaaaaataataatttaactaacagtactgagaattactattgttgggatgtgtgagaaccagaagaaatactagtaacgttaaagtgcatcatgtaacagataccttgtcaaaagaggctagctctgtcctagcaaccaagtgttctttggcttctggaaaggtttggtcttttggcatatcatacctgcatcagaatgagcagataaataataatattcttacaattgtacaaacatatacccaagtaacataacaaataacaatataaacatcagaattatatgtttactttgttaagtccagttccttcatgcaatcactcaacatggaatgcctacaaaaatttgaccatatattagaaacgttggttcgcatccatatctgcggcaaaatgtgagagagcatgactgaatttggatgtaccccttggacagaaatctggctgcctttacatttgaagggttctcaagccatgagctgtactttataaaactagtcatccaataagagcacacatttagcactcttgatattatttctcctttatgcacatcctctctaccttcaattgttgcagctggcacatcaccactgtaaaatggaagccactcgagctcttcgcaaactacctggaaggtgaaaaggtcataaaaacacaaaaaaggtgcatagcattgagagctcggtgtattgcctgcatactaacctccacatacagctgataagaactaatcgaagacaactgtggataatataacacactcccaccaataagatacctggatgattgtaagcttgttaaggtgagagctacatcataattacgcaagaaaacagttatactgtagcttatgtacagaaacataatttcatcgagcaaatggcaattcaaaattcgcatcattcacaccttacaatatcattgattgaatcatccagattggtaagatgattggaagacaaatatgtttgcgtacttctgcctaaagcaatgaaaaacccaaaaattgctaaatccttttccaaaacctgcagtaaggaaaatagttattttggaaggagaattcataaagctagacgaaatatcttttgttccaacctcaatactttcacttgttgtcaatcttgaccatatcttttcacgatcaagagcccgtagcaactgtttctgaaccagatcaatccaaaacgatatctcaacttcacgatcactggaaaacttagggtcagcagcacgaggaccaaaattgcaaaggaattctctctgaagaccaatatcttttgtcaaggtatatgctttacttagagggacaaattcaagaagcatatccatgaatcgaccaatgatatcagggaccatggaaaagaactgctgacaagaaacttttgttgatccaagctttgtgatagcagcaagacatgtcaaacctagcataagtagagaaaggtcactttcactagtattcatttgctggcgttcatggcatctgcaagcaacaaaagaaaaggtatccgttaatgtattagttcatttatcaaatgaagcccaacagaagtaaacaacttacattgctgttgcagagttaaaccgtggatcgttttcaaaagagttaacaaatgttctcacaaccaaaggattttgatcagatgagtaccactggtacaatgtaggttcccttttcgacagctcattttggatagcaccctctagagaactaagtaggcgggataaactgcaacagaaaattaaatatgattaaataggagaccaagaggcatgttctataatcacaaattgaactgttatgtacaacatagaggttagatctgatttggcttcatcatgctgtcaatactatgttcatgtaagcttgactattgaatccagtagaaggctcattctgggtcaacaaaaatgcaaatacagcagaaacctgtagactctagcagtaacttttttttcccatgaatcaagtggatcaattaatttgcatgctcttctgacagcatatgttttattgacattaaaacttaagaaatctaccagtcaagaaatggaggaatatatttctctaataattaggctatagatggaaagcaacttatgagacaggaattagctccaagaaaacttaatatacagaggaagctacataaaatgtacattacacaccatttgctctctaaggtattaaaaagcaaaattggctccaagatgatagatagttgtagtcttaaaaacacaccaggagaaaaaggataatgtcagcaattaggcatgataatcaaggcaagtgctagagggcagacctcctctgaacaaatacattgatatctctatctctgccatttcccctagatgaaacatcaataactgcttgcaacaatgaaccgacagcagcctgcaaacagattattttagataccagacaataaaaagtttgcatgccaccaaaattcagaacgcaacagctaatatttgttttactgaagatttatgtgtgagaactaataaacatcaactcaaagaaggttcaattgccgcgattggctctaagttgattaaaagactctgcatcttcatatatgaaaataatactccagacaccagagcagaacacttcctctggtggcagagtagcactactaatatcctaaaaggggtgaacaaaagctaaccaattaatagtttaccaagttcaacatacatattcatctatacaggcatccatatttcataagacctctatggatgatatcctgactacatcatcttttctttttctaaacaaaaaaagggaaacagtagggtgcatgcaataaaatctggcttacaaaatttcaatactagttttctgcgtggaaggccaaaagggaaaagtcaagagaaactatttaatcaatgacatgaataatggtcactatcattttatgggcagatatatgcctgaagaaagttcagtcctgtacctggtaagagagtggttttatccattcattgttatccacaccaagccattcctttggaaaccaagagttttttgatgatttgctgtgatctaagaaagccaattcaatagatcttgcagcatcatgtattgattggacaaggccagtgcttatatcctcgctttgtagtgctttaaccaatttcacccttatatcatccatctcgcttgccgaatcaacttgtggggatccgttaacagataaaccactgctatcatcttgagaagccaaaggaataagatggattgtccttctagttctctgaaatgctaccctctgtctcctaaattctagccatctagcactgtgaatgatcttctcacattctgatgctgaactcctgaaatagctctttctcttataaacacgtgtatgaaatttttgactcctcagatcaaccacacttctgcatactaatctgaatccatatactttctccagagtgtaaatcttcgatgtgctgcaaacacgttcaaccatttgatccattataataagaaacagcaagaaaaatattattaacttcactgtacaatgaaacctattccataatcaaaaccagtagcaaacaatttaagaaacgctggcaagctactgttttaggaataagcatccgccgtcaaattgccactgaaagcacaatacgggaaacacaccgtgtgcataactgcaagcctcaacagaacagaagaggaaactactagtagtaaagtatcccagttcaattggccatgtcaaagctccggccgtcaaaaccgcaatgctatcgccatcaccaaaacggcaacctacaacaccaaatttgacgaaatccctcggcggcgcacgcccccgaaccgaaatcgcacagataacttagtgagccagtgacgaattcaacgaccctactacctctacccctcccctccacaatccaagctcgcaaccagcgcattccaccgcaacccatccacccacgagctaaacggcaacgactaaaccagcgaatcggcccgcagcaccgcggccagaaggagagagaggagatgggggtgggggggggacccaacctggcaccgcacatggccgcgcgcggctgcgacccaaccgccgtcgccatcagcctccgcccccgccgccgccgccgccgccgctactgctcgccctcgccggcggtgggatcgatgcgcgcgcgtcgcgacaaagcgatgggccggaggcggagagggatagggtttataccgggagggaagtagcggtggggaagcgagcggccgcgaggacggaggaggaggaggaggaggaggtggaggagggcccccggaaacgataggctccgggagaggccaccggtgctcgtcacggggaccagaccatctctctctctccccaactttctctcgtctcggtttttcctcgcgcgtttttctttttttctttctttttttttcctccttcctcgtcgactggagtactggacatttcgcatttttctttttcttttttttttttgcctcgcaccactgctgtcgtgataaggccatttacggcgttgaaggaagaaaaagaacaacacgtcataccgttgagctgcattcaaacctgactagctttgacatttttgttttatgtttagtttaaaattaactctttgaatcaagccggtagaatattaccttagtcaaatttgaacaactaacaagcttgttttttgctgggtctactcaagagagtgttaaagtcaaaaaaaaaattactcaagagtgtgctctgtgtttgtgtgaactagttcacatgctaaaattttagcacagaaaagaactgcagatataatggcatggcagattggcaggcatcacaatttgctgaaagaacactacattgtcactttgtacaccacgctcaaatagatgtccccacaaccgaaaatgaaacttatgcccaaataaaagaatcaaaactaagagaaagcatatccgttctttcaagagaactgattgaacatggtaggtacgtattcaggccacgtaatagagtgggcattatcatcaaacgacgatatgaaaccattagtaagttagtaagatgtttgcatatggtacatgtatgcattaagtgctaatagcattgcactttgtagctacagatacactaaacctatagagaaccatcttaaacacatatattccacctcaaacacataaatacacacacatacatataaaacaaaatatatgcatccctcaaaaaacattacaaacatcaaacatattacatactttaggcgtaaatgcttgggagaggtgcataaacatgcatcatatattttggataacggaagatcaaggagcgtaaaaacttttggcaggatgacaagtgcaaaaaactggagatacataaaaccaaaactggagcacgacgagtgcgcttaaaatcaaattcgtggattatattccaccgccttaagaaaaatgaatatagttaatctcctggagtttactcttgctcgctagcactgtcaatctgatcttgctccttttttatgccgccatcagccaaggtgcttgtattaccactaggccgggttccataaacatgccccatctttaatctctttgtttccatgtaacgccgattctcattggttattggtgtcaacagtggcactctgcccaagacactcaaaccatagcccttcagtccagtatatttcgcaggattgttagtcataagcctcatggttcggacaccaagatctcgtagtatctgcagagagaaaaacagcaatgagcggaatctggaacagcgtgaacaggaacgctatgtcacaggttcattttcaatagttcaggagtacagacaatttatatatacctgtgcaccaataccgtactctcgtgaatcaaccggcagacctagatcctcattagcctcaacagtatcccgcccatcgtcctgcaaattgtatgcacgaagcttgtgacccaaaccaatgcccctaccttcatgtccacgaaggtaaactactacacccctgccagtcttctcaatcatggtcattgccagggcaagttgattcccacaatcacacctggctgatccaaatatatctccagttaggcactccgaatgcactcgcactaagatatcctggccatcaccaacatcaccctgcatacaagggaaaaatatatattctaggttcaacttcttcctggatgagaaagtctggtagagcttataacttaaatacaataaaagaaaccgttgcttcactactttctaacaatcattgcagatgaaccatgtcctgggtatcactgaatcattagttgcgatccagtctgactaatgtaacaggcaaagatatcttgttatactgtaatttgttcaggattttgtacatgtgattctacttttctatataatgcataagggcatggattttacttttttttatttaaaaaaagtaaacgctctcctaaaagtagacattgtatcaaagtacttaacatagtctttgttgagggatgcttaccttgaccatagcaatgtgctccatcccatcaataagagatcggtagcaataagattgaaatgatccccattgtaattgtaaaggtgtaacacaaacacgttctaccaatctgtctctcttcctcctatacctgcataagaaaattattagtagctgatatatatagtagccggaaagttccacaaaacaataatccatgtattataatttataattcatatcttccacaaatatagttttacatgtatatatatcaactgtgctttgcattcctgtaagaaaacatttgcttgaaatgtggttatgaagtacaatagaaaaaatgacctgttctcccgttactacttatcatgaaaccattagcccttctgtaaataataattactcttaaattttgtacttcaatgcagcatgtatgattcttatggaaaaaaggattgacacttgaatatattaaataaagcaaacctaatcaagtccgcaattgaaattatcttcaggttctcccttcttgcaaaatcttggagttttggcaataaagccatggatccatcgtcatcatcaacaatttcacaaagaacagcagcaggaggtaacccagccaacatggcaaggtcaactgatgcttcagtatgcccagcccttttcagcacacctccttctctatatttaagaggaaaaatatgtcctggcctgttgaagtcttcaggcttagaattaggagatgcaagtgctaagactgtatttgcccgatccttagctgaaacccctgttgttgtgccttctttagcatcctacaatacaaatatttagcacagacagattagaaaaacagggcataagcaatatgctctcatagaaggcaaaaactggggaaaaaaagtacatccatacacaacaagcaaaggagataggaatgataagacactcgattatgtccatcttttgcacaaaatagtcatggacataacatagttttttaaaaggaatacatacacgcatcaaagtgatttcaatcaaaaggtgacccttttagctcattctaaccaaagtggttaacagaccccaatggttctctttcttgttaacacaagttaccatatatgtaaaatgatcttgtgctacaaaaagcaataacagcgaatgaaaatacataccactgaaacagtgaaggcagtccgcagcttctcttcattttcctttgttgtcaccataagaggaagttctagtctttccaggtcatcttctttcatgctgacacatacaatgcctgtcccatgcctcactatgaaagccatagcctcaggtgtcacctttgatgctgccattataagatctccttcattctctctatcttcatcgtccacaacaatcacatactgcaatataaacactgtcaacagatgaaggaactacttcaaaaacctaattaatgctagaaaacatgatattttttaataagatccatacttttccttggcgaatatcctcaatagcttcaggaatggatgagaaaccctcagttgggctgtctaggtcaagctcgtcatcatcagcagaaaaaccatcaacaacaggtgccatatcagcagctatggtcccaagtgcagcagcatctgcttgaaccactttagaaggactagcctgtccatttataataacatgttctgaagaatcacccacagcatgagatatatgaaaatttctggcccgatggttatacggcaagtgaacagaactgattgtcctcaaactgtttgatgtagaatttggcataattgaacgatcagaccgcaatccagaagtcctgtgttggctgtaaatgctgctcagccgtgacatgagatttgcagtacaggaatccatctgaggaaaaaaatcagaactatgaaacaagttaggaataaaaatattcaaataatatacccaaaggatgtgatggaaaaaggaattcaaattatttcagtaacgttacagagattttctatgttactaccgcagtaccgccttgtgcaggggagaatctcactttcctcaaaaggaaatttagaataagtatctagtgcctattgattaccagaaatgcggaataaacccttgaaaacaacaatccatctcctaaataaaccaagtcatctagaatctagagtaaagctaaacacagcaaaatcgcataacaaacaccctcaaaaactccaggggcggacctaaagtaccgcatgagattcagctgaaccctcgaattcttttggaaacaaattgctatctattattactgcacctcgcacgcgtccaagtaatagaatggggaagaaaccggatgggtttgattgaacggaaacgaatcgaacaatcaactaaatccggacgagctctacaccaagccggctcatgacgtggcgctgagagagagaagaacgatttaccttcgattccgttctaactcagatggatggccggccgcgtctacccctggcctttacctgatcacccggctgtgcgcgcgcgcagccaggtaaggcggccgcgcacgccgtgcctccggagtccggacctgttcgccgggagcgggaggaggctggccgtgcctccgccgggaggaaggagagtgacagagcggtggcgtttggataaagagggtggtggaaggtggaacagggaagatacgagagtggttcgggtgctttgttcgttcgggagaagacgagacgagacgagccgcgcgggtggggatggcactatagggcaagtctgcaacgtcgacaggtaggtggcggcgtggcacagtgtaccgatgtaaggaaaagaaaaactaatggaaaggtgcaccggaggtcctgatcttgtcaccgagatacgaaaacgtcatcgaaccgcaaaaccagatatacggggttccttagctatatgaaaccggtcacccgaggtccttcgatggtttgaccccggttttagtgtacgtggcggctgagtcagcgtgggccccacatgttagcatgccacgtaaacaccatctctctccctctcttttctccacattttttttcactgacgtggcaaatgtctaggcccactcgtcaggtatggtgcgtgcaagaggtgcctccgccgccgtcgggagtaggaggttggccgtcgccagtctcagactcacagccctcaccatgctcgcgcgtggagacgccggagatctcagtggaggcggtgaagatgaagactcgttgtttccccaacctcatcgccgccgccgacagaggcacgggtctagaaaggggcggcctacctcagcgaatcagtcgcgcgcgttgctggtgaggccgacatggacccttggcgcatgctgccgcccgcgacgagctcgccgagatgccgcccgatccgtcgcctatcacgctcgtcaacagcgccgagcggatctggaggaagagagatgggagagggcaggatgtgacttcaccgccgcccatctcttatccttctctctccgccgccagctgctgctccagccgcatcttggaggcagaaacagctggtccttgagcacggtgcgcgcgggaggccggtgccgcagcggggagctcggcgtcggcgtcggcgttagcttgtcggtggcggcgaggcgcggggttactgcgtcggcgtcggcttgtcggtggcgacgaggcgcggggttactgcgtcggcgtcggcttgtcggtggcgacgaggcgcggggttactgcgtcggcgtcggcttgtcggtggcgacgaggcgcggggttactgcgtctgcgtcggcttgtcggtggcaacgaggcgcagggaggccggcctcggcgtcgccctgtcggaggcggatgcggcaagtccttgagcacggcgcgtggcgaccagcattttctcgacctgcaccgtcctcctctccacatcccccaccgccgcagccttggccggtgcaagaatctgacccggcctgctcccgtgtcgcagccgccgccaccgccacctcgtcgccccggcgatctcctccccaaccgccggccggcttgcaggagaaaaagtgaagagagagaaagagaggagaaagggagaggaggggagagagagagagggagtgatgacatggcatgctgacatgtgggtcccatgctgactcagccgccacgtataccaaaaccggggttaaaactaccaaaggacctcgggtgactggttttgtatagttaggagactctgtatatctggttttgcggtttgaggacgttttcgtatctcggtgacaagtgcaaggacctccggtgcactttttccaaaactaatacactattatgtccatcaacccatcggacgtgggctccaagcccagaacagagagctagtttgtccagtggaagcccaaatgtattgaccttaggcctaataagagttcataatgacactgaaggtgtgttcactttgttgcaaaatgaaacttgccaatgttttgtaatgctgaagcaaaggttagatggtggtagcagtgaaatattctaaatcaacaaaatttggtagggttgtgttgttgattgtcttgccaaaattttttatgaggttaaaaatgacaaaaagtgaacacatcttgaattttagagtgaattttagaaaaccccatgttttaggaccaatgtaacacataaccacaggttctatttattttctcacataacccaatgcattctatccaattaacacaacaccacagatttaaatatgggaaagtaccacaatgacaagtgacatggcagacctgctccacatcagctggccccacctgccagatcaatgcgtgagctatttagggctgggaagcacccatcctctgttcccgcgcacgcgacgacgcacccctcgtcttcctcgtgctcgctgcggcagttttcctcctgttacaagttcagaggggcagctcgtcgtgcacatgcaaaggcaagcatcgcctgttctgttttgcatcaactgatcaaactgtacatatacttcctatcttctaattatacaaagcttgtgtgtgtgtttgattaaacatggccaggacctgacaatgtttctgctcgagttttttgtaagtaggtcgatcaccaaggtgcctgacactgtgttcctatgaaaaaaaaatgaaaggaaaaaaactgacaatttctatgcattaagcagaacaatggagcaaacgttataaaaacattccatgtctgaataaaagcaccatagcaacagttaatatgtgacccattgcaggtccaaggcataagaaatttgcaaaacgaatccatatctgaaatatatacattgtgaagcagagaaaaatacaacctatttgccgagaaaaaaaaaagaggaagccatgtctgctcttttgtgaagcagaaaaaaatgttgcaggcctttaaatgttaattatggttagttttatatctgactgcaatataatagttgtaatagaatagtcttatacacggtccaatctacatgctttttttatttgaaaaattatggtccaatgatgaaaagcaattttgcaatgacaaacagaagaacgattgcaaagttgtaatgccctaacaataatgggttcccctaaattacattttactagccctaatttcttgacaagccaaacatgatcaaatggctggatttaattcctcgtcaaagaaccatgaagcagagtgtccttgcaaatcaccaaccaacatgctttggagtcaattcatatgatcatcacaagaaaagagatgaatgttacctgctaggaatgatacctaacgagttctcttcctccagctaggtcaacatcaccatcatcaccggaggccatcatgcaagagatggttggggaacgtcgccaccgcctgcgtacgcaagaaagacggaggtgccgcgttgtgtgcgtaggaacagggaacacacgcttctgttctcccgcgtgatcccaccataataggccacatattgacctggcaggtggggccagctgatgtggagcaagtttgccatgtcacttgcccttgtggcactttctctcactaaaacctatggtattatgttaattggattgaatgcacggggttatgtgagaaaataaacgaaacctgtggttatgtgttacattagcctcaaaacgtggggttttctgaaattcactctggattttaatatcctagagaaaatttggaggtaaaagttacctaatattagagactagtagttgctaaaatatcaaggatttcttaatagaacacctaaaatatcaaggagctcccaagtgaagcaagaaaactctaaagtttttttatgctttgtttggcataaacctatatccattcatcccaaggatgggttaggattgcagtcaatttgccagcccatcccgagagataggctcatactataattgaagattatctgggtgagtgaattaaggataaattacttactctaccattgttacgcaagcgtaactgcgcacgactgcaatttttaaagtaggagcgacaataacgatcatctggagtgtcagccacacaatccttatcagacgacagagctactgccacggcacatcacgccatatcctcgcacacggtcatccccaactcacgactatgactcactgccatccggtcccacgccgatcccgaagcaacaaaaccgtggcctgtgaacagaaaagcatcatatcccaccaaaaaaagaaaaatacacgcaaaaaaacatcgaccactgtcaccgccaactgtacacagagaagatgacaatacggccctacctttacacgcgagcaatgggccccacctgtcagtagaaccctggtgacctacgtctccccggatataaacaaacaaaataaatcctacccgtagctctctctccgcacgcagcaaccaccactcccc

SEQ ID NO: 11629 - DNA, 42238 bp, Oryza sativa
  unsure (1)..(42238): unsure at all n locations
ccagctacagcccttccccagctccctctccctctcgctccccatctcgccccagctctcgcccgcccctcctcgccgccacctcctccccccgctcctcgcctccgcgtccgccgcccaggccgcgggccctgcccccgcgcgggcggcgggcggcggcggcggcggcgcgaagccggttcccctactcgtctccctcgccgtcggcctcgccgtccgcttcctcgcgccgcggccggccgaggtgaccccgcaggcgtggcagctcctctccatcttcctgaccaccatcgccgggctcgtcctcggcccgctccccgtcggcgcctgggcattcctcgggctcactgccaccgtcgccacgcggacgctcccgttcaccgcggcgttcggggcgttcaccaacgaggtcatctggctcatcgtcatatccttcttcttcgcccgggggttcgtgaagaccggactcggcgatcgtgtggccacctatttcgtcaagtggttggggcgcagcacgctgggcttgtcgtacgggctcgccatcagcgaggcatgcatcgcgccggcgatgcccagcaccacggcgagggccggtggggtgttccttccaatagtcaagtcgctatctctttcggctggcagcaagccgaacgacccatcggcgaggaagctgggctcctaccttgtgcagtctcagttacaggtaaaaagttacttgatatctgcagatgttaaaaatgctatgcgttttaattagtactccattcatgaatggttgtgaaatgggagatgcatttcgcctagatatttataatgttcagctgggaacatgcttctttttttggtggtctctatgacatgttattgaagaagtgctaagaatgagatcttcacttacttttgctttggactgggtgtctatactatttgactggagtactaatgtgcattgatcattctattatcccatccgtctcaaatactacttgatgtatgatgaaatgctcacgctgtattattaaggttgcgacttatctttgttagtgataatatataatgtttgttatacagtcatctgactagtttatatcacaacagcagaggtaaaaaaaaactgtttctaggtgcaccctttgcttctttgagaaactaaaactgaaaccaataaattgtagacgtggtacaattctgactctttctgtaaatagtaaatggtaggaagcccaaaattgaaagtttggttgaaattggaacgatgtgacggaaaagttggaagtttgtgtgtgtaggaaagttttgatgtgatggaaaagttggaagtttgaagaaaaggtttgaaactaaactcggcctaagtgaagtgtggtttaaaaatggttgcctggtcactttatcaggagctacatttaaaccaaactagcttgtactttatgaattgaacactttgttgaatcgattgaattcacaaacattttaattgtttggttaagtgcatgagtacatcatacatttacttttgaggttgtcagatcctactatatgctgaaagcaatacaaactcctggtactaggtttcttttgaaaaggcatgtttagtgaaaacttttcgatatattgcttctgggatgttaaaactgtatgcatgctctgtgctttgatattttacgttttcacacccataaggattgcatttgatcaatggcattgttgtgttggtttctgctgcttcacaggcatctggtaactcaagtgctctcttcctgactgctgcagcacaaaatctcttgtgtctgaagttagctgaggagattggtgttaagattgcaaacccatggatatcttggtttaaggttgctagtttgcctgccatcatttctctcttagcgacaccttatttgttatacaaaatattcccacctgaaataaaggacactcctgaggcccctgcaatagctgcacaaaaactgaagaacatgggaccagtaacaagaaatgaatggatcatggttgctacaatgattcttgctgtttcactgtggatttttgggtaagattgatctctctttttactaatttattttttccatgagttaatttgccatatatactttggtctatgattatgccacatttcctgttgcatttttcataagctgtatttagctactccttctaacgtgatagtgttctgtcgatggatacacatgatatacctggaacaactctttgttttaatgtttggggacagctttcttaggttctgtttggcattgcagtgttttatttttttataaacgtttatactttctgatataacagttagctgaatgcattttggataacaggaaatcttacttgaattagtaatgatttatttaactaactagattccatggaacagcacaaaacaaaaccacaaccacaatctggtcctttgtagctgtagacctgtagtgaattatcttcttccctttagcattttcctctgaacacgtttttgtcaatccggaatcaacccaggttttcaaattatgaatcatgattatggagatgtttcactttctgttggtaaaatgttcaacatgattgaaaattttcttttctttttttgtaaaataaatagcatattcttcttctgcattgctgacttttgcacaaggaaagatccattaccttatattggattaatattaacaaggaaagacaccctgcaacatttctctcttatggcaacatattcgtaattactgtaactagatgtcaaactgtgcattgcacggctattcttatggatatttaaaaatattaaagagttttttttctgatttaatagttttgaaattcgtatgtaataaatattgagttgtactccattttaattcttagttgtaactttttcatgttttaataaatctgaaattcgaaatcaataaaaaaaaccgagttgaattcactttacaatgttaaattatgatctatggtagtgataatatgatgcatttattcaacggttagatctttgtggttaacgttggagcttgtaggaagtgcctaattagtataggtataaatgcgtttttctaatgcttacttatttttgccagattgcttcctaaatctttatgcttggttttcacttcagtacttcacataatgtggatataatgcatgttatcttaccaagtgctacggcaacaagatagcaagagcattaacagaaaagataaagaatgctactagtccaatctaaattaggagttattcccatatcgttgcattttcggtccttttgagatattgtcagatattcagatgtgtgcttcatgttgtattagtcaaactacagcttatatatatctgttatacatttttttttgcagggatactatcggtgtgtcaagtgttgttgctgcgatgattggtctttcaattcttcttctgcttggggttctgaactgggaagattgcctgaatgaaaaatctgcatgggacacattagcttggtttgctattctagttggaatggcagggcagctcacgaaccttggaattgtatcatggatgtcaaattgtgttgcaaaagttctccagtctttctcattgagttggcctgcagcatttggtgttcttcaggcctcctatttctttattcactatctctttgcaagccaaacagcacatgttggagctttgtattcagcatttcttgcgatgcatttagcagctggcgttccagctatactgtcggcacttgctttgacatacaattcaaatctctttggtgcactgacacattatagtagtgggcagtctgcagtatactatggaggtaagtttttctgtgtgcacacttcattgaattcaatttgttttcatgttgacactttacgacacattattctttaatatttgcctcttcttgtttgtaaaagatctgttgttagagaaagagcataacaaatattttacttactacgtatggatagagtattcgaatacaagccttatttgatatcattatgtaggactacattgaaaatccaaatgtagcctaataaaggaataaaaccataagctaatggataccagcagacaatttaaaaaattccttggtttcttttactgttaggtttgtcatattttatctttaagcctttgtgtgtacttcttatattgagtacatgttttccttgtgcagcggggtatgttgatcttcctgatgtattcaaactgggttttacaacagcagcaatcaatgctgtgatatggggagtcgtcggtacattttggtggaagtttttagggctttattgagtcattgcaagtgttaagttgaccaaaagtgttccttactacacctgtaattcatggctccctttctggagtggtagtcattttttcttcagaggagtttgatgagtgcataataatggaacgatgttcctcattagaagtcttgaacatgatacacttgtacaacccagaagggttctcataggcgttttgtacaactcccatgcatttctcatgaacgaaattaactgcaggaatgagtcttgattccttgagcatattgttcatgtactctcggaactgtatggattgcttttgctatatgccgtgattgttaatttattatataggaccatgagtttcatcagacaacacaggattgctaagataaaaacatcaaaggccaaatgtgccatcttcctatccaacaaattggatggcagagtggcagactattttcggagcgtatttgtctacaatatttgccacatgtgaatctttgatgaacttgtgcaaaacccttcagcaggttagtgcatttgacttgaaggttttcgtttatatttgaccatgaaatgaagcatttgacaagtaatctgcaccaatacttgtccatttgtattccagtagtgctaccgattcatcgtgtttgtcactttgttgattgctattcgtcaggagaagtgctgagcaactgaagttagtgaagttttcgaagacattctattcaacttaaacttttgggttgaactgattagcacccgtaacacaatcactcttgtaagttgcaactgttgggaagaatttggttgtttaaacatgacgctaattttgatccgcttctccagagttcaggaccctaggccccctagccaagtctctccttttttccaattccataggagaaacatgaggccatgttcaatgcgtagccccaagtcgtgccttcacaaacggtgtcccgcttccgtcatcgggccgtgtccttggagagaggcgcggctcctggcagaggaacgcacgcctctagctccttttcttgagccaccgcttgggcctatgcgttggacgactgcgtagctcatggatacggcctcccgcaccacaaatttcctcttccacccttggcctcgtcgctgggagtaggcgggaggcacatagcaatgcggaggagtcggaggtagcgaggtggtggaggagccgacggatttgtgacatcgacgacctggggacggcggagggagagggacgggccccgcgaacccgtctgtcagccaccaacgccccagggatggggcaggcccactagatccgacgacgacctcgtgatggcgactgctcgccgtcagccatcagcagtgacgggcgaagggagaggggtggcgacgtgttgggacgaagtcggagcggtgccaccgccgctgttcccttcttgcctcgccgccacctccctcgccctccccagcgtcgccgcgtctcgccccagccgtcggtgaagggagcggtgggagctcgagctgcagccggatttggcgtgggagagtggacgatgagcggcgacggcgggagagagaggcgagcggtggcggcggcagctggggagggcgaggagggaggtggcagcggcatgagggagagggagagggagggggagggggagggggaggacggcgctgagcggagggagtgagacgaggcgaagaagaagaggcaggagcgaaggaaaaagagaagagagagagagaggaagagggagaagagaggggtggtataggaaaacacccattgtgggttttttggttgggacaaccattgtgggcttgagtacctttatccaattgcttcagattttaaagagaccacctagatgtagccttcatcagtttactggtaattgagtgtccctgatagtgtcctcggttagtgaggacttttaggtggggctttgatgatagatgccctgtataggttcagttctcagtctcaaggaccacagtatggcatttttttttccttccagcagccgaaccaatcactcagaaaattcagtatgcaatcactagccgtgggggctcgtcgctcgcctccacagtccacacacgtacgcggacgtggagccgagcgtgacgggacatggacacggacatggcccgtgccggcaaccacacgcgcgcatccagcgtcgtgggctcgtggcgtctcgtgcatgccacggcagcacaggcagtcgcgcgcgcgcgtgggggagagaggaggcttctcgccttccgctggatagcggccgagccgtcgtttctttgccgccgcgccgtgcgacagatggatggcggcatcgcgcggtggtggggagggggtgaatcggttttccggcatctttttccacggcgcgtcgtcctcgttcgtccacgccattttgtttggattcgcccgttgaaaagcgtaccaccggtagcagagctatacgccaaacgtcccggtgaacgataccggaagatgggttgcacacttgcacacctccatcttgcagtcatgaacttatcctctagtaggcctctagggtggagcagcagcaagccagcaatgctgccggaatatcggccattcggcagtcaggctccacgtttttttttttacgaaaagcatgaaatttaggggtttcgacgcggaacgaaagcaaaatctgagtgaaatttcaaataattttcaagaattcaaatttaaaacgataaatttgactaaaatttgattaaaatctgattgaaatttggtgaaaactgttataccactgagtatccggatcttgtattcatcggaaaggtgaaccctaaccaaagtctttctttttcctactccctccgtcctaaaatataagcttttttttatctcggcacggtctgcgagatgctattttgaccaacaatatttacaaaagtaaaatgttttaaataaagagagttgcatattatgatagtccatttaatgataaatatagtaacatgaaaattatattattaatatttttaatttttgtgctataaacattgaaaatttaaaaaatttgacttcgtactattaaaaaataattatattttgggacagacggaatacgtgaaggagacactgtgtcaacctgtactgtggacgtcagttccatttcatggtccatgcagatatgaatatacctatgcaatatttatgatgaaagcaatttgtgagcccccatctctcgtgccatgttccggcccggggttccttggcgctcaccgtgtttggtccctggtcttttctgcagaaaggctttaaaactgtgcgctcagaatagtgcacccagcagtgtggaggacaggaggaggcacaacaaatacctaactgcttcgagcaaggctgaccaccgtggtcctcgctctttaggttaaaatctcctgtcaatgtaatctaccgcagttaaaccttcgagcatttttatacacggataatttgttaagattttcacatgaatggagtcatttttgttaggaatcagaaacaaaactttgtgctccaaacaaaaaaaaagggcccaattattatggacgaagccaaatctagctcctgattctgtgcagtttaatcagtttttctactttgttgtgttcttacaaatccattgtttgtggcggttatagctttaaaatagataaaatggatattctcattaacataaattgtatttatattaccatcatctaaacaatataataatagatgaattaaggcacaaaagagcatccaagaacacccaagaatggaccctaccgtggtggtgctggatgccaggggcatgctggtgttgccgggttgggctagccctccgcctcactggccggtagcgctagatcaccgaacaaggtgccacgtagaggcgtagtcgcacgcccgcggccacggttccatacagggcacgatgtcggtgctgcaatcaccaccgcagtgaaggtaggggtgaaaacggtacaatttttttaaagatttccggattccgttttcagtttatcggaaatgaaaaaggaaatatcttccgaaaatagtatcggaaatgggataaagatttttttttttgactgttttgctgataaccgtattgtctagtaattttcgccaaatttttgaaagtttcaataatttccgtcagaattctgaaagttccctagcggctagtagggatgtcaaaaaaaaaaaaaaactcgaggctcgcaagctgttcaaggtcgactcgtcctagcctcgatttgagctcacctcgagctccaaacgagccgagtctaagcctctccgaaagctcgcgagcttcttcgagccaagctcgagcttcctacgagcctaataatatatgatttttattgttatttaataaattaggacatcaaatatattatttatatgccttgtattggcgtcatatatttattttgttttttttcttcttctatttgaagttgcatttatcctctagtgggttttggtgattaatgatgaataaggttaagggactaatgtgtttattgagatatacaggtaattagtcccaaggtgatcttaggtgatcaagagatgcttggagacccctacaactttcattcatgcggatttgaaactcgaaagtcaataggatagtttaatttttgaaatcgagtcttaggaaaaaccgtactattaagaggggtttcaagtgtggttctgagatataaaaatttcctcttagtgggttcatagtgatagaatatttttgggaaccatttttgcaaatgggtccagaccggacatagaaggctggccggaagttccggtccctggacccagaacttccggaccttgcattggatgaaatttgcgtaagtgttggctggaagttccgggggtcaggaacttccagacttcttccagttcaaaaatgtgagtaatggctagatgacgtcacctagccgttatatatatctagatcgcacccagctcactttttggccattccacttcagttctttcatcccctaggttgttctagcctctcccaagatccctttgcttcctccactcaaatctagagcctttcttatgaaattgtgagagtagatgagagtgtaggagtaatttggagaagctttgaagactaggtgtggttgagcactttgaatatcttgtgggttgtcactcggggcttattactcttggagatcttctcctagacggataggtgtcgcccgcgagcttccgaaatcttgtggatgtcccaggaaagtttgtgaaggttttcctcacctccgcaaggaaacgaggtaagtgattaaggattcttttgctaagttttcagaggttctcctaggtagagcaacttgcacttgtggtcttttctagaaggatttgtgagttggatcttggtggtcactcaaattctagaaaatgacctaggagtgttgagttgaaggccttggactttctctgggttctctgtacaagtgaggcaaggggttaatcgagacccggctctttggagcacctcaacggagagtaggattgcaagatccgaacttcggtaaaaaatcgcccttgtcttctttgtgatgattctgtgcatgttgttgtgattgtgtatctgctctgtcttcatgcagtttaattcgtgcaaattagtttaagtctttgctagatcttcaggtttttctgttgcccggaagtttcggtgtttagaacaccggaagttccggtctgtctgagtagactggaagttccggtgttcctcacccggaagttccggtcctgctgaattttaccgctatgatttgtttgtgaatttcaggatagcctattcaaaccccctctaggctacatctttgcgcgttcactattaatatgataaactagaaattaattatttttttatagattttccttaaaatatacattgtgctacttaaaaatcaagctcggtagtcgagctcaagcttgatcgagctcgaaccgagtctgtctgaaagctcgaacattttataggctcagatcaagcttggctagagcttgtatcgagctcgagtctaggcaggcgagcttgctcgagctcggctcgttgacagccctagcggccggccagcccaacccatggcagacttgtagcctattaggaaggggaagtggccaggaaaaacgttgttaaccctaggacgtggcatgtgaattttgctgaactttggtctactcaaccgatcgatgttgaagtatcgccaaaatttgtttatattgttcgtcaaacttatcatatcattaatcatcatataacgatattgtgtggagtgtgatgatgtaagaatgaagtaataaagtcattttcatatatagttaaatgtgttattatgccacgctccgctgttttcgacatgaattttcaacttccgaccaatattggcagattccattctgacggtcccgtttccaatatcaccgataaaacacgaacatagatagcgcacacttacatttttaatctaccaaaattgatagtgtacacttccaaggtttttaatcttttccaaaattaatttaattaagaaaagattaattcaatcagatcatatatagtgcagtggaaatgggtgtgtggttccaaccccaaggtcatgtgttcaattcttaacacgctcacaaattcttcttagagcatgtataatagcagagtgtaagccggctaaatgctgaggtggaggagagaagagaggagcgagaggagaagcgggctgtaaacttacagccagcttggacacaagaaccaagaaattatgtgagagagacaagtgggctctgtatttatttattgtaaatagctaactattacacgtgtgggctaagagaaggctgcaaagaatcttatagctaacaagtcagctatattattaggcttgctcttaaaaaaatgtttggaggatgtctccctctaaatattgttttttttaatcagcccatagatgctagcgagctgtgattggaaaaacaggaaaatgctgcagaaagttgcaaccgtggcataaaacttgcgtgtaatttcccccttcatattccctgagggcaagtcccatctactttgctgaagaatcccctccacaactcaagagtctctgatgagataccttctgtcttctctggtgattacctcgttgtctcaagccccacacacgttacatcgagcaaacatttgtcatgcaactgtacgtgtacatgacaaaccaaaccgctacgctctcctccttatattggagaaaaagaaagaaaacacggaagaagaacattctaatgctttcaaaatataatactactagagagtggaaacattgtggtattatatagtcttgattttgtacaagaacaaatatctcaaaagaagattcctaccatagactgatagacattagacaaagatcacccttttttggagttccattttctttaatgtaatctcattctaggactcgtcgttttcgtggcagctttgtgtaatcacagaggtattagggcacatacaaaggtagagaccggtgtggtctctacgttaattagatactatcacgttacaatagttaagataatacggtctctaaccattaatgtaccaaaatactttcttactagtcatctttcctttattagactcaatgcaacgaaaaattttcttaataaatggctaagaatcgactctatgccattgtcatgtgtagcaaccatctttctctttccttcttcatctctcttccacgtcacaaaatatacttacatgccaataaaaagagaccgctaataaagacccttgtacatacccttacaacaacaaaaaaaaagaaaacggattcgattggattttgtcagcttaaacaaaggattgtgccgccaaagaacgtctcaaaagccgcgattactttctccatgacagcagccgagaggagtaaaaaagaaaagaaaaaaaaaagatctcggccgccgccgccgcgcggcgtcttcccctggccgcgcttgccacggcgccatgccgccatcggccccatcccgctcgacccatttcgcatctcccaacgccgacgacgacgacgtgctgccgcgctacctccgcgttttcgttacggatggaacatgaaagcgaaacgcagggcacttggccacttgttacctcgcgaatttgcacttaggccgagtttagggtgtatttaagttcacgtcaaaattagaaatttagttaaaattaaaacgatgtgaagtaaaagttagaagtttgtgtgtgcaggaaaattttgacgtgaagtttcaaactttttctttaaacttctaactttttcatcacatcaaaacttttatacacacgtaaacttccaacttttccgtcacatcgttccaatttcaaccaaatctttcaattttgacgtgaactaaacacacctttaggacatttttagttgaggactaatattaacacatatttttaattaaggtaactaagcttagtcatgtcatatttttctgtaaacaaaatagtaacaaactaaacttaagcaaagttaggtaagaaaataaagtgtatgatatgtgctatgcagctaagggttaaacaaaagtagatttatgcatgaactgaatattacctgataaaactgtggcttgattaagataaggtgtgataaatttagttaccaaacaaaaatgcccttagactttgctactcccgtactccggtattatggattttggctcattttttacacagcttctgagcacgtctcgtccggtgcaaagccaaaacagtaacagcaggtaaaagaaaaatgtgcaggagttacacgagccaaagcaaatcacacgaagcaaaggcgaaaaaaggaagcgttggctcccacaacttccccccgcggaacaaaagctgctttcctaccttcccgtatagattggcgcgtagcgtcgcctcgtcgccccccggtgatccggctctctctccccagtccccaccaccaaaccagccaatggaagcgcgtcgccttttgggctaatttgcccccacaagctcaaaagcccgctcccttttgccatgtccgattgccagtcggggtccccccaactctaccaccgccaccacaccggcagcccatgcctactcctacagtcctactcctctgtccgtcgtgctcaccactctcactcccacgcagacgcagggtggaggtccggaacaaacagaacgctgtgcaactatgagcaattcgtcatgttcaaatgtaggcactggaagcagggaaatagggggaaatagggttcacaatcctgataatggatcgagattcgctcatgagttgtttcatcggattacactgaatccataaaaaaaccgatgaaaaagacaaaaaccaatgaaatttggataaattttttcaaaaatttttaaaatagtttgaaatttttttattaactaaaaagccgagtggtttatgttttcaacccggttcaaaaagttcggatttcgcggaatccaaacaggattccactggaactgtgaaccctgagagaaatttatagtgctttccagttgaacacttcaaatgcaggtagggaacttggtaaaaactagaaagaaacacgcgctacgctgcgtgcacggaatatatggttaatggcacatagtagatatgatgtccggtatgtaaacatcgatatggtagtcaacactacgtgaggaaataatttatgttgcaaccaatatccaataatttccagtctatttgtataataatgtgcacttagacaaaagtagtagccacacgtggaaacatatatatcgtgcctgcatactgtagaatagattagaaaaaaactcaaggatcctaggattcatctctttcggggagccaagaagcactcttcctcccttttctgaatcttcggagaggcaaaagaaccacagaaacattgacttcaagggaaacattctacatttccgtatagctatgctcttcgtgacacctgcaatacaaagatgtcttgtctttttaagcttgataataaatagtacatcattatatgtattcgcaataatatatataaaagatgacaggtacttcctttgcaaagtggcattgaataatgagccatgctgtacattatgtctaaagctccattttgcatgactgttcattcacaagtatattctcatgttccattgaggggcaataaacatggcataaaaaaaaatcaaataatctaatgaaaattccttgcaaaaaaaaaaggcttagcaaagtcattctgtgaaatccaacctaggacaaaaaaaatcataagcatgtttaccaagggaaaaattcaatctgaaaggatggaccggtaacaaattccaaaactatcatgtgcaaggtgcttgctagaaaatgataacagtactctcacatatggcatatatatattgtgcaaaattgattaaatttgaggcagagatttgaaagaacttttcacatgccaaaatatcttgaggtagaccaagcacaaaatagaattagacaaataggtggacataaatgacaatttataattgagtaaaggaacactacggtggaaggccgccgctccaaatcttgacatatcttgcaaaagaaaaaggcttttcccttgtaagaatccaacaacttttactatgcttcttttgaaaagaccggacagaaatcatatacacagcagcaacgtgtgcaaatagtcaaaaaagaagctacaaaaattttgtgtagacaacttgtgagcgttacaataaatatgataatgcattcagaaacagcacataaaagtttataccatgcataaaatttttgacacagaagacactttgttgctctgtttttagttctactggtttgaaacagtagcgatcaacaaactataaagtggcagaatcaataccaggatccatgaaaatatagaccacctcaacacttttgaaccaacattctcatgtgaatatttttattgtatatgcaatagcattaaagatttttaaggttagaaaataaggtaatgatctcacctcgttgctcaaagaagaaatctcctcgactgtagatcaactgacttggatagaagataagcacacgcatcattcagagaaatagtctcaagtttatatctattattggacctgcaaggaaaactgaagaagtattattccacattgggatctagacaacaaccaataacttattaaacacattagcattggaaaagtaacagttttttttcttttttggtttcacatgttgcatttagcaatacatatgagctagtattatggatggttcatacaaataaagtttagaagtaagaaacattggggcaatatttcaatattagcatgaccaatatcaccaccagtaatttccaaaatgcttgaatcacttaacattagatgggtaatactgcataaatattataatccttgttaaaaagaaatagccaatcatgctaggggaattggtagtctatggacctggaataagtttgcacatcaagcataagtaaaaaaaaaaaagaaaaaaagaggtatgattgaaactctaggaagccaaattcaaagatttgacgtagtaagtaccccaggattattgttaaagcatctaaattgcacatctaagatgttccataaagaacatgatcaatgcatacatcagtcattctatcaacaaagaaaaatgacttgttagaaagggatggaagagagcacttgctcatagcgtaaacaccatacctaccagtaactacaattaaataacagaatgagtaatcccatgtcacatatatcactgggagaagacaaaaaaacagaattagtaccttcaaatagaagccacagtagtttgcacgtgagctgatgccattgcttttccgtgggtgattctgcaaccgaatgagcaggagatcaataatagggataaggatagggaaggatccagatcaggtatgtatgcatataacagtagaaaatttattatatagcttagtggtttaagcatgggaaaacagtatataccgaattagaggatcattccatggattcaccgaaggtttagggtcatgctgcagagtgagcaccagtccggactggataaattggatctatgagcttcaggatgaacaggtaaagctaaggattaggagggttaaagggaaaaaaaagggaggcaaaagggctgcataccttaccagggcatggtcgaggcggagatgccgttgaaggctggaccttggtgtgcccaaagccctaatccatgcggatgccgaggcaagagcaggccatagaggccaattcctctagctgcaacggagaggacaataggggcagcggcaacgacgacgatcgacggcggcggcggcggcagtggcagtgcggtggcaggtgaggagattgcatacaccatctgagagagatagtgagacggcgagccaccaaataggaagggggtgaggaagagggaggcagtggtggggaagagataaaagaggataagagggtggcggtggctcatgttcctcacctccgtgtgggcacatcaaccggcgagtaggacgggggccatcacgctgatgcgatgcgatggccttgctaggaaagagtggcggcgacgatggatgcaggagggcgaggcggcgacggcgacgatcggaggaggagggtgaggtggcgaagcgacgcggcgggcgacgaccggcaggagagaaggccgcacgacggcgcgaggttgaggggctgagggcgaggaacacgaaacggctagggttttggtgtggcctggcgaaatcggtgccgtccgttcccaatccgacgatctcacagctgtgtaaggggcgccacagctgggacacgtggacggtcagatcgatgccagtgcgaaatcggacggaggattgtacggggattgacacgtaattaacaaaaaaacgtgaggacttttttgcaaaatcaggatgacgtggcgcgctaattctccagcactcccgcgacgtttagagagattaatatgatagcgtctggaacagctagctgtgtggctacaacacaacaggactcaacaagcaaacttctgctaggagtgctactccatccgtccctaaatataagagattttatttggatatgatacatactagtatagtgaatctgacatgaagattgtctagatttgttgtactaggatgtgtcatatccaaccaaaatctcttatatttagggacgaagggagtatatcgttgcggctgcacaaccacagccagccgaacaaccccaacatgtttaaaatgtcatttattatagttttaaccgtataactagtcgcttgagtagctagctggacctaaatattttctaaatgtggctcaagaaaagccttcccgggcaaaagaaactgaaatgatgattttgaggtttgtaactacttactctgttttacaatgtaagtcattatagcattttcctatttatattgatgttaatgaatctagatagatatatgtctagattcattagcatcaatatgaatgtggaaaatgctataatgacttacattgtgaaacggagcgagtacaagtttataaaaatcacataagaacaaaacatgacagattcttcattctagcaaaaaaaaaaaaaacagttcattctcctgttcatgtagcacgatcatgtctattagagttcacaattttattccgaggttaaaatgtgaggcctaacaagatgataagtttgcaaaatgcctagcttaaagtttgaaaagggtacacgtagaaaataaaaaggtagaatttttttcgagaaaaaaaataaaaagtagatgttagaaaagtgtcctaacaaacacaacaaccatggtcactctttaaccctcagtccctcacctactcagcagtcagcaccacgtttgactctgcttaatagatttagtgaacgtgcttaaaactaaaaagtcattaacatataattaattaagttttaattatatacaaaattagaaattaaaattatttaatatgttaaaacaacttctacataaaaagtttttcatacaaaatactctctccatcccaatttaatcatcctataaggtggtgtttagatccagggacttaactttagtccctgtctttagacactaatttagaatattaaatatagactacttacaaaactaattacataaataaaagctaattcacgagacaaattttttaagcctaattaatctataattagagaatgtttactgtagcatcacatatgctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctaaggctatcctcaaccctccatgtcatctagtttacatagcatttaatatattgtcacataagaaaaatgtgatatggtaagagagttaataaggagagagataaaaagataaagaaaccatttctcatgcaagaaatcatcaatacacaagaaccaataatgaaaacaaggggataggtaaagaaaaggagagagatataaggcgattagatgagaatttaattcgaagacaccatccattggatatatagtttatatacatagtgtctatatgacatagcaagtatgaaaactatttaatagtttttctgggtttgatggcctaagcaaatgataccaagaccaaaaacaacaagatatctatcattctgaaattattcatcatcgatcaaggtgctccatcacttcttgttcaacaaaaattaattcacactttaaatgttacatggatttgaactaatagggattaattgattagtcgcatgtttgcatacatgacattccagataaacaaagagacactttgttcgatgatgatcattttgagaaaacctcaaaaatcatagggacgattaaactgggatgaaggaaatatacttagtattgtttagcaattttaaaaatatgctaataaaaattgaaataaaatctgtagcgtagcatcaggcggccgtttacccctaaactctcctccctcccccctgccttcttttatagcgcacacagttctcgcaaggaaccgaaaacagagaggcaagaaaaagaaaacggaaaaccccccgcccagcccaaccacttcactcctcccactccagtactcgactccaccacactccagtccagtccagtacactccgcacacgcgtgccacagggatcatgcgaagcctcaagaacgtcgcctcctcctcctctagcggcgtctctcggttgtaggagacgctcgtcgtctttggacggatcggagcttgggggaggaaggcgacaaccatggtgccgatggtcctgggtcacaagacgggcggccacaccgacgacgccaagtgccatcaccggaggcacagcaccgagcaaccccacctctccccattacccttcccccggccacccctctcctcctgatcatcacgcctttctctgcttcttccatttgatctttgtgacaacgtcgtcctcctcccgctactcttcgaatcttttgtgaatttcacgtcgtgagacagtagggattgaagcatgagaagtccagcagcgcttctcccggtggttgcagatggtaagttttttttggttggtggttttgtgtggtgattggagatcttggttgagatgggagtgtgtgtttggttgtgaaaggtggtggtggtgttggggtggaggaggagatggatgtggacgaggacatggcgatgtgcggcggccgcggcggcggcggcggggagaagaagcggcggctgagcgtggagcaggtgcgcgcgctggagcggagcttcgagacggagaacaagctggagccggagcggaaggcgcggctggcgcgcgacctcgggctgcagccgcgccaggtcgccgtctggttccagaaccgccgcgcgcggtggaagaccaagcagctcgagcgcgactacgccgcgctccgccaatcctacgacgcgctccgcgccgaccacgacgcgcttcgccgcgacaaggacgccctcctcgccgaggtacgcacgccaagaaacggttctgatcacggacgagtgcaatgtttgtgacctttggccatggcacgcagatcaaggagctgaaggggaagctcggcgacgaggacgccgcggcgagcttctcgtcggtgaaggaggaggaggacccggcggcgtccgacgccgaccccccggccaccggcgcgccgcagggctcgtccgagagcgactcgagcgcggtgctgaacgacgcggagatccttccacacaagccagcgccggcggccgccgccgacgccgcggcctcggaggagacggaggcggtggtgaccggcgccgcgctgctccaccacgccgaggtgttcttccacgggcagcttctcaaggtggacgacgacgaggcggcgttcctaggcgacgacggcgcggcgtgcggcggcttcttcgccgacgagcatctcccgtcgctgccgtggtgggccgagcccaccgagcaatggacgacctagctagccgcgaaaactttgcttacttggctggggcgaataaacaattccgtagggggttttctgcaaatttttgtaaaatgaaattgtacctagtccttttttgtcaaaatcctccccctctagtacgtgggccacgtggccggtgagctagaaatggcactcctggctttctctggctcaagcagcgaacgatgcagaaaggggagccaagggagattcgtgggaaacgcaggggaaattccgcaaaagtagcgggagagaaaaaagtgacagtagtgtactccgtagtgtggaggaaggcaacggcggcagcgctggagggaacagtgtcgctgtcggtgggcccggcgccacgtgaaaagcagacttgtcgctgacagcgattcctggcgtctgcctagtgtgtctacgcaaaaagccttgccacacttgccctcctttcctggccacaagagtgtagttcctctcacaagttcttttgtttgtgaatttttttttgcaaaaccatctaaaatatcaataaaaaaaatccgatttggcacaaacaaaatttttttttttgcagaatattggatggaaaaaacaaaggtgatgggtttgattttagtttagaaagaggcttatatcatcatgtgagtatcttttaattgattgactagtcctgttcgtttccactgtaagaagtggattaaattttgaattttcgtggcacgcttttcaaacagctaaacagtgtgtttcgtacgaaaactttttatataaaagttgttctaaaatatcagattaatccattttcgagtttataataattaaaactcgattaatcacacgttattaccacctcgttttacgtgaaatacttaatcttcatcttcagaagattcaaacactacctaaggaagtgttagtttagtccctcgacttattttttggagagatctcccaaacacctcctaattctttttttgcagtttacactgagttttgatttacccttgaagaactctcgattttcgtggacacgctacctgaaatatctttcgtgcaaaaactttttatatatgaaagtttttaaaaagataaaataaattccccaaataaatttacttttcatctttttattttaaaaaattataatagctaataattaattaatcgtttgctaatgatctttttattttccgtggctggaaaatctcgtctaaatgcatgggcccttatactctgcatacataggcaatgaaaaaatattttagaataaggtttttatataatttagtggtcctatagtgttgatggaaaacacggtggcatgggagattagctaaaggcataaaaatacaaacccacaacaaaatactaatccaatctagaattaacagttaaattcaagtttggttgcatcttatataagctaaagaagtgaagaactgcaaagcaaaacaagagcatcaccgactgtggaaggagcgttggattttctttggacggacaatgatgtgtttctaggagcttggctccactgtggggagcacgatggttaatttttggatggcacgaataattacggccagagtaaaaggttttggtactacctcgagccaattttcagcagtacggctgcactttctccgatcctttttggctcgtcctctgcatgtgcttttcagtgtggatttccattcatgagctgatgatgagggtgacgattctttccattaacttttgttccctttggtcctgcagaaccataaacaaacctgcagtttgttttaaacgcaatggacattcgattagccgcttgttggaacaatacaagtttcagtccatcgtttgacgtatactaaaatatattaacttttggtccagattcataactaaaatacttatattttgggacggatggattactaattgcgtataagtttataactcataacatcttattaacgattaaaaaaagttatatgtattcatattaacaatttaaaacctaacgttgaaaataaaccacgatgaaaaaaaaacaataaaatcagcactaaaatcaagttttaacatttaaattttgacagtggcatatgaatctttaatgtagtactactattataaaaaaaaattatagcatatttgagtccctaattgaaatgcgagctttgttcttatgtgattgagctgtcccatatgaaattcgattgttctagaaatccctaaagttattttgtaaagctaggctgttttgcatcaaattaatcgaactgtgcacaagaaggtgattgaaattgtaaaatgcaattgtacgggttacaataggagttagcaattgaataagcccatccattagccaagcaagacaagtcagtacatttcgccacctttttgttgatatccaaacggggccatctcgaatagaccaatcaccaattgactttctttgtttcttttgtccactagttttctgatctattgttgtcgtgttgcaatttggtttagtatgtgttgccattagaaagtgacggggaggaggacggagaaagatgtgcattgatcgagtgatggagtgtaagggtgacacaattgctgcaaacaaaggacccaaattggccatgtctgaaacgaattaatctcaaatataagtcatttttagtagtttcattaatacttttgtaaataaagtcattatataacttttagtcacattttcatcttcgttaaatgtaaatcgctgcagaactttctgtcacattttcatctttaattacacaaatgtctttgtcagatacttgacaactctctaaaaagtaaattaaaatagataaatcagatttttctagtgatttagtaaaataaagggtaacaaaataatttgagctgtaattttacttttgtttcacaggtccaaaatgaactgtgtcggttaccgaagaagacaattaattactagtacaagagatgaacggtatgtgcaatagcctccttgagaacaaaagagccttgtacttctagtagagcatgtcatgtgtattgtgtactggcatctaaacctacaaaatcttcaatgttgcagaaaaacatactttaaggaagactgaaagagaatggagtcgttatgagcacgtcaaataagaatatatcatgatcaatcatactccctcatgtttttaatatataataccgttgatatttaacatatgttttgctattcatgttattaaaaagaactactccctcctattttacaatttttgatgttttggacaatggtacgatctacaataatatatctttgactatatatttctattataatatataacaaataagtaaacatttaagtttattaaaattaccttttaaggctaatgtataaatcatatctagtgtccttaatagttattgatagtaaaaaaacgtaaatattagggaatgacctaatatcaaataatcatttaagtttattaaaattatattttaaggctaatctataaatcatattctagtgtcctcaaactaaatatttaatagttattgatagtaaaagacgtgaatattagggaatgacctaatatcaaataattagaagggatgagactttgaacccaggtcgtttattccatcaccttgtggagctagccagaagacccatcagcgtttctcaatagttattgatagttaaattctagtaaatgatttgtatcaatcttattcaaaacgtcagaattatggaactgagggacgtacacaattattatttatattactgtgatttactttattagtgagtttgatttcttttttgctaatcagccatttataatttgtataagccaaatgtgaagagctttttttttaaaaaaaaaacatagccacttatttacgaaatcaactaacattgctacaatcaacatggctacaaccaatatggcaatcaactaaatccatagtaatcacagccttaaagcgatggagttaatcgggacaccttcaaagatcatgaactacaagaagtgttagatatttgaatggctctttcgttaggctcgttatcccggttcaaacacgaaataattcctactgtagaaacagagaaaaaggagccctgaataaaagggacaggggaagtggaacgcgactcaccaaacaaaggatgggccccaaataaaaaggcgctttgtattcaacgctcgaatttcgtgggccccaccacagggaaaacaatcgacgcaggcttccgcgaccgtggccacgcgtacccacgctcacgggaggcagggccacgtggacgtggggccgcgttgtcatcgacgtcgcgcgacacgggggggtcgtgtgcggcgcgcgcgcgcgcgttcgatgccgtgcctggtggtgcgctgcgccggtggtggtggtgctggtccctcgccgctgtcccgactcgcgtccgatgacgtgggcctgtaaccatcgtatgggggcccgtggtgggccatcgtccggaaaggcgaaagcttcatcgtggcgcgggacgggtggggcccagtctctccctcgaggtgtaaatcttgcacagttgcacacttgtgctgagcttatcggttctctcgtctcaaattgtcatacataaactttgtgcttattacaacctcccataacattttaaaattgttctaaaatggttgttacataaatcattttcgtttcaatttttttttcattttatccttaatcaccatcccaccaccaactatatatggatctattcggctgcacatgccacttatatagccgttacaaccaacaacttgccgaacgctccctataaagaattatggcttgtttaatgtttatatagttatagacatttttaccaaaaaaaactgagcctctactttcttgttctcataatataactatttttaaactttttataaagattaagaggaaatataaaaaagattagattgtccatcgctatggtcagtgggtagggttgtaaaatcgagtgtatctttatatttcatcgctacaaatatttaaaggtagctattttttatataaattctaaacgtcaaaagttttaaataggaaaagtaggataggaatttgaacttccaagcaagacaaagacaacgatgctttgttttgtctgagctggtctgaaatattgtactactttatttatcttaaaatatatttccttcgttttaaataaaccaacctacgattaagtaagatactatacaatatacaatatagtaaatctggatagacttctaagtgtaccatataatgtttcattcagttttaaaatgaaaggaatactcctactaagtgttgtggagagcggaggagaggcaggcgagagcatagcagttctataccgggacacaacttgataaaccatcactgggctctatgtctgagatgggtcggctagcccataacaggcctgctttatggattcatgattcatgacccacctatacatttgtcgacaaattttcttctaaaaatttgacagatgtaattatagtacaatcatagtgtaattacactgtaacttatatgtaattacactgtaacttacatgtaactacaatgtaacttgtatgtaactttcacgtaattttgaatcgttagatctattacaagatttgttctagtgacgaacaaaaagatcacagtacacacatatgtgaaaagatttgttcccacgacctcgattttaccgaaataacatgttacggagagatttttgaaagttacatacaagttacattatagttacagtgtaattacatgcaagttacagtgtaattacactgcgattgtactgtaattacatctgtcaaatttttgggagaaaatttatcgacaaatatatagcaaaattgctaaagtatcgtatctgtggttctggatattcctaaagcatcaggatcgagtaacaaatgttgttaagatgaaacaatgaatttgttttgcgagaaatatctcatagagcaatcgaactcgaaatatgtagaaactgttttaagctatcaaggattgtatatttgatccatgtacatatgtgagcctgatacggattaggaggcgaatgtgatgtccctaaaatcccgtggatatggattatctgacaattccaccagaattatgtttgccagataatccaaaaatgttaacttacgctaccactctatctattgtatacaacataacgtgtccattcaataacccaatttatctgttaatctaggctctcggtccttcccctcccacctcctaatttctgacgtaggctctagcctcgtgatgacgttatcctcaacgcggcgacaacccaccacacgacggcgagcaacttattgtcttatcgattgcatatacacataacatctgacaatattaatttgctttcgagatgagtccgcaccaactatgcaacgtttccaacatcccgaaactatccgctcctcacccgcacatgctctaaatctgcttaaaacaaagaaattactatgtatttggcccatgtgtagagcttacatccgactagtacatgtgcaaagcacgactcttgtttgtctgggctcgcatggtaagaagaaaagcttagagattggtggatatgacacgattagatgagagttgtacgatagagtcgtacatatagcaaggtaaaaaaaaattggtgtaggatatgatatgactatcctaaatccgctttggtttcacccctacgatctataaatctctactattataaaaattaaagatgttttcgccggtattctgttacgttatccgtgtttgagttggtttttaagtttgtttgcttttggaaataccgattcgtgtttgagacggattttaagttcgtttgctttttgaaaatatggatctgtacttgagtcagattttaagtttgtttgtttttggaaatacaaaaggagtagtataagaaatctttttaaaaaactcgcatgctaacttgagatgaatgtcggactcctaattgcatctcatgattttctaaaataaaatatttaatagtgaatttctcctgagctgaactgtataacaataataaaataaaaattgcattcacccgttgcaacgcacgggcatcttttctagtaaagaaaaaaacaaatcatactatgaaaagagtagccacattttctgtttggatttgttacttgttattctatgaatgaagtttggtaagtgaaatgataggtggtaaaataatttatgttgtgaatttttcatgactatttgggttgcatgtataagacaagggcaaccctggatgacttaaaaatcaacttccccatgataccaaaatcctacatgtatatgcatctcattttgttcttttattctcatcacgtttaattatagcatgatggttcatatttcaaacatgctccacatagcatcttccatttttaagttcctgaacgccaaaaataaacaagaagggaattcccaatccatcgaggtcctcagcttccctcctccgcttttcttccagtctttctcctccgtctctcatcctctcgaattttctttccccccgtctctcatgcgccattgatcggatcgcttgatgccgnnnnnnnnnnnnnnnnnnnnngctgccgccgtcgccgggcgactccgacccgtcggggtctcgcgacatggacgacgaggacctcgtcgaggatctcctcgtcaccgtcaactcggcgcgggccttcgtcgagttccgccgcacgcagcgcaaggagtgcgccaacctcctccgctggctggagctcgtcctcccgctcctcgaggagctccgcgactcggcgccgccgctcaccgaggacgcctaccaccgcctcgccctgctcggacgcgccttctccgccgcgcgccgcctcctccggtcgtgccacgacggcagcaagatctacctggtccgatatatcctgcattcctcatcttcctccgtcatcgtctccaattataaaagttaatcgatataacagaacgtgttctcgatcgcttcagttgttaataaactaaaacacgttagacgatgacagacacgaacacacaacatttgttaacaagattcagccgaaagctatgatctcaaagctctgcttacgaacgctactccctattcaatatagcacctagccgctaagagtgtatggtctcgtcgccatcgatcttaacgatcttgcattgcttcgtcttgtctcaggcgctggagagcgaggcggtgcaggggagattccgcgccgtgtacgagaagatgaactccgctctcgacgggatgccctactcggagctcgccatctccgatgaagtcaaggagcaggtaagcctgcctgcatgcatgtttctgcctgcatgacacatgcacaggtcagacatgatcatcatcatcgatcgccatggtttctttcaggtggagctgatgaacgctcagctgacgcgatgtaagaagcgggcggacacgcaggacatcgagctgtccatggatctgatggtgatcctcgacaacaaggagggggagaggaacgcggacagggcgatcctggagaggctggccaagaagctggagctgcagacgctggcggacctgagggcggagacgatggccatcaagaagctcatcagcgagaggaacgggcagagcggcgatagcaccaagcagatcatcgagctcctcaacaagttcaaggaggtcgccggcgtcgacgagaagaacgtcctcggcgaggtctccgtgacgaaatccctcgacaagtgcccctcgttgatgatccccaacgacttcctctgcccgatcacgctcgccatcatgagggatcctgtcatcgttgccactggacaggtataccaaaattctccaagaacaacacggtgagattcgaacgagtttgacgaatttgaatacctttggtttttgtagacgtacgagaggaggagcatccagaaatggctggacagcggggagaggacgtgcccgaagacgcggcagcggctgtcgcacatgtcgctggcgcccaactacgcgctcaagaacctgatcctggaatggtgcgacaagaacaaggtggagctgcagaagagggagccggagcccgtggcggagcaggacgacgagcatcagcgcggcgccgaggacatcccgtcgctggtggaaggcatgtcgtcgatccacctcgacgtgcagcggaaggctgtgaagaggatccggatgctgtccaaggagtgcccggagaacaggacgctcatcgccgacagcggcggcatcccggcgctcatcgggctcctcgcctgcccggacaagaaggtgcaggagaacacggtcacgtcgctgctgaacctgtccatcgacgagagcaacaagcgccacatcaccaaggggggagcactcccgctcatcatcgagatcctccgcaacggcagcgcggaggcgcaggagaactccgccgcgacgctgttcagcctgtccatgatcgacgagaacaagctcaccatcgggaggctgggcggcatcgcgccgctcgtcgagctcctccagaacggcagcatcagggggaagaaggacgccgccacggccatcttcaacctggtgctcaaccagcagaacaaggtgagggccacccaggccggcatcgtgccggcgcttctcaagatcatcgacgacaaggcgctcaacatggtggacgaggcgctgtccatcttcctcctgctctcctccaacgccgcctgctgcggcgagatcgggacgacgccgttcatcgagaagctcgtgcgtctcatcaaggacggcacgcccaagaacaaggagtgcgcgctgtccgtgctgctggagctggggtccaagaacaagccgctgctggtgcacgcgctcaggttcggactccatgaggatctctccaagatcgccaagaacggcaccagtagagcgcagaggaaggcgacctctctcattcagctggcgcgcaagtgctactgaagatgaggaccccgtttgtaattgtaactcattttctttccccctctttctcagtagaaaaaattctgttgcttgccctgttctagctgaatgcatatgtggtgtatcgccagaatggggaattggtggtggaattgctgaaaaaaaacaccctaaatgtatttgtgccgatttcagtcaaactagttgatattcctataccattataagctgagttagattttaatgctaggatatacgatattagtttatacaagatcgatatattccgttataagtagaaaccgggtagtaagcagtattaaatagcaccttattatctggtagtaaatattgtgcaggtggtaaagaacaactaattgtgtgtgcgtgtgtgtggggtgggggggtgtttagtttttttgtgtaaattttttaaactatacggacacacatttaaagtattaaacatagactagtaataaaacaaattacagattctacctgtaaactgcgcgatgaatttattaaacctaattaatccatctttagcaaatatttactataacatcacattatcaaatcacggcgtaattaggctcaaaagattcgtctcgcaatttacatgcaaattgtgtaattaattttttttccacatttaatgccctatgcatgtgtctaaacatttaatgtgacatttttggtcaaaattttttggatctaaacaaggcttaggtaacaatgctagtgccgaatggaaggaaataaacaatcttatgtgtataatttatctgacacaccagtcacattgctaccagcaatggatgatttttttttctcaagtgaccccaaccttattcatcacccatacgcataagcattgtaaatgtagtaaagaactactacccactactgtttggactcacactaataccgagtttggtaagatacattgaggaagctctagcttaaaccatcatggttgaaaagacacaatatgttttcttcatttttttcgattaacatgttaatttctactagtccttgagagcaaacagatggctccttttcatcctctcacttaatataaacaaacttgagtaaaatgtacagtcgatcgttaaagttgggctatgtgtaatctagatccatgaacttataaatttagatatgtatttcttatcttgatttaatatagtactccctctgttctaaaatataagagattttgaagggatgtgatgtccatattcatattcgcagtcctagaaagtgttacatctctccaaaatcccttaaattatgggatggagggagtatcacctaaggtcaaaaatgcaaatgacttagcttgggtgctgatatggtgtcctcgccatggtggtgagaattttgcatgtaagcctctatgttatcatattgctaaaattgactcccaccactgctaaaatcgaccaccacagtgtccatggtaaaggagctgaagagatggcgactagaacggctattgagagtttccaaagccgaaatagataacatgatagggagagggtgattctgcaagcttggtacagtgtggggttgtcgttgtgaaggctgatgatggacctcatattacgagaggattacggcaacaatagcgggacaattcaaaattcaaaagttttgataaaagctacagagaagagtagtgcacgttagagttttgggatcgaactgcataggactcactgaaatagactaatttcagaagttttgcataaatataactagctgggtggcccacgcaattgcacggctagcatccaaacaaaatcatatatttttaagtatgattttacttagaatttattaaatagctatctcattgtcttaagagtttgaaagaccaaaccttatcatccccgtgtttctaattatatagttttttaaaagtcacaccagttgctaccctttatgtcatcatcttctttatttgcttgctcgttctaccactatttctattcattctctttggaacctttaaaaattggatcttataatttttagagtttattatcacgttgggttttgtttttataatttctaacatcccgtcaaacgttgccattatactcctctatggcccatccaccatctcttcttctttttgtcattgagattttaaaaatcgaacataattatcgtttgggatcatttttactttttagaagtcccgccaaaccgtcagcgactttgccattgtacttctctatggctcacgcgctgcctcccttctttattgccattgtacttctctacggctcgcccgctgcctcccttctttattgttattgagatttaaaaatcgaacatgattatcattgttttttttaccttttataagttctgaacctttaattgtcttgttgggttttttttttataatttatagaagtctcgtcaaacgatgccactatgctcctctacggcccgtccgcccccctattgtcattgtgattgtaaaaatcaaacatgactatcattggaattcattttttattttctagaagttccatcaatcgtcagcggctatactcctatacaccccgccagctgcttctcttttttattatcattgagattttaaacatatatgattatcaatggggtttattttttttactttttagaagtcccggcaagcctttgctcgtttgcttcacggcctgcctatcatacctccttttaatcgtcattaggattcaatctgttgctttattaacagtttttatatgtcatatcaaccaccaccactctactcatttataggcctgttacttaatttatctcgtcatgtgttttacatggtcttttattgaatctttcaatagtctttatttttatcacaaattttaattatttataaattgtattcctaattgaaatcttattttcctttttctaatttcagaatttattttttttctaattttaattaatatcgtattgtgttcttttaatattttttattttttattttcaacttaagtttgtcggtgacatgggaccgagagtatcgtgactagaggcttgggcagccgcggtcacccacgtggcttgaccccctcgagggggtcgggcctgagggtgacatggcctccccgccctctgtctccccgaggggtcgggccgctcccgtttcggccccgagggctggggcgccccgaccccttgtggttttggcgccacgtgtgtgggttaggtgagcacagcggcgcccacctaaccgcatttatagcgggttggacgagcgcgccacgccgcatttaatgcggcgctacgcgctcgcttatccggtccgtgactggtcgcagtgtgtgaccggtcacagaacggtcagatcacgggttaggaggcaacaggcggcctttcacacgcctcgccccgtcccgtcggaatgatgagagactctaggcactcgtccctagccggagccggcgtgctaactcctggagttagcacgtcagttccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaacaaccgtgctcccacgttgcacctgcttccggcagagtggaggttggtatgacccatcccatcggagggtcattcggacagtagccattgcaaatctccgcccattaatgaaggaaggacatggttatcccagtgtcaggcgaaggcacgagccaagttttggtcaaagtagggtgggtccccacccaaaagaaggataggtagaaatggtgcatgtggtatccccttgagatataaaaggaggaccatgcctaccaaggggggacgggagctgagagaggagagaggagagaaagagaaagaggaagagggtttctagagcttgaactctcttactcttcagctctttgtaactccttcacacacagatccaccagaacacaggagtagggtattacgcttctcagcggcccgaacctgtctacatcgcccgtgtcttgtgcatttgctctcttgcgaaacattccacagatcgagggcttagaacctcacctagcgcccccggccgaaccggcaaaggggggcctgcgcggtctcccggtgaggagacccacgctccgtcatctggcgcgccaggtagggggcgcgtgtgtttttctaagccctcatcctctttcgtgtgcgccaagcttctcccgctcagcccaatggccgaacgggcagtggcgcacaacctctctccgagcgctagcggtgacgacggggagtagaacctgcgccgtcgagctcgtactccaccgcccccctcgcaccgaagtcttgggcgggaggaggcgctcgagggggtcgaaagatccgcgactttgccgcccacgggcgatggagaaggacggcgagacggggagcgtcgcctcctcgtctatggcgatggcagcacgccccagggcgcgctccaggctgcgggcgcgctcctgcgtcacccgtccgtcgtccccgatctagagactccagcccgacgttggccggatgacgtggctgacttggtcatgacggcgcagcagcgcctaggcgccggcgggcggtcctccgccaccaaggcctctggcactgctaccgccggctctgtgtcatcgaggcggagggcgcggcgagcggcggccgttgcccgccgttcgtccgccattccctcgtcaatgcctccgacccaagaagatgtgcgtggggggccagatgcccgcctcgatatcgagcgccggcgcaatggtcgtcgtgctgcccacgcaacggagggcgcttcctcgtccggagcgccactccgatccgggcatgggggccagcctcccgtgtccccggttggtggtgccggctgtcgagcctttgtggcgagccttcggaacgtccgttggcccccaaggttccggcccaccatcaccgaaaaatacgacggaagtgtcaaccccgccgagtttctccagatctacacgaccgggatcgaggccgccgggggtgacgacagggtcatggcgaatttctttcccatggccctgaagggacaggcgcggggttggctaatgaacttgccacccgcgtcggtccactcttgggaggatttgtggcagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgctcacgcggtgatctacgcgttcagagggggtgtgcggcacaaccgcatgctcgagaagatcgcctccaaggagccccagaccaccgcggagctttttcagctcgcggactgtgtggctcgcaaggaggaggcctggacctggaactcctccggttccggtgtggcagctccggccgcccccgggtccgccgctcggtcagggcggcgggacaggaggaggaagaagaggtcggcccattccgacgacgagggtcacgtcctcgccgtcgagggtgcttcgcaggccacccgaaatgggaggcctgcgagcgacaaaaagaaggaggccggcgctcccagcagggaacgcccgaccggcaagtggtgttccgtgcacaacacctccctccacaacctcgcggactgccgcgcagtcaaaagtttggctgagcgaacgaggaagtgggaggaggagaggaggcaggagcgccgtgagggcaaggccccggcggctcccgccggcaaccggcgaagtgaggccaagcagaaggccccagccgaggacatcgacgatggcgacgatgacctggggttccaggagcctggggccaccatcgccaccgtcgatgggggagcgtgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtacgttgcccggggaggacagatcgcgatggtggtttcccccaccgtttgcaatgtgaagttggggcgtgtcctcatagacgggggtgcagccctcaacatcctttcccccacagcctttgacgccatcaaggccccggggatggtgctccggccgtcccagccgatcatcggtgtgacgccggggcacacttggccgctaggtcatatcgacctcccggtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggccctgatggccccatctctgtccatggcgacctcaaagtcgcgcttgcttgtatggagcagcgcgcggaccacctcgccgtggcgtccaagcccgagggtggcgacgagaggctcagcacctccgtcccagccgccccgaggcagcggatgatcacgtgcgacgaggtcccggtcaaggaggttgccctgggcgacggcccgtccaagaccacacgaatcggtggtcttctagacggcaaataggaagacgcgctcgtctccttcctgcgggcaaacgccgacgtcttcgcctggagaccggcggacatgcccggggtccccagggaggtgattaagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttatcatcagattcgcatggctagggaggatgaggaaaaaactgcattcataacccccataggaacttattgttatacgacaatgcctttcgggctaaacaatgcaggtcctacttttcaacgtactactcaaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaaccccgaaaagtgtgtgttcggtgtgcctgcgggcaagcttctcgggttcttggtctgtgcccgaggcatcgaggccaaccccgagaagatacgagctatagagcggatgcgccccccaagtaagcttagggatgtgcaatgcgtcaccggctgcatggccgccttaagtcgattcatatcgaggctgggagagaaggcactacccctatttaggctcctcaaacgccccgggccgttcatctggacggaggaggctgagcgggccttcactcagctgaaggcatacctcagttctcccccagtcctggtcgccccagagccagatgagccgttgctactctacctggcggcaaccccgcaagtggccagcgcggcgttggtcgtggagcgcgacgaggacaaccctcactccgcgcatccccaccctatgtcgactcgacccgggagagagcagggacgtgaggcccccgagccgaacggtggcccaaggcccccgacggccggagctggccctctgcccgcttgtccgacggtgccaggcgcccccgacccccaggacggcctcggggccactgcgggaaggccgcgcctatcgccctctgaccccgaggtcgtcggcacagaagccgagtgcgccccgcgcggcctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttaccccctcggccaaatcttgcataaccgagagggtactggatgggtggtgaaatgggcaatcgaactctctgaattcgatttgcactttgaaccatgccacgcgatcaagagccaggccctcgccgactttgtggcagagtggacaccagctcctgagcccgtctccgaccccgaggccagttcgggcccctcgcagctgcctcacaccgcctactaggtgatgcagttcgacggctccctgtctcttcagggcgccggtgcgggggtcacgttgacctcgccgagcggagacgtcctcagatacctggttcgcctcgactttcgggcgaccaataatatggcggagtacgagggactccttgcgggactcagggtggcagctggactggggatccgccgcctcctggtgttaggcgactcccagctggttgttaaccaggtctgtaaggagtaccggtgctctgacccgcagatggacgcttacgtgcgccaagtgcggcgtatggagcgccattttgacgggatagagcttcggcacgtgcccagacgggataacgcggtcgccgacgaactctcgaggctcgcttcctcgcgagcccagaccccaccgggcgcctttgaagaaaggcttgcccagccgtcggcgcggcccgatcccctagggagacggacgcgcctgaacggcccccgaggtctgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcttcgggaacaaggcgtcgagcttcttgccgatatccatgaaggcgagtgcggagcccactccgcctcacgcaccttggttggcaaggcctttcgctagggtttctattggccgacggctctcaacgatgcggttgacctggtccggcggtgcagggcgtgccagttccacgccaagcaaacccatcagtcggcccaggccctgcagaccatacctctttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcatcactgctcggtttggggtgcctaatcgtatcattacggataacggcacccagttcactagtgaactcttcggtgactactgcgaagatatgggcatcaagctctgcttcgcctcccccgcccaccctagaagcaatggccaagtggagcgcgccaacgcagaaatcctcaagggcctcaaaaccaagaccttcaacatcctcaagaagcacggcgactcgtggatcgaggagttgccagcggtgctctgggcgaaccgaaccacgccaagccgagcaaccggggaaacgcctttcttcctcgtctacggcgcggaggcgattctcccatccgagctcaccctgaggtcccctcgggcaaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcgctctgcgtcgacgacctcgtcctacgccgcgtccaaacgcgtgctggactgagcaagctctcaccaatgtgagagggtccgtatcgagtgatcggcgtcccccggccgggctccgttcggctggccacgggcgacggcacagagctgcctaacccgtggaacatcgaacaccttcgtcgcttctacccctagtgggggtcgagtgtcaggtctcgggctcgggccaacaccgcacccccccgggcgtgcagggttggccgggggctaccacatgcataagcttatattttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaattgccaaaaggggcccagaaccgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagcccttgtttaagctaagacacagaaggaccgtggcacagaccatcctcgtctcatacacacaacaaatgaaattgacacaaaaatttcctctttatttgattgcagattaaattagtctatacaagaaaggggcccgaaggcctcggaagaagaagaaaaagctatttaagattggcgggggcctggggctcacttcgacgcgcccgggccgcaggcctcgtcgtcgctgtcgtccgcaccaccgtcaccgccctcctcgtcggagtcgagggcgaacgcgagccgaggggccataccctcgaagctgtggacaatgtggtcggcggcgtcccggacctgcgcgcgcgcgccgtcctcggtcccaggagggaactcgtccagcgctacccacggggagaagtcggggtccctggtctggtagcttgccagtacgagctccactgccccccgggcgaggtctctcgaggatgacttgatcgtctcctcgagctcctcggggagccgctggagggtcccggccatctctgagaggcgctgggcaaggcccccctggttggcggcgtacttcgcggtccgcccgccccagaggcccgcct

SEQ ID NO: 11630 - DNA, 7533 bp, Oryza sativa
  unsure (1)..(7533): unsure at all n locations
ccctccgacgggcctcgagctctgaggtgtgccggcggtgtgccttgcggcccgcctccaccatggcctccaccgagcgtcgcccctcttcgacgcgcgcccacgccgcgtcgagctccgcccgctctgcctgcaggacctccatctgggcacttaacccgtccaacaccgtggtgttcgcggcggccaaggcctgcagaaggggctccgcgctcagtggggcagcggaaggcatgggggagagctgcctcggtgagggtgccgcacggctcggcccaccgatcgacgtgccggactcggggacgtcccccgaagctggctcgtcctgagcgtcgcccgaggggtcgggcccgagcggtgcgcccgcggcctcgtcgtgggtggcctcggaagtcatcgtcgcctcgggcggagtcgggtcgggggcttggcaggccgcctggcgtgcgcgcgccgcctccgcctcccggacggactcctcggcccggcggagtctggcctcctcccgagcggcttcctcagcctggcgagcccggatggcctcctgggcagcttcctcggcttcccgaaggcggtccgcggcttctcgccggtcagcttcccgcctccgggcctccgcggtcgccgtctccccggcctcagactggccggacttggaatggcgagggggggcgcgacgggatctcgctgaggcagaagaaaaaccagaagacaaaaaacgggtgagtgaaaacttgccttgggagatgggagaatgaatacggccgtagtgggcgcgaggacgaacctgcgaggaggtcggttaaacgaccaccttggggggagatgaggtttccccggcatggttcggtccccccatcttgcggagccgcttcttctttcgctccccctcgggttgcgacgtcggcgcggtaccctccgggcgcctgctgctggcacgtaccgccccgccccctcggggaggagatggggaaggggtaccctcctgcttcctcttcccccgggcgtcagcagggcggctgctcccgtcgcggggcccagaagcatgaccccctcccggggtagattgttcccccctgcggctcacgcccgcgccatcgtggcctcgaggggcccgctcccctgacgccccgaccgcttgcatgacggtcaggatgttggcgcgctctggatcgctgcagagcgggaggacaccttgggggatgagggatgcctccacggagctgagattcagcacccgttggatcaccatcttgaagtcttcagggacccagtcccacttgaccccctggtgggtcctcatgtagtcctcggacccggtgtactcccaggcgccccgggcgcgccgctggagcggcgcgatccggcgacgaaggtagtcgccgtacaccatggcccccgtgagcccctgggatcgcagacccgccaggcggtcaagaacggcgtcgtagccgtctcccagatctaccggcgcccgccagctggaggcctgcgccgggggctggctcggaagtcggagacgcgcttcgtcggcgagaggggtgtagaaccagtcgctcttccagtcgtcccacttcttgcgaaggacgcagggaatgtagcggttcagcaccggcccctgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaggagcttgagagcgagcgagtgcggcgagggtagggcgcaggaaacgaggagttagagcgcaagcggcgaaggcaaggggaataatggcgagaggaaggaaacgaatctcttcctcggcgtctttatacccttaccaacgctatgcccggctcctcgcttcccgcgcccactatctcgccacctcgtttctcgcgcccacgcctccaccaatcccactcgcccgtttgcggcgcacgaggcggatgtgcggccgtagcagttgagatgggacagatcgagcgcgcgttaaccatgcgcgccaaacgcgaaaagcgccatcattacatctccaggcgaaacgaaccggctcgtcccgattcgcgcgctactcgagtaatgtagcggtcttgaagaaggccgctcattattatcggtcggttttcccttgccgatgcgcgcgatttgcgaccgctgggttcctgcccgcctgtagagaccggccccacctgtcaccaggcctaaggagtggcgtcacgcccgagcgcttccctcgaggggggcgatcgccctggcatgacgccgggggctactgtcggtgacatgggaccgagagtatcgtgactagaggcttgggcagccgcggtcacccacgtggcttgaccccctcgagggggtcgggcccgagggtgatgtcgaaactagatttcggcaataataaaagggggtggctatcaagctggaaaagtgtatgggtttggagacgaaggatttatacaggttcaggccttcttattcaagaagtaataccctactcctgtccggggatgaatccgccgagtgtattattgattgtatggtttggagaaaatcaacctctgcccctagaggcacccggaccccccttatatatgggaaggagtccgtgttacaaaagataatctatatccctaacggaatatgcagatataggtaaaatacagtcgtaaccgactaagtctcaaggtgtttccttgatgtacaagttaagaaacgaacccgagatacaaataagatattatatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcaaatagatgcacctaattaggtgtagcccccaactatgtgattagttaacaaactaaacatatagttgagaacaaaataatagcacaatcgtgcatcatatgacaaaagcatatgcggcacctaaagaggcattctagccgactgctttttagccataataaaaagaatccgagtggttaacactctaaaaggttcacgaatgaacacacttgacaggcatccgaataaaaaactctaaagattacccaccaaatattataaaaattatggtaatgaataagtctaatagcctaagctatgactatccaccataattaaaacaggcatatgtggtgtagaatccgagtaaataaactcataaaggatttaccaaccgcctaaaaaaaatgactacaatatataatcagcctaagccataatattggtcaataaaaatgcacacttacgtggcaaaaagcaacgatattgtatccaatcaattgcttaaaaacccaaacaacaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacatgacaggccacacctgaaaattcgcattgcaataattccgaagaattatatgaccgcgtaaaaaaggattttatcagcattgggcaacactattgtgcgcataagttgccaaagcaaaaaatgcctaagtccctaaggagcacaatgggccacgctgtcaaaagtattgggctgaggtactgttcaggcctaagcccattcgcacctccgatacccttaacaaaaaatcccgtgatccaagcgccacttcgtcttccccgccggaactctcgccattttccccactccctgctacagtacggagctgcgccggcaaactagggttcaccaatccactcaaatccacattcgaaaagttcatcaaaatctttcccgtaattcaccgccttaatccctcacctctccctagccatcccccgaatcaaatcagcgcattcgggtaaaatcaatggcggaagagaaagaaagctttgaaggccaatgggcgccatccgacgtgatggaggagaacctgaaggagatggtggcgcacggcgttctccctgccaaggagatcatcgggtggcggccagcgtgcggtgaggcttttccgtcccccgatacacacgaggttgtggtcttctctcatttcttttatggcggcttcgctcttctgacctcgaaatttttccgcgggatattaagcttctatggaatcagcttgcatcacctaaacccaaattccatagtccacatcgccaatttcatccatgtttgtgaagccttcttgggaattaaaccccacttcgctctgtttcgccgaatcttctttctcaaaccccaaccaaacaagagcaagccatgtgtagtcggaggggccggatttcagctgaggggaactctgagccagaagtacttctcaatgcccttcaagacttcaaacaaagggtggcatgcgaactggttttatgttcagaatcctgagcctgctcttcccgagtactcttgtcttcccccagtgtaccaagatacttggaactctcttccgattggggacgaagcagcccaagccttagagttgatggaccgcatgctaaaactcaaagaacaaggcttacaaggagagcagatcactcggcacttcatcaaatgccgactggcgccagttaaagaaagatctcgtacagcttttgagtttgacggcaagcatgatcctaatcgcgaagaaccagactccctggattttaaaatcatgaaggagagaatgtataaaatcttctcaaatgctattgtcgtcagctactcacatcagctgccagttgtgccatataatgcattcaatccgcccccgcaggtatgtatctgaaatcttcaacctatgaccaaaatagtatcttgtcttcatgttgagttaactaaccatggaggcatcttaatcaggaatatgtattgataaaatctgatcccccaatcactcagcgccggtctcctcgccagcacaccgttcagggaggtggagggccaacaatcagaccagattcgcaacctcaaacctccaatccaattggacagacaggttctcgcaagagaaaactggtgcttgacaacgatgaaggcgacgacgacaacaaatctggggacaagggctcgcctaataaactcccgaagcgtaccatgcccaggaaaaaactggctggccgtcaaatgccaaagattagaacatcttccaggtataaacctcttggtaccatttccctttgacatgcttctctcatagaaattatactaaatattgaaagaacactttgcaggaaaccatccgacatagatccaactggaaaagatcctgatcaagctgtgacagagccaaatttatccaaggatcctgagccaactgccgaaagccagccgactggcgcccatgcttcgggtgataaggccgatccgagtgaccagccgccgactggaaaccagtcgacagcagctgaaactgcaacaacccaagagcccccgactggaaaccagtcggatgcaggtcccgatcaagaaatccctgaagttggagcgcagacgacaacttcccaaggaccagagactggtaaagactcaatgattgggtctccaaataaagaacaagggtcacctcacgctcagctaggaacatcctcaggtaactcgtcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggacgagaactcacaggttgccggcatcgtcataaaccgtcaaaaagaagatgaggaagtgtgccagctgaagaaggcgcttggggaagccactcgtattgtgaatgtaaatctttcaggcgactgcctttgatgactttgttttctttttagcagaactaaaccatgaaccatcatgcagagaatccatcttcgtaacgaagccaagaccgcaactttggagaagctggttcctcatttgggaactcttgaagcagttagggaccagctacacgaggccaaggagctcgccaaaaagacggaaaaagaattaagggagcgaattgctcagctccaggattcaaacttcgagctgagtggttcgtcaaaaggtaatcttctagatctgtcccattaatctatgctgtcataactgtatcctcaaccatttggatttcaaacagcgcaagccaccaagatggctcaaatggagaaacaaattgaagccttgaaaaaagacaaagtagaactggctgcgcaaagggactcggccttgaaggaggttgaaggtactgccagctagcaatctggacgtctctcttttaaatgcagcagattcttatcataaatgtgttttgtagatcgtaaaatcaaatctcaagctcagtttgacgtcctggttggtaagatcaagaggcttgaaggggcaagagatgaagtcgccaatgtcgctacaccactcgtccaagctatgttcctcaataacagtggtctgagtgcactcgacgcaaccgaaattttcgacaagctgaaagttgctccggatgtatatttcaagaacatcaagaaagctagaagtatgggagctagcatggcattggcgatgaccaagtccttgtacccgagaattgaaattgacgccattgatggctttgctgacgggacaagcgaagaggctgctcttgatcttatcagcaatgctcaaaacgcggctgacaagattgcaagtgacgttgtagagcaattccgcaacaacgaccttcagccgagcaacaataactctgatgatgaaaggactgattctgactgagtatgaatgtaacaaatggaggctcaatttgtacaatactggtgtatatatgctgtgcttgatagttctagccaaatctttgatttcttaaaagcttttatnnnnnnnnnnnnnnnnnnnnnnnnnnnnnnnnnnnnnnnnnnnnnnnnnnnnnnnnnnnnnnn

SEQ ID NO: 11631 - DNA, 739 bp, Oryza sativa
  unsure (1)..(739): unsure at all n locations
gatttcgatcactctttaagggtcatgaagtgaacttattcctgtaggaaactatgttggaaaaagtacaccgaaggtccctcaacttgtcaacgagttacaaaatcgtcccctaaccgcaaaaccagatatccaacgtcccttaactaaccaaaaccggtcacaaatggtccttccgtggttttcaccccggttttgtcctatgtggcggctgagtcagcgtgggacccatgtggactccatatatcaggctgccacatcaacgttgaacaccatgattagcacggccatcaccaggtgtggccggtacttgcaacgaagaagccgccacaacgcgcccgactcgtacctccggtcctccnnnnnnnnnnnnnnnnnnnncttgagctcggcgtcgacgtcggcggtggccgccccggccctgcggatgcgccacagcaagtcgcgggcctcgttgagcctcccacgcagcgtgaagctgttaggcgtgtccgggatggacgcggcgcccacgatgacgatgacggccgagacgatgtcggcgccgagtgagagtggaagtggcggcgagacaaccaccaccttattgggcttcggcgtgggaggagacggaagtcagcggcggcggtgcagcgcttagtgggggagctaaggacagcgagacgggcaaagagcttgaggaggcggcggtggcagccatgggggtcagagaagggagagagagagagataaggaaggg

SEQ ID NO: 11632 - DNA, 4121 bp, Oryza sativa
  unsure (1)..(4121): unsure at all n locations
nnnnnnnnnnnnnnnnnnnnnnnnnnnnnnnnnnnnnnnnncagttccacagcaagggagacatcgagagcggcgacgacagtgactcaaagtgggttcttgagtccttccacccccctgagcttgatcctgagaagatttgcaacttgtatgtgaacaatctgattggctgtggaggcactggcaaagtttataggcttgaattgagcaaagggaggggtgttgtggccgtgaagcaactatggaagcgtgatgatgcaaaggtcatgagaactgagatcaacacacttgggaaaatacgccaccggaacatcctgaaactccatgcattcttgaccggtggggaatcaaactttctggtgtatgagtatgtggtaaatggcaatctctacgatgcaatccgccgtgagttcaaggctgggcagccggagctggactgggagaagcggtaccggattgcggttggaaccgcaaagggcatcatgtatcttcaccatgattgctccccggccataatccaccgtgacataaaatccaccaatatactgctggatgaggagtatgaagcgaagcttgcggatttcggcatcgccaaattggtggaaggttcaccactcagctgcttcgctggtacccatggctacatggctcctggtaagatatgaacaattctgctcttgtatgttaaatgtttatggtagtagttagtattgcacatgaattccttaggaaaaaaaacaaaatgcgtaatacctcttcttccagcccttacccattcctctcaaccatctcgcggatgaattcgccatgccgctgctctcttgctcggccgccgccgccgcggcgccaccttgcgagcaggtcgaccgccgtcggcggctgtgacgcgcatcggccactccacccccttcttccccgacaggcgcccccccccttctaccaccgccgcggtgctcgagctcccacctccctcccattccctccccgcctgccgccagcaacctccccttcaaccaccgcccgccgcggccgtcgtagtcgaccgctactggccgcgccatccgccgccgccatcctccagtgcctccgatgcggacgaatttcttggcgattagccgattacatgcggtgaatgagtgggagtcccaccgggaatggtcaggctcatatgaagatggtatctttagaaataactgaaaataatttattaataaacgtttaactatatttttcatggttttaaaccgatgctgaaaaatatactactgcaacgataaacaaaaacactgaaatcaaacttaaaattaagtttcagaattcaatttttggttgggctaataaactaacaagcaacgagggtagaattgctactaggtattctggaaaaaaagagagagaaagaattgctactagtcatggacaatgttattaaaaaaaatattcatacatttttatatgaaagcaaatggcatccatcataattcttcaaaaggtgtaattctgacatgcatattatgcgtagttctgtagatttgacaatctaacatcagctcgtctcaaaatgcagagcttgcttattctctcaaggtgacagagaagagtgatgtttacagctttggcattgtgctgttagagctgcttactggacgcagcccttcagaccaacagtttgacggtgaactggacattgtctcctgggtttcatcccatttggccaaccagaatcctgcagctgttcttgatccaaaggttagcagccatgcatcagaggacatgacaaaggtcttgaacattgccatcctttgcactgttcaactgccttctgaacggccaaccatgagagaagtcgtgaaaatgctcatcgacatcgactctatctcagcaaacgggaaggcaaagaacaagaatgataagaagtaagaacagatgccccgtttctttgtaagaaactgctgccagaaagatcaaaaggcacccagtagcaacagtctgggtgctgccgtgctgccaattaggaccttaattagaatgcctgactagtgaatagtaactagtaggctggtaataaactgaggttttagcagcctctgaaaagcttgcacatatgtacaagctaccctgtacaaatttcagtcatgtactctgaagtttctgtaaaaatgatatgcgaagaattatgatgtaccagtaccacactgcaatgccagtagaatatgaccataccgttaaaaatggaaatgtgctgattttttttttagacaggaacaggaaatactaaaaggcaaaggccgttgtacaggttattccaatactactacatattccaacctctttctgctatgttccaagttccgacctgtttaatcagataggaacaacctaatgtgtcaatatagctgatccagcaaagttcagagttccaaatctttcaggaaccggccggatatccgagaaaattgatacacagagacacagaatcagagtccagaatcctacattgttgtacaactcgtagctgttttctgtttgtcactgttctacaatatactgcagcactgcttttagctgacagttttgaaaggggttgcaaccttcaggctatcaacaatgtcagtgacagagccaatgcccactgccaccgagatcatcaagcacaccatgctcaggccttgcaggagataccacctccctcccctggtgatcttctcctgcgcaatgtgcatgctgatggggaagtaaacagtcagtggccagaagctgaaggcgccgaggagccccagcaccgcgttgaagaacggtatcatcatcgccaccaccgtcgtcgcgatgactacgacggtccggaggacgagcttgtacggcgccacggtcaccgatcctcgctggatcagcggcacgtttacggtgtactcgctgttgatgaacttggcctccggccaccgggaggagatccatctctccattgtcgcaaatatgggctgtgcataaacctgcattcagaaatgcacccggtttaagaataatttcacggtgatctctactaataatattttactaccggggctcagttacgaacttatgatgtactgacctgatatgctccgatgagatggaggatgaggcacatgttggcaatgtcgacgagccagaagggccccataccggacgccgtcaggatgttgcccggagcatctgaaccgaacgcggcgtacccggcgcagccaacggagatgtagaagatggtggtggctccaatcccgtacatcgctgccttcttcatggtcttgttctccggtggtgacggtttcagtgtgtcctacaaaagcaaaacagacggaaaaaagcgcattagcgttaagaacgtactagtaccacattgctactcgcactaaaaaaatattggcacgaacaaaaagaaaatcctgttcgtgtatgttggttcagaggtagtatctgaatattgtgggtgacgaatcatcatcgatcgtgcatgcaaacctggatctcaattagcacttctgcaaaggtgtaggcgaaggcgatgttccccagtgcgagcagtacgttccagagctttttgctggaggacgccgcggtggcgccctggatcctgccgctgaggtggccgccgtgcgacacccactccgccacggacaggccgaggccgatgaaggagtaggcgaacgacatgacggcggcgacgacggacagccaggtgatgtgctccaggcccgggaaactgggacagcaccacctgcacgatgctgaacgccagcatgagcaccgtcgcctacgtgttgtcgcaccgcgcggcggcgccggcgccgttccgatgaatgcaatccgaccttctgatcgcgcttcgcaacacaacggaaagaaaaagaaaaacagacgaaatttagtagcctgaccgatggcgaaaagttcagttcggagggaagttggagtgatctgttcggttactcacaccatgcttatggttgcggtgattgtgtagccgaccatggtgccccacaggttgacgtactgcgcgattccgcacatgaacacctctctaggacctgaaaatatttttggcattgcgttcagtttaaccaacaagatggagatgagagaaa

SEQ ID NO: 11633 - DNA, 1258 bp, Oryza sativa
tcctgaaaccgtgaacgaatctggacggtattaggccgtatatataagggaggcagctgaaagtgggctttaatcagggctcctgatagggccggcacttggaccagtagagagcgccggttcggctcttccggactccattgggcagagtccggatgcaatgcgtttgacgagcaaggacctcatcgtttgcccaaaatttgaatttgattttgattttaatgatatctaagttttactcacatatcaaataagctgtaagcaaattgttaaaatgaacttgtgattggtataaattgatgtgcaattcgttttgataaaagaaaaactgattttttttaaaaaaaaaaaactaggcagacttagctggtgttatattaagtagagtgaaaaatatttacatgttcactaacggcgaaacaaacagagaaaaatgaaaaaaagctgggcgatgctatgacaattaacgttctcgtgatatctttactggcttgtttaattcgtgcacgattttggatgacgggctcccaatacgcttcatcatgcataataaatttgtacttgatgcatgcatactccctccaccagttccatattaattgatgttttagataaagtcgaggtcaaatttttataactttaaccatcaataacttttaaaaatatttagtttaaagtaactagaacaacatgtatagatttatctttcaaagcactataagtaaacatacatttatttattatatatattataatagaaaaatatggtcaaagatatattttgtagaccgtattattatccaaaacgtcaattaaaatgaaaccggagggagtactccattttgcttattttctctcatgggggttctgtcaataagaccgtgatattttctttttaaatttttatttagacaatcattttgtaagctcaaatgttatggttacgtatatcctaaaagtagaggttgaggatgcaatcatctttttttatcttaaaaaatgtctgggttataataccgctcagacatgcccctgctacctgattcagctcgaacctacaaagatcctactatggtataggaataaaatgaaaggaaaaaaatatttactcggggttgagtcccaataatcaaggaatttaggaacacatgaattactcaattgagttaattttacgcctcatgagagaaaatagtacatgtttggttagtaatttttttaccaccttttctgtccgtagcccgcgtagcgaaccaaa

SEQ ID NO: 11634 - DNA, 1643 bp, Oryza sativa
tgtcattgttaggttgtagtgttaaataggaggaattaagatgtataatcaattatctggagtgatgttctcttagtactacatgtagggtgacgtgctcagtactcctctccgagaacaaattaaaaactactttgctgccggttttgtcaaccaagttgaataataataatcttctcaaaactgaaaccattgttatatgaacccaaatgattgttacttcctccgtttcacaatataagtcattctagcatttcttacatttatatagttgttaatgaatctagacctatagtatgtgtagattcattaacaactatatgtatatgggaaatgttagaatgatttacattatgaaacggatgtagtatatgagatcaaatagcatgttgttgacaccaaaaagtcttgaccggcatccacacacacacagggtcatgcagaaccagtgaaccacacacacagaaaccagatgagatgagtgcagtagtgtagcgcaacagaaaaaggcaaaggcaaaggcaatgcatatacatacgttttcgcagctgcgtcatcgtcattcggttggagagacgtatcagagtagatggatggatcatggatccgtctcatggacatccactcggacagcaactttgggttgggaccttgctttctgcttcgccgtcatctgctacgactgccctcggcccttacatccaaaactgaccacgcaaacttgcaacaaatgccgcccgcgatagccgatcgataggtttgccggacatgtgcgcgtgtgtggtatcatggtgcgcgctcgatcgacgcagtgcgcagctgcggacacacacgtaccaatttcccggtcagaatgtcagctcgcagcagggtagtgataagtactgaagagactaaaggctggcgacgtatatatgtccacgtggggagaatgagatcgatcgagatggcatgccaggctgagtgcccgacaccgggccggtggttgccggccgagatgctagcttttttccaggattgtgaggaaaatgcgtcgcgctgatcagtttcggtttctctgcttgctacattgcaatagtagaaaggcagtgcgccagtgccggtcacgggccgctggtgaatcgtgatggttcgctggatggtttgacatgtaattccatatatgtatgctaagatgtcaggttcttgaaactgttggtaggcctatgtggatagagggaggtgaagcttgattgtgatatttgtttttttacggacagaataaatgagcactgccacattccatctatctgtccagaataaatcatcattccatctatctgtccagaaaaagatagatgctccattattcagttgcactctttgcaattgctttaaagagatcaatcagtttgaggttctctctccactaaaatgaatcatttaccagtaaatgccagtgaggaagttggtttgtataatacagttacaatatcatgttattccaaagaatatcatgatgcttgtaaaacttgtgtagattcttgagcaagagagtattgttttatgcatataaattgatctctcgaatacctctatttgactgtggcatacagactttatctcagacaataagagggtgtgttttgcttcccatatcggat

SEQ ID NO: 11635 - DNA, 825 bp, Oryza sativa
  unsure (1)..(825): unsure at all n locations
cctcctccttctctcctttctctctctttttctctcccctctttcccctcggnccgccgcaagggcatggcctcgggtgtgcgcccacccgccggaagctgaacgggtcccccaattgaagaagtcgacgatgccgaggccagctctcggcgagatggggtcgtcgtctgttctccgcactagccggcgacaagggtgctgatcggtgccagcgtcaccgtggccttcttgctcctgctcgccttcttcttcatcatcttgccgcgcggcggcacaccgccggaggtggtatcgtcgtccaaggagggcgggatccgggggcgtcgcgatggcggcggcgtattccaggttgagagctatggggagaggtgcgagcacgtcgccgaggaggatggccatgatcgccggcgattcccgcgtggctacgtcgactacctgtacctgttcgactgcgtgttcggtgtggagcggcgggttcttggctacggcgtgatggcggcttggctcgccgtgctgttctacctgctcggtgacacggcggcggtgtacttctgctccagcctcaagggcctctcgtggctgctccgcctctcccgacgatcgccggcgtgacgctcctgtcgctcgggaacggcgcgctggatgcgctctccaccatcgcgtcgtcgcctacggcgggggagagggggagaccaccaccgtcgtcaggaaacttgcaattcgctcacaactcacacgctcaacctcactgaatctctgaaactctgaagattgtaagactgtgaacagtaaactgaaaaaccgaagaacagagttctgaacaga

SEQ ID NO: 11636 - DNA, 1429 bp, Oryza sativa
  unsure (1)..(1429): unsure at all n locations
nnnnnnnnnnnnnnnnnnnnnnnnnnnnnnnnnnnnnnnnnnnnnnnnnnnnnnccagggtagacagaaaaaaaccgaaccaaaatgtctttttctaggactgaaaaagctgagaaattggatcagtatcaggtgttaaaggaccgaatttcattcggtcaattcagttagtaccttcgattaactaaataaactgcacaaatcaaattttggctcaataaggacctattttaaaaggggggttttccccagcaacccaattaaatcgaattttggcctctagcatgcttcgatatatggcccgtgatagcgaagagagtcaatttgtgttttgtgggtgtgtgtttatgtgtttcgttcctgttatctggaacttagacttgccctgattattttacaacttttgatattccaggcctgatcgagatcgagactgattttcttgatcttcattattttcctaaattaattggtttctatttttagataaccgaaacttgtagaagatcaaagatcgagaccggattttttggtttgaccaaacgtccgactctagaggatcccccttaatgttacggtgagaaaatgaatcggacttaaactatagttgaggaaaggcaatataaactttttccttacaacatggtggaagtgcaaaacttccggtgatgtgcttgtgagttgtgatgcgatcactcctttcttatctctacttacccaactcacctctttcgttttccacgcgtacgtttttcatactgctaaacggtgtattttttatgaaaaattttttatataaaagttattttttaaaaaaatcatattaatatatttatatttattttagctaatacttaattaatcatacgttttattttacgtgctagggagtgacggttcccaaccctcgttccgaacatagtatcttcgtcgcttcggtgaagcgaaccagggagtcaccgagtcggcgtgataacgaagaagaacggcttccagaacgtctcgtcaacccaatgacaaagaatggaattaaatttaaaaatatactgttgatttgtttttccttagaaatattcgtggcgtaaaatttagaaatattcgtggcataaaatttttagcagaaatataccatcaatctcgcacaaccgttgtgcaaagaagcgtgacgacgcacaccgcgcagtatcgcgagaccgaacgtcttgtccagcggttctacttaattagtgatcaattatcctaattatcgaataataactagtgattaattatcctaattagtgattaattaacaattaatcaatcactaattaacaattttcaaccgtcgtaatcgctcactgattgagagagactgctcggtctcgcgggttggccgcgcgagaacgtgtggtctgacgccgtcttgacgcacgttctcgaattcgtc

SEQ ID NO: 11637 - DNA, 1255 bp, Oryza sativa
cttttaaaaatatttagtttaaagtaactagaacaacatgtatagatttatctttcaaagcactataagtaaacatacatttatttattatatatattataatagaaaaatatggtcaaagatatattttgtagaccgtattattatccaaaacgtcaattaaaatgaaaccggagggagtactccattttgcttattttctctcatgggggttctgtcaataagaccgtgatattttctttttaaatttttatttagacaatcattttgtaagctcaaatgttatggttacgtatatcctaaaagtagaggttgaggatgcaatcatctttttttatcttaaaaaatgtctgggttataataccgctcagacatgcccctgctacctgattcagctcgaacctacaaagatcctactatggtataggaataaaatgaaaggaaaaaaatatttactcggggttgagtcccaataatcaaggaatttaggaacacatgaattactcaattgagttaattttacgcctcatgagagaaaatagtacatgtttgtttagtaatttttttaccaccttttctgtccgtagcccgcgtagcgacccaaatcgttagccccggtacaaagtacaagtgattgtaaactttcatgttattaaataaaaagatgaatgttaaaggacatgtagtatagtgattgcaatgacctaagtagtactcaagattctgtgttcaaatctttataggaacgaattttagattgggctatttccataatgaaactatacttcgaaatcaaaaaggtaaaccatgcatcgatttctgcattattttttttcgattacacaccaatacacacgtgcacacctgcaaatatattcctaatacacactcaaaagatacgaagactaacggtaaatctcaaaccttgtcaattaaattcctactaaaaacataaccgtgtatgtaaagcatttagagtggatatcatgatttaaaccctaactaataagtaaaatcatatagtaataaccatgactttaccatcataccacaaatacttcttaggtttccacgatccaagcattccttgttatagtcaatcaagtacgcaaaatttatctccacggttgttgtcattgttaggttgtagtgttaaataggaggaattaagatgtataatcaattatctggagtgatgtcctcttagtactacatgtagggtgacgtcctcagtactcctctccgagaacaaatt

SEQ ID NO: 11638 - DNA, 5924 bp, Oryza sativa
  unsure (1)..(5924): unsure at all n locations
nnnnnnnnnnnnnnnnnnnnnnnnnnnnnnnnnnnnnnnnnnnnnnnnnnnnnnnnnnnnnnnttttgtgaacaatgttactatcactttatcagatgaataaatgatcaaaataaaagttatagatcttgatgagttattcaactttgttgttgataactttttcagttgaaatcatttagtatttgaaaatgttgtttgaagttgtcatatttttaaattcaaattcaaacggttaaaaaattgttatatagaaaaatgaccaaaataaaagatatagatcttgatgagttattcaactttgttattgatgactttttcagttgaagtcgttcactaacaaaaaaattctatctgaatttctcaaactttgaatttaaaatatcaaattgtttaaatagagttagatggagaaatgaccaaaagaaaaattttgcacctcgatgagctctacaactttggtttcggtgacttttccatctgaaatcatttattaaccctaatttttcttcgaagttgtcaaattttgaaaattcaaaatttgaattgttcaaataaacttatttgtacaaaggaccgatacaatagttgtagatctcgatgagttatacaattttattctttatgatttttgatggttgtgtatgtgaatgaatgtatatgaatgggggatgttggggtgtgacatatcctggcctagggcttaatagaattaatagaatgctcataccaacaagctacaactactcttccggaagtagttctccacaaaaaactttgatattaaacgtgcttggtctggagcaattttaggatgggtgaccgatcgggaagtaaacttcgtgcacacgaataaggacaaaaaaaaaggattggcctgagaggggctggacagcatggcaaggctagccaaaaataaaatttattttttttaggattatactcatcagtgacgggcattaacttaggcccgattgagatgactcatctgtgacgggctatagtttgacatgtcgtcagggtcaaagctatcagtgacgggctttaattagggcccgattaagataggttcatccgtgacgaccgtttgcccgattgagataacttttcacattagtgacttctagcctgtgacggatgccgtacccgattgagatgggggttgccgccagattgagataatggtatccgttctagtgaacacatattctaacattatagtataaaacataagtatctttttttctttataggaatagactcaatttggttaagtcgatactttttgcactctcaactttctacccttgaaactaaccgtaagaacgggtagatggtttatccatcagttcgtagctaacaagggtcgttgcaatttgcaaaaaaataatatcctataatagtaaaaaatagtgataattaatagtattacgtacgactgtgatagttcaatacgatggacaggaagttagattgggacatggaagcagatcatgcatgaccgtctcaatcgcgcgcaacaataatctactctcttcgtccttaaaaaaaaactaaagtaatctagtcatgagttataatatttgactaatttgtcatatcatgggcaagataaagctactagcagatgggattgtacgtgattaaaggcacagaaaaatgcttcatgaggtggtagtgctgagctttagcaagcttgcgtgcaacgctctctcctttgctcgacgagcaccagatgaccccggcaagagaattgcatagcacctggtaatcccaccaactctatcgtcctcccactagtgaatatttcctccatttttctttcagtgtgggttggatcaaatcatattctctacactttcttggattaatttccgcgtaatttccaattaaaaaaactgcagcactctcagctagccagcttgatgaacactactagttgttcctacaattttcatgcaaatcatgtagtaaatacagctctataagagacaaataataccaccggcagacagtagatccaacgcatctagacggtttttcgcagcatcaaagatttgcttccaggtttcctagtgcctctcgagtaagcgcactatatggacacttggacagtgatgcagagcgtggctaaaaggagatggtatgattcttatatttctgctttttgttgtgcaacacattaatttggtctttccatctaaatcgcgtcgatgtaacagactttttattttccacaaagatgaactttcgctacccaaggttccgaccaatttctatggccacagtatttaaaagttttcgcttggtattttatatacatataaggagcatatgtaaaagtgagagagtttgctatctatggaaaacagtagttaaatttactagcatttgcaagttgcaatcatgcatggaaggatggaattgcacattccatatatatgagtaaatttcacagaactacatgtactttaaatcaaattatcgtaaaactatatatttaaggtaatgtgtcacacaactataaatttaagaccaagtataaaaaaactacaaatttaataacaaaattatcacaaaactatagggtatgtagtttacatccttacctctaatattatgtttgagttataattgttcaaattttgtgattaaattggtgtaaaatctgtagttttgtgataactttgttactaaatatgtagttttgcgatattctaccttaaatatgtagttttatgataaatttagtgttaaatttatagttttgtgatatatgttaaatctgtagttttgtgatagtttggctaaaatccatatagttttatgaaatttactccatatatattgaatatattattgaatgttggctcctatcgtgcttttctcttctgagggactcttgtaatgtatatatgtctagattttggagtaagataagtttaaataactctttctttttcgccttgatcaagacattgcatcaattttgtaaaaaagaaaggatataaggaatataattacatccccacgctatatagctataggacacatataaccataatgtttgaataaggtgaatgaagcaaatacattaatgctttccatgaaacacacaaaaaaaaccatgtattttttatcacaataattgaacaatttctgcactatttctttagaaaatcatgcgatccaactagggcctacacgcacatttgcaaacggtgacatctattgccatgtttattctaaacaaataactcttgtttatcaagaatctatgtaacaccaatatttttttaaggcaacaaaccaaacatccacactttaacgaaatataacggattataatgtatcccccctaaccacctctcatttaatttttactcaatattacccctaaaggcccttccactcctcacataccccttctctaataagtggcattatagttttttccctttaaccttaatctctcttagatgagtacaacatagtatttattaattctaaatttcaaaaatattaaataaaaaatataagtaaggcttcaagttgaataaaactctatatctattattataattctagaagttatttaaaaactaaatttagagtgcataattagtcgacatggtattgttaattaattactaattactatagtaaaacgctggataccacgaagggacatggtagcgatcaagagaggaatgagcgctctaggagtcgaacatgagacgtgcccgcgctccacagcagccccttttgccacctgcactagcacgcagtctcacttcctaaagtatcaactatcaagtaaatacattggaacattaaaataataattgataaaggtactaggatgattctatatacaatttagaattagactacatttgagttttgtatctataaatgcaattatattgtttattatatattaaatggtatttaaatataatccccaataaataagataactgattaacaactaatattgttgttaacgcgaaaaacacgcaatggcctaagagatatgcttaactctagtgcaggtccaaagaaattgccttcaggttctcagcgtgctagctggtttgattgtgcaaccaacaagaaagaaaaaggaaaaagttaaatccaccaacgatagcagatcggctggattgccgatgacgtatcttccggagccatgccgatgtgacttgcatcggaccagcaagggaagataaaacgtagagattattagatctacttgattggctgtagatgtcaatgatacatagcctatccaacgaaacacacttagatcgggtgattgggatagatcggatgttatgccgagacagtataaatcactcaatatctaactgtacctcaaagcagaggttacgtaggttcatagcatagttgatggggcaaacctaacgtgtatcggctagtactccgataccgctttatactaagatatcagcgcagataaaatatacaaaacaaagatcaatatggcaagcagggtgcattaacaaattgatatatagaaagcctaatatgctttaagcgaatgagatcttcatataaagggcagatttagacgatcaagaaccgggtagggaaacaaaacggctaaatcaggtaagatcggctgaaaccccgatactatctctattagtaatcaaagaaagagctagataagacgtctcaagatagcacttaacagatcgaacctaaccgatgcaacattaagcgtgaaaagaaacataagatctaagcaaatcaatgagaactcattcaagatggtagatatactgcacaatctagcttggtgtcgatatctaaatttatcggccgttttcgatgatagaggctagccgatgaagttagatgacgaaatctatctagattatacagcatatatgataactcggtgaatcacataaacaggattagagtgtcataaagatgtaagcactaatccagagaacacaaaccgccatagcaagctttacctctttgtcggagatcgaacccgatgtagcccaactcgaaagcaaaaactcgtcgaaacaatgagaatagaaaagggtggcgatgcgccgaagtattattgaactgtcgttctgtgattacaaggtgtcaggtcatatttatacccgaagtcagggccggcccttgccctatgcagccaaggcgaccgccgggggtgggggggcaacacctaatactagtaatctagtaccttatccgatgttgagatcaatgatttttattcagaattaaaggtattgcaagtgagttttctaaattcttcgatatgatgtccgcgcctgagattctgaaatttgttatgaatgcatatttctatccaaatgtttcagatgcctattgaattctcttaaccgtacctgtgacggtagcttcagctgagaagtttttcaaaattgaagttgttgaagaactatttgagatcaactatgtcacaagaaaggtcaaatggcttggctatgtgctcaattgagaaggatatatcggacactattgatcttaattccgttctggatgattttgcatcaagaaatgcctgaagaagtatctttacataggaagcagtggatacgatggggttctattcttcattaagttaatgaataatgatattagttccaagtttcaaatatattgttattttggtcgactttatttcttaataattaccaggcatgttaaatttaatatatggatgtattacaagaatatgcggatgggccaaaaaaataaatagtttgggccagaaggaaaagaaacagatgtgagaaaaaggaataagttcatctaaggtcccttaactttcaacgaatccgattttcgtccttcaaccacaaaaccagatacaacgggtccctcaactatcaaaaccggtgcag

SEQ ID NO: 11639 - DNA, 6034 bp, Oryza sativa
atggggagagaggaggaagaggggtaaggatgacatgtggggcccacgtggggccacgtaagcgccacgtcaataccacgtcagatcaagaccaagtcaaactagccacgtaggtgccacgtcagccaaaaccgccttcaaaaccaccgagggacctaatctgcaccggttttaatagttgagggacccgttgtatctagttttgcggttgaaggacgaaaatcggattcgttgacaagttaagggaccttagatgaacttattccgtgagaaaaatatttgggccaggagacaagaacatccggatgggccaaaaatacagtttgggccagaagaaaagaaacggatgtcaaaaatattaaaaacaaattggcttcgcccggactcgaaccggagaccttcagtgtgttagactgacgtgataaccaactacaccacgaaaccgatgttgtacttcgttgaaaaatttgtttttaatattattttagtacccctaactttagttgctttcagaaataagttctaaatacaaaaggtgctaatactcataattgaattctttcacccgaaattcctatatgctatgcttgacgatcccaaccggaataacgtacacagttttgtccataggataaccatactcctcaagtcccatttgctaaattcagaggtataaaaacagaggggcttgtactagtagtagtagcttgtaacacgacagccaaattacaccagcaactagtacgagtacagcaacaaaagtagtaggagtagtactacatgcataatctcatcggctgcatgcgtccatccgggttcagagctgcgtttggaagatggtgacgtggcgcaggcgctgcgccatgtcggccaccgagcccaccgccgcgagcagcgacacgacgagcgcgccgacgttgagcgcctgcagcgccacccacttccggctgcctctctgcaccttcgcctgcgccatgtacatggtcaccgggaagtacaccgtgagcggccagaacgcgacggcgccgagcagcccgagcacggcgttgaagaacggcagcaccagcgacaccaccgtcgtcacggccacgaacgccgtgcgcagcaccagcttgcacagcgtgaaccgcaccgcgcgcccgccgcccagcggcaccgcgtactcccggtggaagaacgccgactccggccaacggctcgccagccacttctcgtagcacgcgaacaccggctgcgcgtacacctggtacgctccgaccaggtggatgacgacggcaacgttggcgatgtcgacgagccagaacggctcgaggaagccggtgaggacgttcccgggcgcggcgttgccgaacgccgcgtacccgacgcacccgatcgacacgtagaagacggtcgtgacgccgatgccgtacaggctcgccctcttcatcgtcacgttctccgacggcggcgacttcaccgtgtcctggatctcgatgagcagcatggagtaggtgtacgcgaaggcgatgttcccgagcgcctgcaggaagtgccacgccttggtcgacgcggtgacgcctccggcgccgaccctgacgccgaggagggtgccgtgcgccgcgccgtgcgacgcgaccttagcggcgctgaggaagagcccgacgaaggagtaggtgaacgacatgacggcggcgacgacggagatgagcgtcaccccctccaggctcgggcactgggacaggacgacctccgcgaggccgaacagcaccatgtacatcgtcccggacgagccgcaggtcgcgtccggcccccttgtagtggtggcagttcgtgcgcaccactgacctgcattctcacggcccaaatcctagtacatgttactgaacaaaaatttgccaagatttttcagggtggccaagaagctggagctaagcttacatgatgctcgtagcggtcgtgatggtgtaacccaccattgcgccccagagaatcgcgtactgcgcaatgccacacacgaccacgtctcgaggcccttcacacgatcgatcaaagcaacagtcttgtcagaaatcgcagagattttgcaggagaaaatgcaggtaagtctcaaaggttcttagctaccgaggcatgagcggacgacgtccatgtaggtgtagttccgcttgccgtggacggggtccggcgtgcggtagcagtcgcagaggaggacggcggtgtagtaggtgatgtaggcgcagacgacgagggcgatggggccgagcacccaccccatctgggccacgctccacggcagcgccagcacgcctgacccgatcacggcggtgatggcgtgcgtcgtcgccgtccataccgttcctgtgaaaaggaaacaaaattcagtttcgtcagtgccattcttgcgttcttgtgagaaaaaaaaaatcctgtgagaatgtctgacaggtcactgtcatttacattacgtgtgacattcttgccttcttggtctcttggaacacctggctgattaagcatgaacatcaataaagatgcagtgcattgaagagattgccatatcagcgcggctaaaaagagatcgccagatcatagatcaattacagtgggcatgatgcaacattgcacaagtcaacttcccagtagtgtaagaagccatcattttttcaaaaggatctccaggattccatcatgtgtcataaacaaagaatccgtttgatctactgcccatgcgctggataccataacgtaaagcagaccaactaacgagtacaaatagagcaacaggttcatatattacgcatgtgatttaatcaccatgtcctaaagcagtaacacttaaaacaactaaagaaatatttgctgtcttacttgtgttaaactaacgaatcatcgcaaatgtataaacagactcttttgaacaacgtaagcacgcacatgaatgaaaacacttatgtaatgctctggtggcctatgtggagtatgatgtggtatcccaaccaacatcaacatgcaaaggaagtatgatgtgaaatcaggcacttgctccctgatgtaaagtactagcagggctaaagtacagtcaaacttttgtccagtaaaattccttaattacaatagacaattgccccgaaatcctattatttgacatgagtgtacttatacttaactggtcattgtcaagactgcttaatggcccgctcttcatcacagcctatgatagctagtcacaactcacaacagtacacccaagataaccagaaaaaggaagtagtagtacaacagaatatgcactatgttttactttaataccatgaaagctatttgtcgaattaggatgcgtgatgtaagtggagagagcacaagctgcaggttaatttgcagccattcatcgatacctaatccattgctccctcacgcgaagaagaaacgttccaataggctattgccaacaaatagtgttttccattgtttctgggattccaatataacattaggataatgattgcacatattgaaattctgcctataatcctggagtattagtactgctgtaccgtataacactagtaaagccaaggccacttggacttggtagggtatatagtagagtagaggtagtgcctgccaagtcattggcgatttggatcttgcaagaggttgcgtgctgtaactatatgggaattaggacccagttcctgcataaatactatgccactaacactgttactatccttcacgttgtcctagtaaaagcagtggtaacagaagcttcacgcaatggatttcgcattttcaggtgttggttttatccaataatgctagcatatacgcaagatgcctctattaaatctatcccgagtttcagggatgttgctgcaatgctgtgacgagtgttgtgtgtaaaacagaagaaagaatatgtgcgtattcgggagtgtagcatctcattagctagacatgcatccaagaaacaagacatgtaaaaggggacaactcttttacatggcatttctttaagataaaacactaaaataggcattgaattcattatatggcagtgtttaataagagaagtgtaaattccctgcctctgcatttgcagtgtgtatttgtttggttcttccagtacggcgcggcgtaaacaaaatggaaaagaagggtttgactttcagtgcccatgcatgcgtgtatgctccatcagacggcttggacagcaaaatcatgcattgactaattccaaatcttttttttttttgcatgtacttggagaagcaaaacgagagagtcctacaaggtttcgaaaggatgcaagacaaccgcatgttccatagcgcgctgaagtctgaaagcgtctttccactgggcacacatctggctagctctcacttgaaagagaggcacaagtcaataaccaccctccaacgtacgccagcaatgcacgtttctgtccaaattcagcaatgacagaggctcgcagatctaccacactcaacggtatgtggtgacaatgaacatgcagctaaactacgatgaacaacggaacagagtttcagaggaaacagcagctaaatactctgcatgaagcatgaactgttcaggtgccttcctagcagaagaaagacaggcagggtagccgtaggatagtagtaggattttcggcgacgacgacgactgtgcaaacgcgaactggaaacagagaggatcctgagaattacctgttctgacgcggccatcgtcgtcgacggccacctccttcctctccaccttctccacgtccatactctctctgtgtacgagtttccctctctctcagtctccggcctctcttatctgagcggaaaggattttgagcgaattctgaagcctgtgcgctgcagctatatatagagctggcgagcttttgcacctgacctgtttcccactgtagattcattcttttaatacggtcacgaaaccccacgaatcctactagtacctcagagtcccctgtagaaaatgaaggttttccacgtcatttttttagtagcaataactaccaccagattatatgcctgttacatttagttgaacctaccaaggtgttcacaaaggtgcagaagttctggtgacttttatgaatctgattagtcaatttgggatgaatctggttggtacttgcctactacattcattccataataattatattcttaagattttatttttcctaaaataattaccacgatagagtattaatatcatcaatcacttattcaattttcccatattctattttcaaccattctctcgtttttatatgtacaccatttaatgaagcgagcattataatctttcttttcaaatcttaatacgtagtacctgctaataaattataattataattattttgggacggaggtagtactttgtaaccacatgattgaaaaatctgaactaataccttctgcagttgagttagtgagcatgttatccgtctgattttggtaatttctaaatatccctgaagagaagacagtgatgctgatgatcattcaggtggtagaaaatgaagtgctggacatatctcagcctctcaggggctcagggcttgacccaaaaggaaagccatcttctgcttcatcatgcggccgccacgaagcacacattgctacaaagctgcatgaatcatgagattgctgctcttctcctctcatctatcatcgtgagatcatcgtccatctcttgacgccaccaaaagaatttcaggttcagaaacaacaaattgtttcttgcgattcactggaaaatcaaacacggctcgtaattcacggccggaaaccatcaaagtttgctgcgtggttccaaaaccatcaacattatgtacaccctgtaatctgcctatatatggattatatttatggatatgtgctgtgtgcaactgtgcaacagcgtgtctttgctagctcgtgccaacgcagccaaaggggatcctcacgagtcgacataggcatacaagctgtagattcagggctggtttggtttgaggcctaaattacgcctaccaatatttgac

SEQ ID NO: 11640 - DNA, 4953 bp, Oryza sativa
gaattcgagctcggtacccattttggcttcaatccaaacgcgactttgccttactaaaattagtcatgccaaaacttaccaaaatttggtactgacaaaatttgataaggcctatttaggccacaaaccataccaacccttacttgacgaatctgaacacctaaagctgggctgatggccagtttgggtccaaataataacaccaattaacgccataaggctgtgccacggcccaggcccaggcccaggcccaacccaatcttacaaaaaaaaaaacaagtaaacaaccccaagccacggctccgagaaatacaaacacgaacacggcacacacgtctacgtgagcccacggggattattgttcgagtcaaatatgttacaagcaaacacgtggttgcatgcggcgagccggcgtgcatcgcgtcgaccggttttcagttcttggcggtggtgaagcggtacgaggcgtatgatagcgaggcgttgctccagctgcggtggatcagctccgccttggccccctcaccgccggcgccgagcgcgacgtgcagcgggaggaagtgtcagcgacgggtgcgccaccctgccgtgcggcgccttctcctcgtaccgcttcacgtcgtcgtgcctcccgccgagcagcgcctcctgcagccacccgtcgaactccgccgcccactgcggcaccggcgtgccctcgggccccatcctgcggaggttgtgtgtcgcgctgccggagccgaggacgaggacgccgtcgtcgcggagcggcgccagcgccctgccgagctcgtagtggtacgcgccgtcgcggccgctctgcagggagagctggcacaccggcacgttcgcctccgggtacatgaacatcagtggcacccacgcaccgtggtcaagcccgcggctgtggttttccttcaccggcccgaacccggcttgctccagaagctccttggtcttcatcgccagatcaggagcgcccggcgcagggtacttcagctgtttgcaacaacattattcggtatggtcagatactgatgcgatcatgcaaatgcaacgtcattattcagaagggtagatactgatgcaatgaaattattcagtactatggtcagagatactgatgtagtgattacgttatacgcatataccttttgcttccaggaaatataacgttttccatgcatgatgcatccttttgagcggaatggatttaagttatagtatgatttagtaattgtttggttgcatataagaaaagagtacaaaatctttctattgaaaagttatcatacgccaacaatgaatctaccttcaaccacacgactacaggagcatatatgatggataaatagtactccattcgtcttaaaatataataacttctagcacttaagatttgtcccaaaatataaaaacttcttcactaacattcttttctcaatcaatcacaattcttcaccattcaattttcctacatacctgcacttctctctcccatttaattctgactactttcttaatacttgtgtccaacactaaaaattcttatattctgggacggaggaagtagcacatacttataataatgcatatatagtacctaactaaatacttatgagtagcaactttccttcgacgaaaaggaccaataagctactagatgagtaatcaaatccttatggtgatgcatatatactacctaactaaatattttgtacggcagctttgatgggtgtggtttctccgataacaggttcacccaaattaccagagtacacacccatttttattcgactggcttaaaaacaattgcgtaaatatttactcttggccatcataacctttactagtaatatccacaactatcttatggtgtatatgctagtccttccgtcccaaaatataagctattttggtgaatgtgacacatactagtattatgagataaaatcccttatattttacaacggagggagtaactcaaatgctgaacagagtaatgaaaatgaaactaaatttaattagccatttagacatagctcacagcaaaatccttgctgactgatcgactgaacgatccggcagatgctagtgacaagcgcactttacccacttgtagtagtttggtatgcccattgcccacaaatattccctaattttgctcacagcctcaaacaaaatacacaatgtcatgtctgcatcagatgggatgctggggttggtaaaagttcagatcagctaaacttttgggcatctcttcctactcccatgtttaagtggtaggacctactcccatgtttaataagcatatctaagatgcaatgggacatgtacttcacaaactagcatgaaagatctagtataatactagcatgttttagtctttgattgcgctccaatcagtcccacgtgatataaaatatacaacacgagatacctaaatactccatgcataataatatatagtagtataacatatatggagaagtaatcttcacctttgaccagtttcccctacatcaggcgcggggttatcacaccccagcggtaagtgaggttaccgtgcgatatttgtgacaaaccatacaaaatttatcgaaatttcatttattattttaatttataagaatttgttggggttattgcagtattaccattaccatatccggaggtaaatgcaataaccgtgcaattacggccgattttgtaaacctgcctaaggctatgagcatgcggagaaatggtatcatgctgccatggtgttgcctacgagtaaattcagaccagttgccaaaccaggtttcagcaaccatgtagtgtggttttccgataaccaaggcagaaagatcgatttcttcccatatattctgcgcgatttggaatcaaaaccatccaaatttgacgtcttccctatagcatgtaggaaatccgaatacccaatccttgaggctgtgttcccaacatcttcaacctcgttttccgcgcgctcatttccgaaagtgtaaaatgcccaaagtagaagatgctcgaacaaagaaacgaacgaccaaggtccaattttggcggaatcgctccacgttgtacggccatttctcaatcaagaaacaagggattcgattcgagggaaggagacggacggacggacggaccttgtacatagccttggggaagccgtagaagtcgtggatggtgtcgttgttgccgcggatgacgttgaccgtcggcgcggccgcctcccagtggcccgacacgacgaggatcgcccgcggcaactccgcgcccgccaccgccgccggcagccacgacttgaagaatccctgcgccgcgatggtgtcgtcgatggacagcgtgggcgcgccgtgcgacaagaaaaaggtgtcaatggcgccctccgccgcgcgcctcgttgtagtcctcctcctcccccttctttcggcttcgaagggcgctcccctgctgctcgtcttcccccggcgtcggcgtcggcgtggtcgtcgcgcgcgcgtgcaccgcggccgccgggctgggctgcttgctttgcctttgacccatcctcttctcctccttatacggggccggcgcccgcgcgcgcggtgcggagaatgactgtttattttgcggtgtttggtaagtttagttggtcgacgactcgacggtctggaccgcggactcggcccctcatttggactttgggatgtcgctgccggcgcgcgcacgggcgtgtaagcagtgacgtaagaaagcgtacttcgctggaggcgcgtgacaagtggagaagcggatttctggaatcggccatggtctggatgttgttggtcatgtgaatctgtgagactgtgatcctaccaacttctctctccttttttaaggaagggtctcatgactctcatcgaatggatgtttggattgatgcttttcagccaaaacccatcgaattgcttattaggctgataaccaccagccacaaaaaatccttatcaagttaaataagccaaataagccaatcaatggtttttctttagcttaaggggaaaaagctaactttggctgatcagctaaagctcttggcttactgatgagggccgaaaatatgattggctgttatatcttgttatacttgtgtctcgcccatcctaggggtaactgttgcactgcgaatgatactacataccgtgttgttactgtatacttgtacaatagtacttcttttttaacgattacactatatatacatacgtgcgcacatattactacacatgcaacaccacatttgcactttcacgaacattttcttaaataaagaaccaactgtttatatctgattttattgaatttttgttgaaggtccaattgcacctactaatctagcttggatggcatgatatatgttactattggctacagtgtttgagaccttgcattgcttgtgtgttggcttcactgtcagctcgtccaatgtaccgcagattattatataggagtagctacttcaatgccaaacaaaggcaaaaaggtaggattgccttgtttcattgctagagaaggtaaaacatcaaccacccaaagaaaagtaaacatcagaacgccagcccaacagacagcaccttatgaacacccaaaacttaacaaaaacagactacagagtaccttaaacaccggacaccaaagcatacagcgaactattgacattcagaaattcgacaaccatttctataaattaccatcgacaaacatgtttttttcctacaaaatatcattgtacaagtgtttttgtaaattcccgttaggttttcatttatagacctccgttaagtcttctaaaaggtctattttactctacgatccatagaacactatgtgaggggaaattattttatttgatctcttgaggggatgtcccctcgttgtttgcatgtcactgaaatgattatgaaaaaaattgggatgatg

SEQ ID NO: 11641 - DNA, 16245 bp, Oryza sativa
  unsure (1)..(16245): unsure at all n locations
ccacaacgaaaaaaccaaattaatgtatattcatagtcaaatttgtctttttcgttacaagatgtttaggttgaatttgaacttgcatgtttgtggagtgatatatcacatgttaatacatcatcccaaattttttaaaattttttcataaccatttaagtgacatgtaaacaaaaagaggggacatcccctcgagaaatcaaaattcacttccactatgtgagcacttactggattagaactcttgaggggagataacataccatccaaatgattatgaaaataaataacaagacagattaatatgtgatagatcactccacagacatataagttaaaatttagcttctacaagttaaaaaataaataaactatgattagttaacttatattcatagtcaactttatttttttttattgcagctattagaagttgaatttaacattacatatttttggagtgatctatcacatgttattttttttatttttttaataaccaattggatgataggcaaataacgaggaaataccctagaatagttctcctcgcagtcttttgcacccatagttaaataacaacatattgcctaattagctgtcaattttttttgactgaattagctgtcaaatttgcacacgcaaatacggttcagtgatgaagctgaacgccctgttgcttcctaccttgctcggtaggatgggccagttcgggtccaaataaacatagcagttatcatagtgatatcaacgccatgagaggctgggccacaacccaaaccaccatgcatgcaagtttattgcaactgaaaaccacaagacacggccgttaggaaatacaggcacgaacgtacgtctacgttaataggagtatattaacgtagatcccacggagattattaattgttaagagtaaaatggcgatgatataagcaagacatgtttcactctttgcatgcggcaatcggtttgttcttggtggtggtggtgaagcggtacgacgcgtgggagagcgtcgcgttgtaccagctatggtggatcagctccgccttggcatcctccccggcggcgccgagcgcgacgtgcagcgggaggaagtggtccggcgacgggtgcgccatcttaccgttcggcgccttctcctcgtactgcttcacgtcgtcgtgcctcccgcccgcgaggagcgcctcctgcagccacccgtcgaactccgccgcccactggggcaccggcgtgccctcggcgacgggcgccatgcagctaaggttgtgcgtggcgttgccggagccgaggatgaggacgccgtcgtcccggagaggcgccagcgctctgccgagatcgtagtggtacgcgccgtcgcggccggtctgcagggagagctggcacaccggcacgttcgcctccgggtacatgaacatcagtggcacccacgcgccgtggtcaagcccgcggccgtggtcctccttcaccggcccaaatccggcttgctccaagagctctttggccttcttcgccacatcaggggcgcccggcgccgggtattccagctgcatgggatgccatgcatgcattattcagttttttttttaaatttttgaaaggagggaacaagctttgcctcgtgatcagatcacaaggcaacaaacatgatgcatgcatggtagggaaggacgaaacgcgaacagttggacctggaacatggacttggggaagccatagccctcgaagtcgtggatggtgtcattgttgccgcggacgacgttgacggtcggcgtggccgtctcccagtggcccgacacgatgaggatggcacgcggaggctgcgcgcccgccaccgccgccggtagccacgacctgaagaagtgctgcgccggcatcgtgtcgtcgatggagagcgtgggcgtgccgtgcgataggaagaaggtgtccatggcccccgcgccccgtagtcccgtacgttgtgtactcctcgtcctctcggtttcggaggccactccctgctagctgcttatcttatctcgccggccgcgtcggtgtcggtgtggtcgcgtcggcgcgcgcgtcgcgtgtgctgccggccgggttgggcttggctttggctctgcccccatatccttctatttatatacgcgccgcgcgcgcatgggcgcgtggtgcgttgcaacgtcgccggcagccgatgaggcgtgcgttggttgcagatgattgggagtgcgttagttgcagatgattgggtcagccgatgaggcaccatcgtacgtactgtacgtttcacagttgtgcagtagtagttggtcgatatgacttccgatctactactccagtctactagaccgcacacctcacctcaagttgccggcagcaaaagctgcgcttgaacagccagcagctctcgcgttctaaatggatgttaagctttggatatagatagaatatgcatgatggagcaaaattctcacatggttgaattaaattaaatattataaattgctaacaaatagtatagaaaaagtggtctaagcattcaagtagatgtttaaagtggggcctcattcattcgctcaagatcataacatgagctacttcaatgccaaacttaaatgtacgtataatgctagctcaacaacctcactagtagaaaaaaggtcttcccttactgtcaaaatatgcctttcccggtggctagactaaccgctagcgtcgaaaggctagtgaaaatctaaggttttcacaagcaaaactttaacagctagcgataatcgttttcgcttgcggtagtgttataccggccgccagcgataatcgaattccgttagtggcagagataatcgattttggggaaagaaaaagaaaaaacccatgcagctgccctctaaccgccagcgaaaataaatatgcccacatgttgctaccctgcattaaaaaatccatagcgccaaatctcaaatcccaaatccacaacaagcacaacttccaaaaaataccatcacagatcctaaatccacaaattcacacaaaaatttcacatcacaacacaaattccacatcacagatcgagcacaaaaattttacatcacaaagattaagaggtgaggcatcacagatcgagcacaaaaatattacatcacaaagattaagaggtgaggatggattcgttgctcccaagggagggcgtggatggccggcagcggatccgctcgccggcgccggctctgctccccaccgcccctcccacgcgccggtgccgccgagcgccgccactggcccctccccccgtgcctctcccgaggacaggcggcggcggatccactctcccgaggctcgccggcgccagatccgcatctcgttgtcgagaaccaccgccgcttccttccccgcgccactgccgcacctccttccttgcgccgccgcccccttccccactcagcaatggagagtgaagggaggctggcggcggtggagaaagaagggaggctggcggcaatggagagagaagggaggagggatagaggagggaggcagagggaccgtgcgctaccgcgcacttgccttccgtcaccgtcgccgccgcgcgctgccgcttgagaaccgacgtgcgctcgcgttttgtcaccgtcgccgccacaagccgctgctggagccaccgcgcgccgtcgcccgagaaccgtcgtcggagctgccgccgccgcctgtggggagtgagtaggagggtgcatctggagggaggaagaggaacaagaggataaggactaggtggataaggagtggtgggtggtgattttttaatgggcggtgatatttttaagtgtgtgatttttttaagtgcggcgtttaaacgctggcggtaggttaagaagcaatagggttattttttgaaatggacttcttaaccaacctcaagcgaaaacggattttcacttgtggtcctagactcaccgtcggcgaaaatgaattttcactaacggttctaaaccctctattcctcgttagaatttcacaagcggatttcttatatgaccgctagctaaaaaaatagagtaccgtcataaaaaatcgtttcttaagctatggggttgggaacccatctcatctacacgaaaaacagagcggtccgttagtacgttattaattaaatattagctatttttaaaaatagattaattttatttttaagcaacttttgttttttttttaaaaacacaccgtttagcggtacatggttaggaaaagcgagagtacatggttaggaaaagcctcgaacgaacacagtcacctcacgctcacagtgacactgacacaagtgcatagccgtatacacgacgacatcatgcggaagtccaagcagagcaacaccgtccccaggcagagcaatcttagtatacctcgtacgcagccatagggaattcgtttttggtcacgaggctttacagtttacagaggaaatgaagtttatctagatgcataattttgactaattgacttggacggagaccccgctgttgaaggtcaagaacgtgcacagtatctcgatccctcaaattcccgtgcgacacgtctgctgcttccatcgcttgctagttacatagtccatcctggttcagctatataacttgatcaatttagagatagtgagcaccaagaatcaatcaatcgagcagaaatttgatctgtacatctccagtcaccatggctgccgccggcagcagcaaaaccgcgagcttgttgctatgcctggcgatgatctccttcgtgcagctggcacagtcctcaccgagcggcgacaaaggcatcaaagggtttcacggcaagaagctcagcttcaccctgtaccagcaggagaccatcaacaagaccagctacatggtcgtcgccggcgtcgccggcgccggcgtcagcgagaccaccacgcccttcggcaccgtctacgtcttccgcgacgacctgacggtgcgccccgagaggtcgtcccgggtggccggcgtggtggaggggacctccgtgacgaccagcttcgacgggctgaggagcctgtcgctgggcaagatcacgctcgaccaccgcggccgccggggatccatgtccgtcctcgggggcacgcacaacacccggccgtccgactgcccggtggtcggcggcacaggtgacttcgcgtacgccgtcggctacgtccggacgtcgccggtgaacctgcggggatcgtcggtcacgttcaaggtggagtttcacctgtactggccaccgtatgctcattacgctccaacttcaaagcactagacaagtcgctgtcttccaccttgatgagcgcgtctgcgtgtgtactcgtttctggcagtccgatattatatcatgcatctgcctattttttttcagtctctcgctgagtagttaatatagagtttgaattacctctgggaggtatttccgtatttggtgtaataaaattcaagattgataatctgaggaattttcatgaaaaaattaaactactacggatgatgcgcttatcggacgcttgttgttcggtgatagtactacttaaaaaagatcctcggatagtcagactttgcagtatacaattatgccaatgagatatgaatcttgagccaattatatcactaacatatgggtattgggttctactttcgtacggttcacatgtcagaaagtcaggaaagcctcatccatactactttcccaattcaatgtttaagttggagatggagaggttgtggattgggatcacatgcagtggctatagccactgcaacttatgcagtcctaaggacatcattggaatataaattaacgtcctagatctttccttgatactgttcacaaatgaccgtacaaagttagtttctgtagcatgtactgtagcaattactgtttaaaacaactgtagcatttatttcagccgttgattgccttgatccaatgatgaaaaatggttccaactgctaaacttgcagtctgtcctatgactgcaccggatctggattcaactctagtcgggcatgcacaactgaaaccgacaacaaactttgttccatttctcaaaccaaacggaaaagttattagcaatgattaattaagtattgattattacaaattttaaaaattgatatatttgattttctaaaacttatatatagaaagttttacatcaaatacactatttagtcgttcggaaaatatatttaaaaaaaccaaagagtagctagctaaaaaaactcagccttggttttttttaactatcatggcacacacctttaaaattgtcgaatggtgtattttgtagaaaaactttttatatataagtttttcaaaaattcaatacattcatttttaaaatttataatagttaatagtacttaattaatcattaatctttcattccattttacgtgtggccgttaatccaggtcaaaaagctagcgaacactgaaagctcccgtgcgccagaaacacccgagaatagacaaccgcacagtaacatacacacggcagcttcatcggttttccatgggcactttcggtgtttcacgattttgcgcacgggttggcccaacccaaaccataccgtgtgcgattttgctatagatttgtcgtgtgattttttctctcggatttgtccttttttaggctgttcgataagtgccaagattcgtgcacatatagcgatgggaatccgcataggattcagtcggacgggttagagcgctaatttctttttttgcgctttaaaaaattgatatgcacgctgttctctctcgttctctctcaattgaaactaaaataaaaataaaatacaaaattacagtcatatataactaaaattatatttgtaaattcagttgatatgacatgtaggtgcattgtaattttgataaaagtaattatgtaactaaatatgtatttttattttcttttgtagtccgttggatgtaaatttaagggtagaaaaaatctgggtgattttttcttagaaatcacctgacaaataaatagacaatccctaccgtgtgtgcttaaacacacgagaaccttcccgtgcggatctagactcccggtaacattctatgtaacggactctttcagacggcacggtggcttaccgtgtgttcgaacagcaataatcaatcaagcagccatctccatggaaagctagtgagcagcaataatcaatcaaaaggattatttagcagttagcaccacctaagctcaaattcttcttccgtttttctctttctctcggtttcaataggccaacacgggaagctagtgaacagcaataatcaaccaagcagccatcgccatggcagctaccaacacggccatgagcttggtgctgtgcctgctggtaatgatcatctgctccacgcaccggttgctgcatccccaaccccagcttgcggcgacggcggcgtcgtcgtcgtcgtcgccgttctcgtcacgcagcaagataggcaaggacatcatcgacaagacggtcagcttcaccctgtaccagcaggagaccatgaacaggacggggtacgtcgtcgtccccggcgtcgacgcgcccgcgcccgcgagggtcgtcgtcagcgacgccggcgagccctccgccgacaggcagcccttcggcagcatgtacgtcttccgcgacaacctgacggtgcgcgccgacagctcctcccgtgtcgccggcgtggcggaggggacctccatctcgacgagcttcgactgcgaggacggccggaggagcgtgtcggtggccaagatcacgctccaccaccgcggataccggggctccgtgtccatcctcgggggcacgcccaacatcaccaggccgtccgtgtacccggtggtcggtggcaccggcgacttcctgtacgccgtcggctacgtccggtcgtcgccggtggacacgcgtgggcggactcggacgacgtacaagatggagcttcgcttgtactggccgctgcacgcctatttcgctccaattccgtagtaacacatcgatcaacgttcttccattcgcgtcttattccaactataattccatgcagaagttatttttggagttaatttgatacatgaactaagaaagatttaaatgattttattgccctataaatattattgtacatttcaaatggtgcattgatagatcatttattcatgaggcacaatattgactaagataatgtaaggggaataaaggaggtcatatgtgatgaggtaattaatttgtttccacgtccattactcctggttaatatagtgatactgaaagttgctcaatccattccaaataattgacaccggcactatttaattttaaatttaaccatcttttgcacaaaaaaaaaagaatacatgaaaaatatggtatactagcgaacaatgtgctgtcaaaaatattatcatacaaatttctttcatcataatataattatttaaaagtatttatggttaaagtgaaccgactgtagtcaattatttgaagaacagaggtagcaaattctgagtttaaacatgaatattttggtatttagattttaccataacatttaccacggaaggttaaatggcctcacacctctttgtgcactcttattatatagattctgtttctattttataaatcggcgggatgctctaggatttacttggatggaagttcaaatgtggggcagacacaccaagggtgcgctccacattatatatgttttgtacaaactttatcatttgttgagaaggaggtggtatggactcacaagaagtgtgtgcttttataggtctggtaataggctccaaacattgatcgatgaaggatttgcacatccattcaatctaaggacttaaatctagctaggcgaaacgagatgcacatcttaagttatgcttagctcccccaattattttttacattgaattgtacattcaagcctgtttttctcgcatgtttccgtatttcaaaagtacggtcgagttgttttgtttgcactaaataaaagtactgctcccaacgttcaaatataagaatttctgcgtgtttcccaaattttgaaaatctcacagaaaacacatatattttggaatggacatagtactccgtagtttcaaccgtacacttctctacaaattttcccagtaaaaaaaactcggggagcatcaacggtcgcaattaggctcgaaaactgtgatacgataaaaccatgttacatggatacacaataaagatatggctagtattggactagcgacctaaggtacctttttttttctggataatctgtttggatgctcacctcattttgccacaattttgtgctaaaagtatatcaaggtataaattgtgcggctccaaaattaatggtcatatttgtgtcaaactttggctaagaaaagagcctatgatttgtgggaccaaaagataagaaatcattgcatgctaaaattgtagaaaccaaccaaacactagccatattttaccacattttgccatataatagtcaagagtggtaaaatacaacaccaatgaagcatgctctaaacacttgaatgattttgtaattgttatttaagggtccaaacaaatcaattgactattagaagttaaaatagatttaaaataggcttttaaagaaatttatgtaatcaaatttttatgaaaagttaaacatgaagcatgtcatattaatccatgatacccaatgtgatatttgcccattgtagtggggcctgtctgtaaatatcattgtgctttaagctagtttaataaagtatatactttcttcgtctaaacaatatccaattatagagatataaaaaggtgacaatatcatctgaggcttttggtctcagttagtcttgcaaaaaatataaaaaaaatgcttttgaagtttttcacaaagtttacttttatattgttaaaaacacatatataaaaaatttatttataaattattttttatttataaatataccgtttgtgacttaccagaacaaggagagaagagtctgttcatcggtccatcacggccggacaaacctcgccgcttcgcttcgcttcaccctttttcggttcgctctagctcctcatcccgttatgccttccccacctgccgctaccccacgcccccttcctctccaggtctcccccctccccttgtgcgacttgtgtcgaacaccgcagccgccacccgtagacgcgacctcagcaaccccacccacttcctctccgtgggcgcccgccgcgcgtcttgcccccagatccggcgcccaccccaggtaaaagccctcgcccgagctccgttgctcccgatgcgcgcgtgcagggagggatgggatcaggggaatgggattgggggtttggggcgggatggatcagttgaatcggctgcgctagtttggaactcgaacagcttgcagtaggataggtgggttgaatggtcgcaggtgttgcgcttttctgatgcggtttcgtttgctgctgctgctgtgtgaaggtagccggttgttgcttgcacgcgtggatcacttacagaaccatgcggcggtaggaacttgggcaagattccagatggttcgcttgtttggtgagctcttgtagcattgattgtgctccgttcgatttcattttggtgcaatccctagcactctaatttttcttgcttggaataaatggtgtaattattagactttatttcagttattaaacttacaatgatcgatagttatagttcagtacttcggttaccctgtttcactgtgctgttttgacttctgttatagcatgctgaaaactgaacttgccaaacaggcaattgatggggactttccttttttgagccagcaattataaacttataattattgatagcaaagttcagtattccagttactcaatttcatactgttcagaatactggctaaataagtcaattcatgttgttctagtcttgtgaggcttccttttctcctgttccaaactattgtcacggttttcctcccgatgtgcaaacattgctttgttttcacttaaatttatttgactcatcttgtatggttagttacattttaatatggcttaaaaccataacggatcattactgcagctttcttatgaggattaataatgggagaatgaagatgaggaacaaacaacggaaatcatctgctctcaactttgatgcaggatgccgatcttccttgtcttttattgtatggagcttggtgggagttgccctcattgtttgcttcttttctgttgtccgtcaagcagacactaggcagaaccatatttatttcagacatctatctgctaccagagagttagaagagattgaggaggaacatttccgcttgccacctcctcacaaggttaatcctcgtgcagtgaaacggcgggggcctcgcaaggctccaaaggttattgatcaatatctggatgagtcatcagcagtgcatgccttgttcttccctgatgaaagaagtgcagtgaacccaacaaaaggtggaaatgacagtatgtacttctatcctggtagggtgtggctggacactgatggacatgccattcaagcccatgggggtggtattctgtatgatcatatcactgccaaatactactggtatggagaaaacaaagatgggctaacctaccaaactcaccccaagagtacatatcgggttagtataaattctagtataatatcttccttgttttagtgactggttatcttagcaatttgttctgataccaaaaaaaaaaaggtacaacaatggattttgagacaagtctgtggctgattggtccttaagtacgtatgtactgataagtggttgtctttataattttccaggttgacattattggggtaagctgctactcatcaaaggacctatggtcatggactaatgaaggaattgtgcttcctggagaacctactaatttcacccatgaccttcataaatctaaggtgcttgagagacctaaggtgatatataatgatcatactggacaatatgtcatgtggatgcatattgatgatgcaaactacaccaaagcatctgttggtgtagcagtcagcaactctcccactggtcctttcacctacctctatagctttcgcccacatggatttgaaagtagagacatgacaatcttcaaagatgatgatgggtcggcttacctcttctactcttctcgtgacaatactgagcttcatgtcagtccattgacaaaggactatcttaatatcacggtagcaatgaggagaatattaataagacggcatagggaagctccggctgtcttcaagcttcaaggaacctactacatgatcacctctggttgctcgggttgggctcctaatagagcattagcgcatgctgcagaatcgatcatgggcccatgggagacattgggcaacccatgtgttggaggcaacaggtttttccggttgacaacattcttatctcaaagcacatttgtgcttcccctccctggcttgcctggtacattcatcttcatggcagacaggtggaatccttcaaacttgaaagattctcggtatgtttggttacctctgttcattgggggattggcagacgaaccgttggattacagttttggattcccggcatggtcgagggtgtccatttattggcacaggaaatggcgcctacctgaaagttggaagggttatacctgaattttgccctacgcacatgaagtacatacaaaaattacagatgatagatgcaatcatggaacagacatagtttgaagagtttggtgattgttccgaatatttcttgagatatctagtcagtgctttcgtaggcctttttgtaacgcaaaaatagtctgtcaagaaaaattgtataacagtgcagctctcaaaacaaatatttgacttgctgtaacatcctccaaaaagaaagttgaaatagcttgagcgtgtgttcatcccgagattatgctggtaacaactaacaggtagtagtgtttctagttactgtatccgttacatgattgatcccaatgaagcagaactacagttacgcaggcacgcttgaatgtcgaacctgtgatcacacatcttgtttaacatccattttcttcgaaaactcaactgattgaatgcctgaatctgataaactagtctcgctggggattgtttatgttgacaagcagccaacacacatgaactaattcatgaatacttgaagccgatggaaacaatgttccatacttcatagttgcatgtgctactttagtacttaagtcatgtcaaaatattgtcaacctcagaaagaattgacatggaacaacagatcacagcattaacaaaagaacaacaaatgactcggataaattccgttggtgatctaccgcttaagaatctaccagattgggaaaaacaaaaactgcctgttaattgctaaagcaaaattttaagcagtatatgttgagtaccagtgccataatataacatcatttccccaaaatagctagagctgtttcctcttcttggtctttgaccaactagatgcatgtttcttcaatttgtgaagtattgttctctcgctcacccgcagcaccaaagaatgatagagattcctttcgttgacagaagagcatgcttgcagtttttgcctgtcatcttccaaagtgtttgaaccatagaggctctccctcatgtcaacaagggatacaagtgcagaacaaacgctctcattaagcaatagcttcttaacatcaggcaatttttcaagcccgctaatatctggatgttgattggagcttgttactctgacaaccttaagcacactactaatgctgtcgacctcatcatcaccaatcagatcatgagccacgctggccagcttgtcataagcatcagacttcaaggagatgatataaagcaggatcaaaagttcaagctggggctctccatcatatgaaatctcaaagtagtcagcatcttggctggtgcaacctgaatagcccagattatgccagagtgatacccttgctcttgcatatcgacgggagtacttagaagagcaccacttagtaaccagagctaagtcgatgttgacgatgtcatatgagttgtccatctctgtgaagccatatcgatgaagcaaagcagcatttcccatggtaccgtatgtgttaaaaacctacagtggaacaagaggaaacataaagttgcctcaaaacaggaacctaactgatatctaacagtgatacattaagcaatactttggacccaaataaaagatggtaagcacacaattacctcctccccttcattgacatctctcacaacaatcatttccaaatcttcatcgtcatctcctacatagtatgaacaaaacaaccataatgagtgaagctcaaaatcaaccaagtacatgtctaaataaggtctaatgatgttacatgcagatggtcatggatgtaacctgaagggatgtcggcagaattttctatagttgactgttcatcagcagaagcattgtttggatcttcaccatcttcactatctgagtccgaggcttctaacactgaagtgaagtggacatgttccccaccagtcttgtggttaaaactgaaacaaattggatggagggcatttccatattaacgctcagacttaagaccagcacaaatacatcatcacctaagtatgtgcacacctgatgcattgtttccaaataaccaggtaaacgagaaataatctaattacatgagtagattgtaacttacaggtcagccaggggaaccattccagacccatgatagctatctattcggaaggacctcgacgaaagtagactcttagcagagaaataattctccaggctaaaatcatctgggtcaacctcaagttctcctgacaaaatgagtggctcaatacactctttccagtcctcacatatgaactgcctgtcttgcttcactatctgcctagaaattttgccgtttttagagccatcttagtgatcagccaataacgcaatatgaaacatgaaatgtgtgcaacaggaaagtacatcatatgcataattagctcgcattatgctgatttgaaaaggaaaaatggccatagttgtaactccagggagccaaacattgcaagatagatcaatttcactgcctaccatcgaagcatcaaggcagatacaaatcgtggaagcattgcaacttgttactacaatagaagggctcaccttatcgagctcggtgccggccaggaggcgctcggcctcatcggcgggccagacaagcggcacgggctcccgctcggggatcaggcggaggtaggcgtccaaccgcgactgggcgccgcgcgcgcgctcatacataacggcgacggcgagcgcgaggggccaccgagctcngcgccctcgatggcctcgcgtcttccgaaggtgcgcgnggtcaggcaacgcgcccgcgtgaatggtgcccactaggtccaccctcccgtagcccgcgaagggcgcgcacgtagacgccgccgccaccgtcctcggtggcgtcaaggcggagcgcgttgctgcagacgacgccgtggtcccgcatccaccgcctgaaggcccgtaggcggctgcgcggtcgcggaagggtcacggatcgtagcgcggcgggggagcgcatacagagaagagcaaagcagaggatcttaccgtgcggtggaggtggaggcggaagcttccatggctggcggcggcggcggcgtcgcgaactcgcgaccaggttttcgttgcggaaatcggtgaggcagcaaccgcgctgcaggcccagcagaggcccaccaaggcctgcaacgcgtgtatgttaacaacccttttctctttttttttttaaacacgtcaatatattagaaggaagcagagttatacttgcacgatgtaatcggccagaggatcattgccacgaaaaataggaaaaacaaaagactgttaagaaaaaacgctactcttatataaagggaaaaataggaaaaaaaaaacaaccctcttcttctaaactatgtaatctcgagaacaacgaaattcgatacaatctcaaaagaaaaaaaaagaaattgaatgagaagaagtagagggggatttttaagagtcgacgtgcaggcatgcaagcgagagagagagatagagatcgacgaggttgaaccaaagctnnnnnnnnnnnnnnnnnnnnnnnnnnnnnnnnnnnnnnnnnnnnnnnnnnnnnnn

SEQ ID NO: 11642 - DNA, 6316 bp, Oryza sativa
tatgcctcgttaggattggtgtatttgcttaccaaggacttgcttgagaagcttgatcatgggctacatcatgggctgggctaaccaatcaacaggaagcctagtgggttcttaacagtgtagtttcccttttgcctgaacattaaatcgcaggtgagagatcggacgggcaatgatggccataattcaagtttggccgctgatcccaattgatttttgccagcagcgctctgtaatgtgcgtgcacctgctgtaactttctgcctgcaggcggccgcccacgccaaaacacagcacaggttgaggtagtactcgtatttgtttcgctgtctttcgctttgctggttggttcgtactgcaaacttgaactcacaccacaggtggtggctttaactaatgccgtgcatcagttgaacaagcatagagtagttcgcttgctcttcagcttgtcggccgcaattgaaatttaaattttaaatcttaattttaaaattaggtttcgatagtttcatcatatttttttcacgaatacgtaaaaagattgcagtcaatatattagaagaagaatagcagagtttagttatacaacgcaatcggttagaaggccgttgccaatggtcaaagaaaaaagaataaatacagaaaagataagctcatgtaaaaggaaaactacaatcgcaaaggagggtggggtaagggtcccactacactccggcctatcataattttttttcaatcaagacttttaagtcatcaaaaatacagataaaaagttatttacttacaaatatacaattagttgtacgtgaaaatataatcgtaccagcaacaaaagcatcttaatgtagccctttgcatgttctactttcagcagtagccaatgcaagagtactactgcctttagccatctgtgaacaagttttcagatagctaaaaaaaactcagggcccctttgaatcacatgaataaaaaaacggaggaatagaaaaaatatagaattctaacatgaatgtaagtgtaaaacagagaagcaaaacacaggaaaaacgtaggaatgaccgtttgattggaccacaggaaaaactgaggaatttgaggagagataaagactcaaaggatttttccatgaggttctacctcttgttaaaattcctccaaaacttgaaattcatagggttcatttctttgattcaaagggctttgtaggaaaaattcctataggaatgaaatcctctaagggcccctttgaatcaaaggatttatgtaggaatttcataaattcaaattctatagaaaattttcctatttggccctttgattaaaaggattaaagctttccaaatcctatgaaattcctatggaatgacacattgcatgtggattttggagaaaatttactaagagctctaacctcttggaaaatttcctttgagtctatctctctcatccgattcctgcgtttttcctgcgctccaatcaaatgaccgtccctatgtttttcctgtgttttgcaatcctctgttttacacttcaatttctgttagaatcctgtgtttttcctattccttcgttttttctaccctgctatttaaaggggctctaaaattcctataaatttcctttgaatcaaagcggcccttatactttcgcccgtttaaaccagcgctagatctgccaggttgatgctcgcaatgtggaaggtgtaacgcaaacactgtaaatcagtaatgatattacagtagcagtgattaggcgaaagtacagtgctacatgcacgagattaggtatgcatggttaccgaaggtacaacccctgctgcctcctgccagcgaagtaaaggaatcagcaagaataaaggggggagcgcgattagtaatcaccaacttttgcaatctgctgcagcaaatttatacacgctctgtacatgtagctgtggatcagcattaaccatggcgacaagaagacaagcgctagaaaagaagaggaaaggcttagctgttgttgacaatgcgctaattaattgatggatcttcagcaaggcgagctccaaatgcaatgcagccatgttctgatgagatgacgcagtagtagagattgaaggcaaggtcccggatggtagatgaaactgtggcagcagatgtcatatcatttctggattcactcaacaacactgatcaagctataggtgagtgaagcttggaatggatagccaagccagcagctgctcgattttcatgatcttcacacttgcattgcatgctgtgatccatccacgaagcgttatggccgagtgaacacctggacatctagctagctgtacgttagtaggagtagttcgccggcaatctatgcaatgcatctacggtttcattacagcgtcctgcagtactgcttcttgcagcagcgtagctcgatcgaatcgcagtcctgcatgccagggatcgggatggctggctggcgtatcagaagtctagacgctcgagtggcggggaactcgtcgaccgatgcttaggcagagattgtccaggtctccaggaatagctagcttcagaccaggtttctgtggatgagcatttaccggttgtgaaatgctcggggccagccggctgtgaactgtatttgtctcgtcctctatacacctacagtagtatttccaggggggtaaattgactgcctgtagattttggttatacatccttaaaaataggagtatactctctctccgtataaagaaaacaacctagtactattaaaataagacataacttagtaccacaaatataaaaaaagtttgtctagattcgctgctgtattaggttatatccaatctaataatagctttttttaagagagaatctcttatatgccactgaaaattggtcatatcccttatataccattgaaaattggctcttttttacggcattgtttagttccaaactttttcttcaaacttctaacttttacatcacatcaaaattttcctacacacataaactttcaatttttccatcacatcgttccaatttcaaccaagcttccaattttggcatgaactaaacacacccgtatacgtccaaaaaaaattggctcttttcgtgtatgcaattagtccaaatttacgcaccctctcatatcacttttgtctgttgaccgttaactctcaaataaaaaagatgtatttgctcttatgagtatacgacatgcctaacaactcagaatggcaaatacgtctttttacctttggagttaacggtcaacaaacgaaagtggcatgagacatgggaagagccagtttttcctggcatataaggattcttttttttttaatggagggtgcatgacgaaagcaatttggcatacaagcagaagaatactcgtaaaagacatttgatataaaaggttctctctctgtaccataatataagggattttgagtttttgcttacaatgtttgaccactcgtcttatttaaaaaattttgaaattattatttattttatttgtgacttactttattatctacggtattttaagcacaacttttcgttttttatatttgtaaaaaaaattaattaagacgagtgttcaaacgttacaatcaaagaatcaaaatccacggagggagtaggatttgcctctgaatattcccagtcaatccaatccccaatgcttacaccaacaatagctgtagctatgctttatcactgctttcactgtccacacatctcatctctgtccagttcaactcacaagtctgtctccatcactatgacatctcccataaattgcagcaaaattttctcccctctcctttcatcactagcgctattaatttccacagaaaagaggtcatgcagctccaagtcacatttatatgtgcatggcagcagcagcagtaccacctatcccagccactagataaatgcgaaagcctccatggctgcattgctcattgatcatctgcccaccattagagacatcaagaacactctgcactagctcactcaggttgcatccaaagatcacaagatctgaagatcacattgatataaccatgagcagttctgaagaaaggatgttcgagatggatgctgacccaacttcatcaccagaagccagccccaagcaccatcacagtacatgccacatactagaggttgatcaatctgtcactctgggctttcttgtgccattgttcatgtaaatgccttgttagcctttgtttcttgcttactgtgtctgcaaaacacacgtagcagggtctcctcgggaggtgcacgcaggtggagatggagatacaagagagggccatgaagcatgtcatggagattggagaggagaggaagagaagcagcttgaagaggaggctgatgatgaggctgaggaaagatggctacgatgcttctctctgcaggtcttcttgggttgccaccgctgagcatccaggaggtgaagtgtttgttttttttttctttacttttgtttaagatattttttttcttctttacttatcttgttgacacaaaatttttaatgctattttgtccttgttctctgatttctctgttaccatttctgtgggtgtatggttcatctgtaaatatctaaaactggactagttggtctgcagaaaatgctgtcggaacagcatgtttcttgttttggtaaggaaatatgaatcacagaatttccatcttctgcgtgaacttccatggtgatttgctcctagtaactggagtaactgatatatctttcaccggctttttaattatactctttccattctatatattttagttttgtcctaagtaaaatttctataaacttagtttacaataacatatgcagcatcaaatttgttttgttaaatctatcactatatcttgatggtgtacttatttattattataaatgttaatatttttctacaaatttagtcaatgttaatagaatttaacataattaaactaaaatgactttactccgtagtatggaacggagggagtaccatttcacaaccccagtagcagtaaaactttcagaatcttggtactcctacggtgacatacaggtaatgaagcattgacattaattattgacttagatcagtgtaccgtgcatataatcactagtaccattactacccaatcatcgttaatatgctgacattggccacagggtcagcgagtgatcaccgttagcttcctttaatttaagtggccgaaacagtgagctgaaaggttgcagatgcttttgtctcgcaggtgattacgagtacatcgacgtgctcgtggcagtaggccatggtgctgacacgtcgtccacgtccaggctgatcgttgacgtggatttccggtcccagttccagctggcgaggccggccccatggtacgcccacctgtcgagccggctgccgccggtgttcgtgggcccgccggagaagctgcggcaggcggtggcgctgctgtgcatggcggcgcagcggtcgctccgggagagcggcctgcacgtcccgccgtggaggcggcccagctacgtgcaggccaagtggctcccctgccgcggcgtgcaggcatcagcgctgccaccgggcggcgagtccgccgcggcggcgaacggcggcgatggcccgcgggcggtggtccagtggtcggtggggaaggagaggagacgccgtggtggtgggcaccggaggtcaggcctctcggtggagctatccgactccggcgccggtgaggtgagctgagctgagctgtggtgtgcagtgtgccacgatggtggttcgctggtttcattgatcttttttagctcccacggtaaaaactgtgggatcgaggtgtagaaggtacatgtactgcagactccactgtactccagtagtttagaccaggttagattggttgccaaccagtcgggtgcagtcagtgactgttctggtagggccaacgtggtatccagttttgcagttttgctttcgcatcaaccgttgtttagctgcgttgatgttggcatgcatgccgcctgtggcatccggcgccgtgttttgcgttggacattttggaggcttaacgccaagcgaatagctagtgtggtgatcaaagaacacacaatccaaagtcatctatttcaaagtttacaagcatattgtacgtactacaacaactatagtgcaattactgtgatctgtgggtgctggaggtggagtatgcctggtcctgtggaatgacagtgcggagagaggggctagcttgtgggttcttatcggtttactggaggtagaaaatggacgctgtacgccgtatatatgcgcgcc

SEQ ID NO: 11643 - DNA, 1755 bp, Oryza sativa
tgtgtaaccaccggcagctttgtcaggcttgggtgtgaccggcatgtcatcaccatttcacctcgcctgtacgagtgtacgccagtattgtgtggctgatggaaatgctcttcgtggcgcgagatgattgacctctctactccattgctccccatactgtgcagtcctctactatactatccccatggcccattgcagcttttgcaaggaggaaggagaaaaaggaaggtaaaagaggggaatcctacgcggagaagatagagatatacgtacagtgatctggctaccaataactgaacaacgtgaacacacgtagtacaagtacaaccaggtgttgtgttttccacgcatattttgcctaaccccaacaaacggttgatctactcctccgttttacagttgcaaaacatagtaggagcctcaactgggcctctatggctggaagaaggaaacgctatatctggccgaaagctcaactgggcctctatggataatgagccctaaaagttaggaataagttcactttgtgaccctcaaaagtgacagaaatttaattcgtaaccctaaaccacaaaaccggatatctcaacccctaaactcttaaaaacggtgcaatttgactccctcgacggttttgcagagcggtttcgctgacgtggcgcctacgtggtgatattgaccgagtctttgttccacgtggcggtgacgtggcacttacgtggcattagaattaaaaaatatgtgtgggaccgtttgtcattcacacaaaaagaaatatgcacccactgacatgtagggcccacatgtcagtcatccttccttattggaaaaagtccactttgactcccttaattatcagcagaatctaatccgtaaccctcaaccgcaaaaccggataagatgactccccgaactattgaaaccggtacaatttgactccctcagcggttttggagggcggttttgctgatgtggcgctgacgtgttgatgttgacctagtctccgtctcacgtggcgcttacgtggcattcaaattaagaaaatttatgtgggacccatctgtcattcacacaaagaaatatattatgggacccactgacatgtggagcccacatgtcatcctctctctctcttcttttcaccggtctgcaagggcgagagctggacaagcggcggcggccggcggcaggcaagcgacactaggggtctagggcagcggcagaggcggtcgagggagtggtcggcagcggcggcggtgggaccagatcttcctcctccttctctctcgctcatctctttctcccctctttgtgtggtcggcaggagtggtcggcggcggcgggataacgacgggacggccggcggctgtgtaacgccccgacattcattagccattaacacagctaactcacaccggggtgttatgcattacctgtgatatagtaccagtccaaggatacactagctggtacacacagaataaatatggaatcaaagtaaattactttattacatcactgggtagtagtccttacataagatgccatcatggataggcccatagatgagcaacacaacattacagaaaaccataaaagcgacggcgtagaagcgaacaacgcggagcactaagcgactaagcaactatgcactaggcgaagaacctaggcatctatcttattccacaagcgaggcttggggctaggcacgaaacatctagaaatcttcatactcggcttgctcctacagatact

SEQ ID NO: 11644 - DNA, 633 bp, Oryza sativa
  unsure (1)..(633): unsure at all n locations
cgtggctccgtgtctcccggagagggcgcgacggtttttttcgtggagtttggcgcgatgcggctttggcgcggcgtgcggggcggcgctacgtggccctggcacgttgcggggcgcacgggagggtggtatggtgcaacgcggcacgggaacgagggcggaacggtgcggcacttggcccagacattttgtcgaacacctggcgtgcatgcttgtggctggtctggggaagaagacgatgagcagtcaggggctgggatgggctggcgcagaaataagactgtgggccggcctgcttagggggagctaaagagaggaggtatgcagggtagttgggcctgggatagaaaatagagaaggaggcccaattcgaacagtgagctttcacaattttcaagagatttgtagagtttgaattttgagaagatttcaatggatttgaatttgaatttgacttagggtatcacaggtatttgaaggaaatttctagtagagtatttgagatccatttggcacaaaatcaactaagaaccaaattaactcctatttttaaatgacaaactttttaaataaaagcacataaaatacggatgctacagnnnnnnnnnnnnnnnnnnnnnnnnnnnnnnnnnn

SEQ ID NO: 11645 - DNA, 547 bp, Oryza sativa
  unsure (1)..(547): unsure at all n locations
gggcgaattcgagctcggtacccctaccggggctcagttacgaacttatgatgtactgacctgatatgctccgatgagatggaggatgaggcacatgttggcaatgtcgacgagccagaagggccccataccggacgccgtcaggatgttgcccggagcatctgaaccgaacgcggcgtacccggcgcagccaacggagatgtagaagatggtggtggctccaatcccgtacatcgctgccttcttcatggtcttgttctccggtggtgacggtttcagtgtgtcctacaaaagcaaaacagacggaaaaaagcgcattagcgttaagaacgtactagtaccacattgctactcgcactaaaaaaatattggcacgaacaaaaagaaaatcctgttcgtgtatgttggttcagaggtagtatctgaatattgtgggtgacgaatcatcatcgatcgtgcatgcaaacctggatctcaattagcacttctgcaaannnnnnnnnnnnnnnnnnnnnnnnnnnnnnnnnnnnnnnnnnnnnnnnnnnnn

SEQ ID NO: 11646 - DNA, 1683 bp, Oryza sativa
ctcatcatcgtccatggttacaccaagatcgctcaacttgtttgccaggccactgattttgccggcaaactcgtcgattgactcggtgtccttcatgtgcaatgccttgaaatcgctcttcaaggtttgcactcgcgcctttttcacacgctcaacgccaaggaacctcgtcttgaggctttcccagacctccttggcagtcttcttcttcgcgatctgctgcaacacgtcttcggggacggccccgaagagacacgcacgtgcctgcttgtccttcttaatgtccacggcctcatcggccgcgggctcgatggcatcccagatgccttgcgcctccatgttagcctccatcttgatcgcccaggtggagtagttggtggaggtgagcactggatatgggagcgacacgatgccctccctcatcgatcgcgatgcggagtgctcgacgatggccatcttgttgaagcgcaggatcttgggcataaattggctctgataccaattgttagaatctctcctctctgaatgtttaagtactaatcactagcactaacataaacacttgtatttactcggtggacacaaacacacaagaactgaacaaaacacacaggcttttggttgatgtggctaatcacaactcacaccattttcttcattacatagacttaagtacatgcaaaagataaggatcagccaactaatttggccttgactcacgccttactccaacatgcagatgccatgcaacaaggtaactagctagacctattcttccgccacaaaatcacttcgtggccttccagcttgagctgcagctctgcatgcatcttaacacatccaactaaatgcttgcatgcagccgctaatcactagttctacatgctaatgcaacagcctttacacatcgtagatatcggcacgttcgtccggccgcatcgcacagctcacagcaagcacgtttcacacgtactggctcggatcctttgctgccacacactactaccttgtgcaaaacctatacaaaccaaatgcatacactctaaagacaagattattgctaacatttacccccctaatcttggcatgcttcattcagagaagagttggctcctcatcacttgacgctgcggcaaggagcgctatctccttcttcttctttttctcagggcactcatacgcaaagtgtccaagttcttgacagtagtagcacattgtcttggacctgtccggcttcttgacgcggctgcggccaccgcttgtgtcgccggacgtgaaaagtagatgctcgccattcttgtcatcacgcttgcgtatcctttcctcgtatgccttgaggcgaccaattgcctcatcaaatggcatgctgtccaagtcagagaactgctcaattgcagcgatgacatgcagaaacttatctggcacagaatcgagtagtttcttgacttgctcatcatcgtccatggttacaccaagatcgctcaacttgtttgccaggccactgattttgccggcaaactcgtcgattgactcggtgtccttcatgtgcaatgccttgaaatcgctcttcaaggtttgcactcgcgccttcttcacacgctcaacgccaaggaacctcgtcttgaagcttttccaaaacttcctggcaagtcttcttcttcgcgatctgctgcaacacgtctt

SEQ ID NO: 11647 - DNA, 4321 bp, Oryza sativa
  unsure (1)..(4321): unsure at all n locations
ttttcaagagatttgtagagtttgatttttgaggagatttcaatggatttgaatttgaatttgacctagggtatcacaggtatttgaaggaaatttctaggagaggatttgagatccatttggcacaaaatcaactaagaaccaaattaactccaatttttaaatgacaaactttttaaataaaagcacataaaatacggatgctacaggctgacgcctccaccctgccgcacagcagccgaccagcctcgtcgcggcgcaccggaaagaaagccctcgccacgcacatcgacgacgccgcaggtgcccatcttgaggtacatgatgggcccgtacttgcgcgctagcgacgccaggtcggcgtgcggggctgggccgacgagcgggagcgcgccgaggacggggacgcccgggggtcccaaggggaggcggcggccgccgccaggggagggcgggcggtaggagcagagggagaggttgaggaggaggcaaaggaaggcggcggagagcacgacggggtcggtgcagagcgcggcgagctccatgcatctggagcgacgaggcagggcgtcaacgacgccgtggggagggatgggcgaggacgtctacgactcgcggggggagagaaagagaggcggcgagggggactccgctccaggttgggtgaactctggccgggatggggttggaggaggcgccagccaccgccactccggcccccgtccgccgccgtcgccgacgatctagcccccgtccgccgccgccgacgatgacgatctggcccttgctctggccttcgcccgcccgccctcccgccgncgntagcccccatcctacgctcgcgaacagaaagagagagaaagagagggggaggttgaagaaggtagataagagaggatgacacgtgggccccaaatgtcagtgggtcccacatatatttttttaattcgaatgccacgtaagcgccacgtgagatgaagactaggtcaacatcgacacgtcagcaaaaccgccctccaaaaccactgagtgagtcaaattgcaccggtttcaatagttcggggagtcgtcttatccggtttcgcgatttgaggatcacgaattagattctgtcgataattaagggagtcaaagtggactttttccttccttcttcctcctccgtctctcccttctctttcgttctctccccttcttccccttcggccggcggcggggcatgggccgcggtgtggtggcggctggcgggagctgaaccggcggcggcagcgggagctgacgcgggagctatgttagaatctctcctctctgaatgtttaagtactaatcactagcactaacataaacacttgtatttactcggtggacacaaacacacaagaactgaacaaaacacacaggcttttggttgatgtggctaatcacaactcacaccattttcttcattacatagacttaagtacatgcaaaagataaggatcagccaactaatttggccttgactcacgccttactccaacatgcagatgccatgcaacaaggtaactagctagacctattcttccgccacaaaatcacttcgtggccttccagcttgagctgcagctctgcatgcatcttaacacatccaactaaatgcttgcatgcagccgctaatcactagttctacatgctaatgcaacagcctttacacatcgtagatatcggcacgttcgtccggccgcatcgcacagctcacagcaagcacgtttcacacgtactggctcggatcctttgctgccacacactactaccttgtgcaaaacctatacaaaccaaatgcatacactctaaagacaagattattgctaacaagctagctggagcggcggcggcggcggtgggctggaggtgatatgggttctggagcggcagcaccgccggtgtggtggacggagttggtgcagggagctcgtccacccggtcgatggcgacggtgatgatggagacaagggagcggatgaggctgggcagtcggtgctgcgacggggctgaggctgaggctgcggggggagctcgtccttcgaggcgatggccgtggacctcggcgtgatgaagaggtggtcgccacccctcctccggcggtggcggcagtccccggagtggaggagtcgacgatagtgaggccagcgctcggcgagatgggacctgcgtgctggacatcaggctggccaacgccgacatgcacgctggcaacatcctcacctgcagagacgaacaaggccatggcctctccctggttacaatcgacaatggatactgtcttcctgagagtgtaagcactgacgctgatagattttcttctagctaattgatttccattttgttcgttggtgatcatgcatcgatcacgcatgtgcagtttgaggattgcacattcgagtggctctgctggccgcagtgtaggcagccattcagcgaggagatggtggagtacataaggtcactggacgccgaggaggacatcgccattctgaggttccatggctgggacatgtcaggcaagtgtgagcgcatcctgtgcgtcaccaccatgctactcaagaaaggcgtggacacgggcctcgccgcgttccacatgaggagcatcttgtgcagggatggggccagacggtccccggagtgaggagtcgacgatggcgaggccagcgcttggcaagatggggtcggcatcgtggaggaagtcgaccggcgggggttgtccttagcgtcatcgacggccgacgatggaggctgaggtcgaaggcggcggcccacacactggcctcgctcgtcggccgacacagaggcgccaatgctgaccttgttcgccgccgccgccgccgctccggattcagcttgggtgactttgtgttggcatgtcacaacgtgacattgtgaggatctctgccatcaaaaacacatccaacagctcgtttggttgggcccgtctgcaggtcggaaatttagccgccgatccatccgtcccgcgggagtcggcgcccgccgatccaacccatcccgtttcgcctcgcccgggtccggccgtcgccgcgagccagcgagttgttctgaagaacaaatcaaaagcaaactccagtcaggatgcaacaaacagaagctgtttgatgtccataggctgatgcttgtgcaggggcagtgcggccggcaagggcagtgcggcctccaggacgtcccctcctccacgcgctgagctgcagatcacagaagaaaaatgaggccggtccgccacggctgcagatcaccacgactgcctggactggctcggcagcctccatccgcagccgccaccgcacgagggtaggcctggtggccggccgctgctcgcctctactcgtgccggcagggccactgcggccatctcgacacgcgcgcgcggcggcccacggcggcggccccactggagtcccgcgacgacagcccccttccgagcggcggcaccggcccccttccaagcggcggcggtggtggttctgggggattcgcgagcagcacgctcgggcaggaaacggagcaatgcggggtgaaaaactgaggcctgcaggtgggccggcgcagaggacccttggatttattttcaacgccccagattgctctaatgtcacaccgtgccataccatggcaatgtcacagaatctgagtcccgccgctccagccctcgccgcgtggaagagggggaagaagaaagagggaggagtcagtgggccccacaaatttttatgtgtgtgaatgacaaacgagtcccacatatattttttaattctaatgctatgtaagtgccacgtcaacgccacgtggaacaaagacccattaatatcgccacgtaggcacgtcagtgaaaacgccctccaaaaccactgagggagtcaatcacttttgaggatcacaaggggaacttattcctaaaagttactactagtttgagggacaaatgatgaactttttcccgtttggctcaagcccacgcgaccatccaaatccagttggaacgttatcgcgagtaacgtgcggtgcggcccatctgtgtgggccgtggagcgagtagattgggcgcggattacgtgcaggccgggcggcctgcttatgcgtgggctatcggcaattcggagagcttcgtgccatcgtaggatggccccggagtgattacctgcgctggcccgcgcggtgcggagaggatcggaattagatatggcgtcaaacgccgtcgtgcgttgcggactcgcggtcggcaggcgggttgcgcgtgttccgtgtgggaggccttgctgcgtgccaaccagcg

SEQ ID NO: 11648 - DNA, 26689 bp, Oryza sativa
  unsure (1)..(26689): unsure at all n locations
ctttcgtcgtgtggcggcggtagatgttactgccgtacggtggcacagcggaggcggtgtcgtgtttggagaaattgagaatgccacgtcttgtccgaatggaacggggttgcacattacgccgaaaagcgagccaacggatcagatcgagctcggaagagtgcggcaagttgccgccgtgttggtcagccgtcgggctcgtgcattgccaggtggcgctgccgtgcgctcctgcttgccgaaaatgacgaacaacgacggtgattgtgctgcgttagccgttagtcactgaaggacttgttcattttgctactattttcaatcttaataagttttgacattgtcaaattttgataaggttgttaaaattttagtaaggttattaaattttggagattttatatgtgcttactaaaatttagcaacaaaccatatagccacttttttaaaactttgaaaaaaaaagtatttttgaaaatggtagcaaagtaaacaagtcctatttttttttattttaccagaattttgaattcggtctttcaacctaatttgttgggtgaaccgaaggaactacgactccggattttcttttgagcttgccgtacgtttttggttacgtgtgtgtaacaaatgtgatatgcctgtcgcatatggttctcagccagaggccatatttatttttctgcgcggatagctcagatcaacctaactgtaagcgacttgaaccagaacttagaagttcaaacttcaacaacgcgcctaattacgatagttccaacctgctgccccgtgtttgatttgtgaacatgcgtacactcctacctgctgggactgcctgcccgtccagcaacacacacacgctgttgtctctgctaccctgcgtcgtgacagcctaacaggttgactgaaaatccgtatagaaaatgctttttatccgtgctgaaaaaaagagagaaaatccatttgcttcaaagacatgtgctacgtttatgcaagccaaaccatctcttacgataatgttcccccctaattttctccagtaatcagaagataggttgaccggttcatctacttccctcttgcaatagcataagctctttaatggtagtgaagggcagctctttgtagaatcgaagatgatgcaaccattcatggatatgaattaaatattaattattatgaaattaacaaaaagttttttttaaaaaaagctatctatctatgccttttttccccgacaaatcgtatttttaaaaatgtggcacgaataaaccgatgataacatgtccatgttagcttatttaagcgtttgtactgtatttctcaaaaaaacatattattagtttgaccagtagttgacacttttctttccgaggaaactttagtacgatcaactaggatatacatattcaagatttttcagttatcttgagaagagtcttacgcttagttgttaagtaaaattatgtaatcctctgagtacatatcttacctaaactgaactaaactcattccttaatccaagtggccgccaaacgctcgtcttgatcaggctgacctcaacggtttcgtcagcatatggttggatcattgacaaggtagctaagcattggcattgatcttaccgagcctaaacacagcttgatcgcttgctccaaaacaaaagtccacagagttcgtcagattgggtgtcctttcttgtagggcgccaaactttaggcgtgcttgcgtcctggttcctgggtaattaaatgccaacgtgccaattgtgtgatatgaacatttactgtctttttgttgtttcctagtgaatcgtcgtcatgttacggacgtacgtggtacggtcggtgagcgatgcgactcgacaaagttgccgcaatgccgccctataggctatagctaagtaattaaggtcggttgatcagttggaattctcttcctccgtctcgcggtcgccatcgccgtcgatcgatagatgggcgggtggttcggctcgttgtacgtggctacgagcagctacatatgcaaacaagatgcaccaacccctgctgatctactgctcagcatgagcactgcaaaactacgagagcagcaacaaagcgagacgacagatctgaagaactgtcacagtgaccgattccaactcgtggaatgtgatggaaacttcagccagtgctcgatgatctgatgacaactcgcagcaatccggtttgctagcctgctaggaagaatcattttgcatgctatagaatggattaaaaaatagcatcacacggccggagagtcgctccgccattgctttccgttccgattcgcatccttgtctgtctcgcattgcattcattaatctgcgcgcacgttgcagctactcgctaactcctgtgaagtaagggactgtttggttggtgctctcaaggatatttgcctgaccagatgtaagcctgagattagccgggaccttgtttggttggtgccctgaccttagtttctccttccctgccctgagctcttttggagcctcattagcctaagtcaggcgaccgttttctccaggacggcgcagctacgctcattaatcctaattaccgcttataataatgtagtataggtactgtagattgtaaaagcagccgaccatataaatatattttatttgtactttcaaggagggatatagcctatccaaatattttattttttttgctaacactttataacaaccgtaataattaaaagcttaatcacgtttagttttcacaggcgcggaagaacaaccaaacagacaagtgttcaggctgcctgagcaggtaaaatttatcatcctatcagatagctctcaggcacctaaatttttcaggcatgttagtgagggcatcaaccaaacaggccctaaaaacgtatcagcggcaagcgtttcatttcatttcaattacgtatagcacagtgtccaagctcgcgaaaggtaaccttgcgcgagcgggcggcttgttggctcggctcgcggcggatggttggagcgaaggccactaggggcatgcaatgcaagatagagacgtttctctttctctttttacctttttaattttaaaaataaacatttcgactatttaatttttaagatatgaaacttttggctagtctaaatagaccgtcgtagtaaaataacaaggtcacgcccgtctaaataacgtgataacattatttgatcacatcgatctgactgtaacaacgttgtaacagcgtagtactgtcatgccactgtagcataacaaaattatcacgtccgctgtgggtggggtaacaatgttattttaccatattaggtggggctcgtgtgaccagaaattttggaactttgaattgtgaaaataagttttactggtgtttatttttaaaataaattatttaaaaaaaataaaaggggataaaattcgccgtgtcgtgcgcttctgtttggagaaagatttctactccaattatttgtggagcgtagctgagagcatagtggacgtattttagcgtgtcatcaccagttatccttagccactcctttgtagagattatatagaatcgcttagttctaaagaaggttgtagttttgaattgttcagatttcatgcttacacacgaaataatcagtgcatgaataatttaacaacattgtattattgttagttggtagtatttcagatcgcagataatatgtttttctagggccgcccttttcactttttaggatactactagacacactttattttcttattaaaaatgattgtttccttctacaaaattagagtacattattatgagttggtacatatatagctagattctacctacgaagatgaagctagttatgccttatcacatcgtgcccacgccattttctgctttcgaagatgcaaacatatcttctacacacctacacagctatgcacgcaaatgactgaaacggagaaaagatgtaaggcgcgtatataatactccctccgtttcacgatgtaaatcattctaacattttccatatttatattgatgttaatgaatctctaatgaatatctatctagattcattaacatcaatataaatgtagaaaatgctagaatgacttacattgtgaaacgaatgaagtagaatacacgagacaatgcaacatttcccatattcatattgatatatctatctagattcatatgaatctagatatatatatatctatctaaattcattaacatcaatataaatatagaaaatgatagaatgacttacatggtttcaattcagtttggtggctgttannnnnnnnnnnnnnnnnnnnnnnnnnnnnnnnnnnnnnnnnnnnngtttttcttcccctcaatttcgaggcatgaaagctatcggtattaacatcatctgcagttctgcacatcagtttgactcaacgtgtacgtttatctgaagaagggatggccccgaaatattgccccgtatttgtaataaatagtccaaaataataagggatatattctctccgttttatattataagtcattttaatttttctctagttactttttaaaagtttgatcaagttaatagaaaaacataataatattttttaacacaaaacaaatatattatcaaaatatatattaaatgtttgatttaataaaataaatttggtattttagatgttgttaatttttttatgtaaacttggtcgaacttaaaaaaatttaaaagaaaaggataaaacaacttataatctgaaaatgacatatcttttgagagaggcgttgtcatgagaaaaaacaatgtagcagcaccatttgggtactcatgggtatgctaaggctgtgttcttcccacacctttttcaagtcacatccctcgtattcggcacacgcgtttttcaaactattaaacttttcaaaagatttatatacgaaaattgctttaaaaaatcatattaatcataagaaaatgtgtcgctctgttttacttgcgcgggagatgagtttccagcctaattttgtcttgtgtttaatcgcaagaaatttggtattaaataattctatcacatttgattttattatatttttctcacactaagatttacgttggatcattagtatgagaaatagataatacggtcattttagaataaatattgccagttaactgacgaaatatgtatacaagatggatataagcatatagataagaccaaaacaaaacctcagggcatgtaggggtgaggtaaaattcagggcctggaaaggattgaggtaaaattcagggcatgcaatgaattttctcgggttctttttttctgtttagagaatttgaattctgtggatatgtgtattttcaaatggtgttagccaaacttcatagagaagtcatctcgaacttgattctactccataatttccacatctttgccagggattagattcttacaaaaaaaaaagaaggcgtggtaacgttgcaaagcaaatcagaaatgtagctttgctaagcatttaattcatatttcatagacgagcgcacaaaacatgtgttttttttaaaaaagaatcaatgtgttgaagcagttggtgcgatattccatcagtgtggtgatgctttcgcaaggactagagaatagtgcttgatattctgccgttccattttagccatgcgatttctgccgacacaaagaagctgtaacagaacatcatctctctcttactaaaggagggcatccatctgcctataatttgctgaggagtaactgttacagagatggtgggctaacattaatcgctaatggttgtttcatgaccagattcaacagtagaatatagtaaatggatgttaaaattaacgttctggggacatcgcagcatcctgccaactttcagctccactgattagttggcggttactggcgagaatctaattaagtttggtgtacaatccaatcagtgagcggagctctctgctccaatgttttggcatttggccaacaattaattcatgcagcgagcaatccatttcagctcgacaaatgccaacacagagataggcacgtccatgctcgtcacatgtggacttcgtttgtcaaaatggcgtgttgccaagagtgtacgtatcagtgcactccgttgcttgtaaacaactaggagaaaatactggtccatccaaaaagcagaagaaaaggaagaaacgagataaggttcatgatatatacaaggatactgttggtggtgcatgatttgcatatacctgtacaataacagtacagtacagtgggaggagagggctagtctgtaaagcgacgcccacgcagaaatgcagaatacaaaacgaaatacgtagaggaaagggcattgccgcatcaacatcacgggaagaattttgttacgggcctttcaatcacggtacacaccaattaatgagatctggttcgaaccaataggctggacaaggacagcaccccgaccacttcgctttcaggggatccctgcgttaagttcttttttttttctttggcccttttggtaggctacacgcttccatgtgtctcaaaaccgtgagctgtgactggctctctccggtttccctttttctttcccacccagacacccagtcccgttttttcccttccttccagtacttatccctgcgagttttgtcccatgaggccacatggacacgcaccgcatggacgcatggtcccccaaccccgaccgcgtccgatcgttcggcgtcccttcgcacacgacctggctacggttctccgttgcttggttgcttgcctcctagcgcgcgcgcgccccgtcaccgtcacgccgcgcaccacctgccaaaaaggcgtcccaccacgtcgtcctcctcctcgtaatagccggccgttgctgcgcgcgcctgcgcgccggtgcgtctctcgtgtggagaggggccgcggccgctgcgacgtgcggcacgggcggctttttctccgcaacgggtgggcgtggacggggttgggttgatgatgatgatgagtggtttctccgcgcgccggtgcggacgcattgaaggcgagcgtgagacgcgagccggcgcgcgcggtggcggaggcagccaaccaccccacccagcgcccggtgtaaatgtggtcgaatcgcgatagtcagagctgcgttcctgtgaccaccaccgccacgtcccacccagtgcagtgcatgagcccagcccatcgcacttttgcacagatggatggatggatggatggtgaggccacacagccatatcccgttcggggtcagacgcacacatgcctccattcaaagtgccaaactgaccaggcagctcgtgatggacgcgatacacgccacgaataaataccagatgagatgagatattgagatggcagttaaactaaactactgctactgctgctacacgcactggcccagcttcttcactccacgtggggcaggggaaaacagagcatggtactacagtaggagtagtacgctttgtacatctcgcagtgtataaaggacgtacggttagtgggcacggggcacgaatctagaagaattcaatgggccaatggggagtgttaccatctgaatgtgattactgttgccggagactttaaactaaatgatctcaaggcatcgtccagccacggctgctgaggcaagggtatcttgagatgcatcacgcatatggtggcatgatggatttgagctagagatcatatggggggtgtcactagtttaatccgtgggctctgcgagcaactgaattgtttttctagcgcccagtgatgactgatgactactggtcttaaccgaaagcatgtagttggtactaacaccgggactttttttacagtagctttgcaactgtgtttgttaattccacatgagcttatcaggctatgttattaaattgtgatggtataagaggagcctagcaatccacgatgccttttttttttgccttatctaaagctcacatccactggtcttgtgcgatagtttaacaaaagccagccttctctgccaaccactgcccacaatggaggacaattataccaccctttatttgctcagcaccacaagtatatttgcgagttaatcacaagcaacaggcttcgtgtattttcgtgtaatgatgttgtaggctacttgtggtgcccacataaccaatcattacactcgcctggtttttcacttctggaaattggagggcaaagagagcaacggtgctactaacatgagtaatctaatgttatttcttccacgatctcctttccacccgttttggagatcacaggtgtccatggtaagaaaaggggagaacataaaaggtgagatcaaaatagtcggtaggtagcattgcaaattttgacagaaaacaacggtttcgtaacgaagcgtgtgatgccaaaagagtctctcaaaccttaaaggtggacattcggtctgaccaaaaatttctgtcttggccttcggtctttcggtcatttcagtatttgaagagtgaagaccgaattccaacacaaaaatatcaggaccgataaattcagtctcggtctcagtcctgaccgaaattcagcaacattttcatatatgtaaagaaataatagaaattttcaacacaaaaatcacaaaaaaaattcataagcaagtatgaataaagactcttattaggttgcatgcctataagagtagggatgtgaaaattagagtttaatcctattgaacttagtgggttgtaggttgcatttagaccttttttttttaatttggtcttttcggtttattcgtttaaccgaggagactaacagaattgactgaacaaaatttggtctttcactgcccaggaccaaattgatgaccagttttctcggtctcggtctcggtcttgtcggttcggtctttttctgcccatccctacttaaaccaacgccctcttttttgagtgataattaaggatggtaagcgttgcggggccgggttgggctggaacggccccgcccccgaccccccgacttcaccacccggccccggccccgaccatggatgcgggtgaaaaatcccacccgcctccgacccctgcggggccccgcaacccgaccggggacccgcagcaagtagcatcttcatccaatcaacatagaaaattcaagacaattatcaactcagtgcatcacatggattatctcctaagagaccaactcaccaacccatgcatttgggcacactttcattcacaaggcacagttggagacttggagtattggagatggagcaatacctcgcatgtgaatcgcctagagtatttgggagtattggagacgtgaatcgccggccgccgccacgcctgtgcgctgcaacctcgccggctgcgcccgtcgcctcgccacgcccttgcatgtctcgccggccgccgcaacctcgccgcgtgcccttgcgtgtatagcctccccactgcgccctgccgccttatgcgctgccgctgcgccctgtgtgtagccgccgccctgagctggatccgtggaggggatgggatacgtaaggccgtacgccggaggggagattggagagaaggggagggaagatggtggctggcgagtggagacgtcgagatgtggccggcgagtgaaatgttccccccgtcccctccccggccaaatgcggggccccgaccccagcgcacccgcgggtgaaaaatcccacccgcccctgcctccgtaggggcgggtccccgcagaggacccggccccgcgggggaaattgccatccctagtgataatccccaatagtgtttacatgaaacaggtgattaacgacctatcgcctatgaatgggaggacgccagaagaggacagtttcctaattaagcccacaatcgagttaagacgatgtgatagaatttagttagtttcgaggtgtaatgcattcatggcctgagcggcacaagctagctaccttccgtttttattcccctccttttcttcctttccatggtgtcatggcgacgcttagcagcatcgtcttggagaggaaaacctgtaatggcctccatgactcatgagacgagatgagctagcttgtgaacaggtctcaagcagccaatcaatgtgttggcgccggccggcaaagtggcttttttgcgtctccgacatgtgaaagcgcccgttggcccccgtcaatccaggcttgacagccgtttcctttgatggtgtcatggattcggcctggaacagcatcactagcgtttgtctgacgagaagggaagaaaaaaacggacgtaaaagttcaggaataatgcagtttcctaatcctaccgtaacatcgatccattaatttcaacatggaaattttggtttttcaaatgtttaatttgaccctatacctgtgacatggaaatttctttttaaccgtttaccatggaattttctgcagattgtttgatctctgaatgggttcatgcacgcatggcgttgaattaggtttgagagaacacgcattggtcacaactttgcatatataggtagagtagcaaaggacaaaaagagaggatggttcaactacatagcgatcaaagacggctgaactgattagaagttaatagtgacaaaagcttatgtaaagtaatcttgggtaggatgagaactctatggcggggaagtttcctaatgaccactgggttaagcttttccaacctagagagagtagagtgttgtttagctctgtctttaggcgtggattcacgcagagagacgctttgccccaatctaatgcctaagcgcgtcaagctgatctcatctacccgtcaacgtgggtcaaaccagacgacttggatgccattttacacaaggttatgtgaacgcccagattctactccgtagcagtagcaccatgctggcatgcttcatgtaaacttgactacatataagctgattagcatgatggccttggctaggaaaccaaataccaaaagacttgaggacagatccgtaactgcagggtttttttactcgttttagaacataaccttgttataaactcatggaaactcgtacaggaagctctctgtggactttaggcactagtatttgagaaggcagctaatgccaagctagccggtgagcagggtttaccattccgacgaaatccggtcggatttcgcaaaatttcgacgtttcgacgagtctcgaaagtagaaatcatctaagatttcgagaagtttcatccaaatttaaatttgaattgataaaaaaaagaaaaaatcaaataaaatcttataaatactatgatattcatagaacctattgggatataaattttcgaaaaaaatgatatattatgtgtatttaaacttacatcagagaagaaaagaataaaaaaataaaaaaaggaaaacacttacatgggccggattaccgatcgaaatttcgatgatttcgatcggaatttcgcctaaaccgaccggttttcaagaatttatcggcaaactcagagaatttgtattcaaattttggtttgtgaaatttattcggaatttaccggttttccaccggatttcacgaaattctgaattccgccagtgcccaaaatggaagtgcatgtcggaatcgtaaaccctgccgtgagtgtttaagaaaagttattaagaacccaatttccagtttctaatttatttattttaattctatcaatatgaggatttttttaattattttttagaattttatttttttaaaattttattaatagacatttctgaaaattatttctaaatctgaaccttttgtcatggcgtggccaaatcactttgtcacgccacgcgtagctggcgtggcagtgttgtcttgccacaccaccgtggcaggcgtggcaaaacaacgctgccacgccaaatattttttggaaattaataaaactttttaaaaataaaaaaaatccactatgagttctaagaatttgcccgaggaaattgtttggaagcaatagattttgaaagataatacaacagttagaagtttcacaatcacaaacaaggcctaaggtacacatgcagtttgatattgatagagacatggttcgcttttcttttcaactcattgaaaacttgcatgcaacttttgaagattattcgttgaattaatgtaatgaattatctacataatttctaaaataaactttcagaaataacttagaataagttatcaaaattaaggttctaggaaacacatttttagaagcgtataacaaataatctacgaatattttagtgaaataaactgtaaagaaagtactctaacgggaatttccaagcacaccttagattgtgagccaatgattttttttaagatttatcaacgatttttgtgctacgaatgttttttgcaatgcaattcctccgtctcaaaatataaaaaattttagagttaaacacgttactagaagtgaatggtggagggttgtgattggatgattagtggagaggtaggtggaaaaagtgaatgatggagggttatgattggtgaggaagagaatgttggtggagaaattattatatttagaataaatcctgatggctaaagttgttatattttgggacggaggaagtacatcttacctctacgagtatttgaaggttgattaagcatatcagaaccatttcactattgacgggtatattgctaatagtgaaaaataattaatgtaaatacaagtcccatgttaagtttataatttaaactcgagtgtggccatgttttactaccacggacataactagccgagctaagctcagttcgtacttcgaagtgctacaaacactctggcaaaagtaggagatttattctactgtatagtctgttatactatcatattggaagccattaaatttgcaccggtttattttagggaaagttgcttatttgaccctctttcgaagcctaattatcaatatgaccctacttttttttagtttgcttatttgatcctactttttaaaaacgaatactccgtttgaccctgtttctttagcaccgttaagatttcatttaaaaaaataaaagaaataaatttattttccataatgaccaaaatgccctccaagcctatgcacatctaaccctatcctgtgtgcttgggcagcgacgcacggaggggtagcggcggcgggcctctgagggagggaatccgcgccggcgccggctcgcggagggaggacggcgacgccggctgcgggtggaggtagcgtctgtgggtgggccgcggcgatgcgttgaggaggaggggccgctgcgacggctcgacgaggagcggcggctcatggagggggggatcctctagagtcgacgtgcaggcatgcgcgctggcgccagctcgcggagggaggatggcgacaccagctgcgggtggaggtagcggcggtgggtgggccgcagcggcgcgtcgaggaggggccgctgccgtggctcgacgaggggcggcggcggcgggccacgaagggagggagggaggacggctgcgtcgaggcgtgaagggatttgccgtggtggcggttgcgggtggagggccgcggcggtgcgacgaagagcggcgtcggacaagggcctagaggacgacgactgtggcgttgctcctcctcgatctgaacaggacgagcggtggcgctgctcctccttgactagaacagggaggacggcggcgacgggcgattagcggtagtgcacaggggaagggaccgccggcggtggtggtgcggagaggagggagcaccgacggtggcagcgcaccatgtgacatgtttttctttttcggtggacacaaatttgcacgagaaactgggttaaattgacaaggggtataattggaatttttgtcttgagttaacaccgtcacgttgccttcacggaatagggccaaacctcatcttcgtttaaaaaaaagaaggttaaatgagtaaagtcgaaaaaacagagttagtcttaaaattagggtaaaaaaacaattgtccctttattttaataaagcccagtttgatttggttacaaactaggacgaatatacgccaattttggcatgcataattctccattaacttcttctattccagtccattatcttctttgccaccattgatatatgcctaacaattctcaccgactacgctaatcaccgtgagcccatccccaaatctgggcccttgacgtacacgagattggccccgcggggcggcaaaaatgggcaaaaatcggtgaagaacttcgcttccactccggtctcccccgtctctccccgtttgtttcctgtatataacgcgctcctgctgcctcacacccccttggccgcgagctctgcacagcgagagagagagagagagagtagagagagaggagtgagagagccggtggcacccagctaacccactcggccgccaccaactgcggccatttccgacgacgccgacgccggggcgcgcccgtcggtgctcccaagtccgccttctctgcgggtgcgtgtgctgctgcatccagcatcctcctccccttcttcctcaccgtgtggcatctgcgtgcctcctgttcttgtgttgctcctgggctcttcttgatctggtttgcgtttgatgcgttgccggtgggagttgctcgatccgggcttggtgcttctgggttttttttttccgatggcgatgtggcgccaccatttgctcgattcggtgtccggggtctctctttttttgcgcggcagcagctagcagatttatttttctgttgccttgctcctagccagtggcgatgttggattttgcagctcccttctacttcgcatttttatcaattatttactcttttttttggtgtgtgtgtgtagttgttctcctgggctttgctctcactatgatgctgttcttctcgggaaaatttcagttctttgcctgctactctctctctctcttccttcgtcctctgtggccgcattggattgttttcttttgcctcggtgaactccatgctcacacgaatcctcccttgtttcttgctccgatttcagatgagaagctgctccaccgcggcggcgacagtgtggtcggccaccgcctgagaccggagagccatagctgacggctcgggggaagattcaggtgggctcgcagagaacgaaagagagtccccatgggttctttggagacgacgaacacgcggtaccggccggccggagcagcgtaagatctccctaccaccacgctgtcccgatctgaagaaaggctccacctttgcgtgcctctcttccactgttcttctctctctctctctctctctctctctctctctctctctctctctttagctggtttacatgctttgatgtatgtgctcgcttgctaacccggctactgtggtgcgttgctttgccatgtgctatcatgtgttgcatgtcgagttcgattgactcaaaaactaattacttctacttcttggtcgatgcgtggcgcccggcgccggccatatcgtcgtggtattcttgcaggaggtggtagtggtgatggtgtactggtttttagtacgctgtacaagatgccgttgttctccttttggtctccgttcatcatgctctcctccttaacttccctcatattgtaggtggtgtggtgggtggtagttgtgcagcttttatggcatccatccttccatttttttccatcctcccccttgttgatgctgctgctgattacagctaagagagaatcagagaacagcagaaacgtgctatctctgcatgttttactctctcttttctagtgtgctgctgctcctgatgcgagttggtttgatgctgatgtgtggagaaaatggatgtctgtttttgcggattttcctttatctccagacggaaagttggttttacttttgtggccatctgatcccctttttagcggctgcaatttggttaaattggatgtgctgtgatgtggagccaggcgtcggtggtcatgtgttttcactgccaatttgaccccaatgactgcaccttgcatcgccggtgccattaaaattgctacacacattagttccatgtgcagtcctcagtggtcaccagtctttaggcacgttgaagcgtaagctacagttgttttgtgcctgtgtggcccatcagcgccaaatgggcgagcttagcgtgtgtatagaatgctgggttttggctagttggatgcttcgatgcacgctagtctagtgggttcagtagtcaggggccggctccgttgttttgaatcaaacttcttgacaaagctttggtgttcacagctgggattacccatgagtgcagcttttcgtttcatgtttaacgttatttaaatcgctaagcgcacttttaaatttgagaccaataacatggggttaggtactggagtatctttgtgattagtgatgcttttctttcctaaaagatgtggtgtgactaataaaggaagaatggaggaaaatgaattggcaccacttctttttgctaatctttttctttaattctcagtgcggagaaccttgctattttgttctctttagccttttttctttgatagctaatcaactttactatgatcgcttttccatactaccgtatgagagattaagtactcctttgaaaagatgtgctatattttttttatagatttagtgttactagggctgtttgtccatataggccagccagatcaaatacacacaagactagtgcaaacttctaggaaaacaaaacatgatcaccaagaaaaatgttttctaagctatctttttgggattaactaatgggaacaatggggccttacaattgatatggaccttggctagcaatttttattacttccatgtgctttcgataaaacagtacaacaatgtaagctgttttttggggaaaatatatcatacttatttattcagtagttctttcatatacaatttcttcttcagacagaattcccccttgtgtcttcatacctggtgcaaattccaaagttttgtttcatcttgctgactatcctacattcaggggttgctttctgaattgttctttaccaattattatttgatgcccaaataattactgtaagaagtcgctgtctgactgtttcttctataccttctttcagggatgacacagctaagagaaggacccagaaaagcaaaagtttcaaagaggtcgaaaaatttgatgtctttgtcctagagaaaagctctggttgcaagttccggtccttacaacttctgctcttcgcgatcatgtctgctgcatttctgacactattgtacactccatctgtgtacgaccatcaaatgcagtctagttctcggtgagtagacctatcaaaaggaaacttattacaatattctgtcagcagtagaatatccagtggaaactagaacaccaattcctgctcgcatcacagtggttatgttggagttatatataataagaaattgcgcattaccctttttgaccatacctttcatatgctttacaggtttgtcagtgggtggatatgggacaagaccattcctgatccacgatatgtatcttcgcttggtgttcagtgggaggatgtatataaaaccgtcgaaaatctgaatgatggtgaacggaagctcaaagttggactattaaattttaacagcactgaaattggctcatggacacaattgctcccggatagtgatttttcgatcattaggctagagcatgccaaggaaagcatcacctggcagactctttaccctgaatggattgatgaggaggaagaaacagagataccatcgtgtccatcgcttccagatcctatttttccaagagggacacactttgatgttgttgctgtgaaacttccctgtacccgagctggtggatggtcaagagacgttgcacgtctgcatttgcaactatctgctgcaaaagtggcagtgactgcttcaagaggcaatcgtggtatccatgtgctgtttgtgacggattgcttccctattccaaatctcttctcttgcaagaaccttgtgaaacatgaaggcaatgcttggatgtacaagcctgacttgaaggcactaagggagaagctcagacttccagttggatcctgtgaacttgctgttccactcaaagcaaaaggtatgtcttactgccttcatttttaaatggcttcccatttcatgccacttaatccctatgatatataacaagagagccaaatatgaagtagttaaaatatcgatgttgctgtaagtaagcttttagaatctaccattgcatttctttttcgggaatgagcaagagtggttgctttatcgcagatgtatcagtaatgttttggtgattttgtccggaaatgttagaacatacttttgcaccttctagttttattttcctgcgtggcattgaaatttccactagataacatctttcatctcctttacagcacgactttactcggtagacagacggagggaagcatatgctactattctgcattcagcaagtgaatatgtctgtggtgcaatcacagctgcccaaagcattcgccaagccggatcaactagggattttgttattcttgttgacgagaccataagtaaccaccaccggaagggcttggaagctgctgggtggaaggttagaataatccaaaggatccggaatccgaaagctgagcgtgatgcatataatgagtggaactacagcaaattccgtctatggcagctcacagattacgacaagattatatttattgatgctgatctcctcattctgagaaatgtcgattttctgttcgcaatgccagaaatcactgcaaccggcaacaatgcgacactgttcaactctggagtaatggttattgagccttcaaactgcacattccagttgttgatggaccacatcaatgagataacatcctacaatggtggtgaccaaggatacctgaatgagatattcacatggtggcatcgaattccgaagcacatgaacttcttaaaacatttctgggagggggatgaagaggaagtgaaagtgaagaagactcggttgtttggtgctgacccaccaatcctctatgtccttcactatttgggtctcaaaccatggctgtgcttccgggattacgactgtaactggaataacccgatactgcgggagtttgccagtgatgttgcacatgcccgttggtggaaggtacatgacaagatgccaaagaaacttcagcactattgtcttttgagatcaaggcaaaaggctgggttggagtgggatcggaggcaggctgagaaagcaaacttcaccgatggacattggcggaggaacataactgatcctaggctgaaaacttgctttgagaagttctgcttctgggagagcatgttatggcactggggtgaatccaagaactcaacgaaggaaaaccctgtgccggccacacctaccgcgagcctcacaagttcatgagatgtgtagatagccctataccagatacaaacttctaagctccatacatacatagcaacagcttgtaaaggtagctatgcttaggtttctcgacaaaactataccttgtgtttgctatcatggcttcggctccactctggctgctttgatagctcacaatttttttggttttttggccaataattcatcagtataggtaaattttctgttcatgaattgtttggtcagtctggggttggttgttgctcggctgcaatagcctagttcgatgtatggtggttgaactgtttcggtgataaaatctggagtgacgcaacatgagattgctgaccagcaaacactgcctcattttgacatgaaatacagtattgttttaaaattgagttggattaatacggtcacggctgacatccacagatggttggacgttggagcagctggggccattttgcactggaagtccctgaagcacacgaggttgtatgtatgctttgcttatatttggcatacttagttaaggcttaagagatgggaatctttgtttttctcatagcaattaattgcgggacttgcaatcaaacatgcattcaaaactcaagtgatgagccccattcgtggggcactgatgcacagctgcacaggcagagaggcagtgccaacctaacaatgcagcattgaaacgcactgctgctcactgcaggtgtggaacatgggcacaaccagatttctgaagagatctggtggcaatgccatgctgccaaagaagaacaacatcataatttcccagtatcaattatttagccatgcttccgttccttcgagatgcagcctttcgggggtagctcatgctgctgcccttttccaacggcaacgcaccgactaaagcagaagtgttaggctgtacaatttctagcagcgtcgttcgccaaagatactcctaatctctctttctagtagtacttcccttgtccttcaagatgggagtagttggaggattgcatcacaagtgattgactagtttacttctcaagaactagtagtggtataatgcatttatgcatctactggtactttactacatactggtactgttcatccacgagcttggcattgggggcagtacacagctaacggagtacatgagcaaattttgtgagagaagtaacttgcaaatgcagtgagccagaagctgaaacatgaggaaaatgtgaattgcgtgagcatccctagctaaatctacaggagtcgtagtaaacgaaacgggtcagctactaaggtttcatcaagctgttgtttatgaggttgctggacttgttacgacttagcacgaacataaacaaattcccagtgggctgcgagacatttcacgcgaatatcgtggaaatcctaccaacccagccgtccagagagagagagagagagagagagagagagagagagaggcgtacggggtaggagtacacacgtggtggtgttggagtccgggtgtcccttgtccgggcgagcacgagagtgtggcgcggccaccgagtgtagtatgtcatcttccgcggccctgcgccacaggcagcacccaccagcgttgtcaggcaaagcgagcggtcgtcgcgcatggtagggcatggaccgactccactccagtgcccactgccctaggcagggagggacccttcccgcgacacgcgtcctctcgtcgtacctggtgccaggccagacgccagctttcgtgctttgaccggctaaagaaaacgggagggcgaagggattaccctactacagtcttgtgcaagccgtcgccgtcgacgcggaggagggccggccggtcctcacgctgggacgtaccgcgtacgtgacggcgtgtgcggggatgccatctgccatgccggtggcagcggcagcggatcgggggcggctagtcagattggcatggggacttcgccgagttcggctgcgggggcttcgaatcggagaagttttcgctcagaaatagcggatcggggcagctcccggccggtgcacccggtggggttggcgtgctgctcggtagccggatggtcgatgggttggcacggatgccacgggccggacgtattggactattcggttggtttcttgctcgtgttttgcgtagtggatatggtggccctcgtaaaggttctcgtgttcgtgttcgagtagtggatatggtgggcctcgtgagggctcagtagtgggcatgtggtcatccggtacagaaggaaagaagcccacaaggagaacgtgtacaaaggatgaaccgaactcaaaggaaaaagttcaatcagagttcctaaaaaatatagatcggatattattcgtacaaccataaaaccagttaagaacgactccctctactattaatacaggttcaaatttacctccacatgtgatttggacaatggtttttgtcttatgtgccggcacactaacctagtctttatcctacgtggcacatctatctattatatatattattaaaggaatagaaaaatgagtctttacgtttgctctcatggtctagaaattttcacattaatcggagaaaaagaaaaaacagagttcatatagaaatacaatttagaaatagctgaaattcggaattaaaaaaaaggaatattagaataggagactagagtccatatagaaatacaattagaaaataactgaaattcgaaattaaaaataaggaatattagaagtaaagtataaagtccatatagaaatacaattagaaaataatagaaattcgaaattaaaaataagaaatattagaagtagagtatagagtctatatagaaatacaatttaagaaaaaaatagaaattcggaattaaaaaataaggaatattagaagtagagtacagagtctatatagaaatacaattaagaaaaaaatagaaattcggaattaaaataataaggaatattagaagaagagtatagagtgaatttaaaactaactaaaattcagaacaaacataataaaattaaaagtagtgtttagagtccgtataaaaatacaatttacaaataactaaaatttgagattaagaaaaatatgggaagaagagtttaaagtcaatataggaatgcaatttagaagtaactgaaattcgaaattaaaaattaaagaatactgaaagatgagtttagagtacacatagaaatacaattaaaaataataaaaatgcagaaataaaaaaataatattataataagagcatagagtctatatagaaatacaatttacagaaaattcggaattaaaaaaataaatattaaaagacgagtctagagcccatatacgaatatatatatatatataatttacaaataattaaaatttgatattaaaaataattaataactaacacgtatataaaatacaatatgaatattacccattagtagtttcgtaaagttattgcaaaatttaaaattatatcattttaatatatttgaataatatattgagaaaacatatatattattattatatgagagaaaatataatgatactagccgcgcaagctgcgcaggccaccatactagttttttttaaatagtggacccacatgtaagtccatgtctcatattcttcatcacgtctccctctctctctttcctcttccttctcttcactcttcctcccatcacacttccaacaaacagtagagacagagagcccgagaggggtggaggtggcgatgaaccggagccaggagggcaccggtgactattcccctcttcctttcgtcctctctcctaggattggggtgccatggtcgtcaaaagcaggaagggcgtggaaggcggtggtggttccagcagctccctacgagttgattgacttattattttttaatcatttacatgtgggatatatatatatatatatatatatatatatatatatatatatatatatgttttaaatttctttgatgattgggctatcacatgaatgtcacattagtaaaaacgaccatcaacattgtcaaggagtttttttgcacgggtttagtggttgctaaataagatcggacctatattggggaccttttcaaaattctaatctgcttctatctaaaatgataagttggttaagttgggcttgaaggtcgaactcaagggtccaaagaaggcctctctgaacaagttgggctgggcccgtaaattctgtgtcgcatttgataatctcattcaaaaggcagtcaacaccctttgtccatgttccttactacaatcctacagtcgaatagatggtcgtttgccaggttcgaagtggattagcatcgacgatccacaaacatcttggcgcttctgtttacttgacattgactggtgcgtcacggcgcattcgttgtccagtgcacttccgaagtgggtaggcggaggcgcagagcacaactccgaagttggttggtcttggttcagtacttctgctcgttgggtcgtagggccggttgcgcacatctgcatatggggcggtgaagagggcggtggtcggtggacgcttcggcggaaaaaaggttgctgcgagtgatggctgatggaccaccactacgagtgaggcgagatgataatgttctggcgacgcctcatcatgctaattgcggatagcgcacgcggacgccaacctatctgttgtctgcatcgcactcggccgactcaaaattggaaatttcagctgtttcttttcatagatttagccttcacgttcacggtcggctagcactagatcatacatcctcattgatcaaggaaaaggctttggccaccctttcattaaacattatgcacggcacaatgcgtttgcacagttaaatggctatacgccgttggcagtttggcaccatctcattcgaggggatcacacaatggaccaccatttacttctttttatgctgctctaactaatgtattttgggtatccacttgtcaccctgtatgaagctggcgacgctgtacacgtcgacgtggtccctgggcacctggctgctccacccgatcctgctcccgctggcgccgtcgccgccggggccggcgctctcgtactcgccgtagtagagcgtcttgagcgcgaagtcgccgttccacgccatccacccgcgcggctgcacgatctcggagagcgtgcagccgacgtacaccgtgcgcgagtactccttccagggccggcccaggtagacgtggtgcacgtcgggcttctccctgtacagcgccatgtagtcgtcgctgccgttgacgacgcagccgcggagcacgatccccgtgggctgcgccgggtcggtgcgcccctgcgcggtgacggcgtcgttctcgcccttctccgggcggagctgcctcgggaggacgatgagggcggtgtcgcggaggacggtggccgagttgccgaagacgaagtcgacggtgccagagacgcggcaccgggtgtagaactgccgcatggcgtgcgcgtacagcgtgtcctggtggcccaggagctccaccgtgtccagcaccgtgcggtcgcccgtcgaccggaacgccaccgcatggtgcgcgtcgggcccggccgtgttggagatcgtcaggtcgcgcgccatgaagccgtccgcgagcacgcctggaaacagataagagattaagatcaccaaacacattacagccggattaggattactgtgagcacgagtacgatcacgtctcgtgacagatagtacatctcagggtaaagttaaaactgagagttgtgactagccgaacgaaccatgccaggtctagtcggcagtccacgcctagtttggctatctgtttggcagggaccaacaaaagggaaaggcacgaaaaggtacaatcttttactttgcctatgagtagagaggctcgtgatgctgggacgcattgtcgcttccggccacactaattggatggcctaagaacgaataaaaaagaacgaatgtttcattgcgcgataagccgattgattaatcatttgcaagggggaaaacacaacaagtatttatcacatcccactatcccagatggtttgtactctctttctcctccaaaggtctggagacagagcctaattctgaagaaaaagattgttttagttcagtgccaaatcttgcccttctaaattttgtagtctaaatagtactacctgtgtggtgtttggggttaaatgtaatacttgctacatcaatagaattctctatcaaaatattggtagggccaaaacttacctaaaatttagggctaccaggaaattggtgggccatgtacctaaagatttggaatcatctttgtagtgtatagaaatttcatatctgtccaattgtccaatgaattactctagcacttcaatggcaattagcagccattaactgcatgcggtactaccacaagtttttttttttataaaaaaaatatcaacaccaactaaacacagcataaccagggtttccaaaccgttggggccgggactaccgcgcctcggcggtaagcacggttaccacgcagtaaccgtgaaaaaacccgtacgaaaccatgcaaaatttatcaaaaatttaaattattttttaaatttatttgaatttaaggaggttaccgcggtttttctattaccgtaccctgcggtaaccgcgtggttaccgacggtaatgtaaaccctgaacataaccagacatgcacacaaatatatttgtacatcaaaatttgaactaacgtaggtagagtcatatatacacgactcaccatcacacaaatggcgttcccctactaaactgggatctagagtcgtcctaaaagcgtgaagtcaaaccttgaaaccttacatgcttaattaattaaaaaatatttagatttcacacaaaaccatattgatagattttcatgaaaaacactgcaagaaacttatattttaatatatggtattttttttacaaatatacatagttagataaatagcgataaaaaatgcatcagggattgcgttgatctccatgtaagactagggtagggtagtgtctgactaattatcatggacagtggaaaagagatattgggggtacaattttcacattctcatggttaaataacttcctaatatagacgtagtcaagtagggttcacatcatctattataatgacattcttgttacagacattgacacgtagaacgatagaagggtgagatccatatatcagg

SEQ ID NO: 11649 - DNA, 10355 bp, Oryza sativa
  unsure (1)..(10355): unsure at all n locations
ggcgcagcacgcgacctcggcggcgacgagggatccacgcgccacttgccaccaccggcgccgtgcctgccaccgccggcgcctcccaaatctggccgcggggggccaagatccgcccactacggcgccggatctggcgcccccaaccggcgacggcgcgaggcggaggatgccgggaaagacaacgacgagcggcgacgggagagagggagaaagagggccgccggtggatgccggcgacaggagaggcggccctcctcatcgtcctcgtggccgccagcgaagggagaggggagcggcggcggcggcgaaaaaagaggagggggcggtggcgacactggcgagagagagagggcggcgaaaaaaagagggggcgggagagagattaggggtagggtagtaaaaataaacatgggactttgtgggctgggatacccattgtgggttggagtgtctctattaagtttcttcagattttgaggagcacatccaggggtgtcctctattgcaagctaagtttccttatgagtgtttttagttagtgaagatactctatgagtgtctcacaagctaagtttccttatgagtgtctttagttagtgaagatactctatgagtgtctcacatctaggagtgtctcacatcgtggatgctctcaataactgtaatggtagtatgtcagaggatcctcacgcatgccgaacgcaatgttcacaaaagccaacaattaatggccgacgtcacaaattcacagaaaggcattttaggtgcagacaaagtgctaaattggctggtcacgagcagcagctaatgacaccgcattgattcatgcacgtaccacgtgtaccaccgtagagaaaaaacgtacgctgtgccagctaccgtatacgtacaaagacaagatagcgttgaaagaaggggaaaaaattacgggtatacgcacctacggtggccgtgttgaacgtggagacgcccggcgtgtcggcgttgaggtcgccggtgatgaccgtcttccccatgccgtccccgacgaccaccacgttcgtcttctccaacggcacgttcaccgtctccttgtacaccccctccttcacgtgcaccacgaacatctcgtcgccgtagtccggcgccgccgccaccgcctcccccaccgtcttgtagtggcaccccgcgccgcacaccgtcacgttgggggggagccccttgggcacgccgagcgcgtcctcgtcggcggcggaccccgccgccgcgggcggccagtagccgtcgcgctcggtctgcggcggggcccaccggaaggtgtcgtcgccgtagcgctgcagcgcggcgagcatggagatgtagttgctgttgacggcgatggtgtcgtcgaggtaggccatggcgtcggagatggtgcgggagaagttgacgtacttgtaggcggaccagcagtcgtataggtggaggagcgcggtggaggcggagaggagcgactgcgacgacgtcgagggcggcggctaaaggcggtgggtggagaaggagaggaacgtgaggcagttggtggcggcgttggtgaggttgacgttggaggaggcggcgaggacggaccgcgccgtggagacggccggcgggatgcgggccctgagcgcggagagcgtggcggcgaggaggtccggagtggacgcgtcggcggaggcgttggagagcgtggagacgcaggcgggctggaaccgcgtggcgttgcaagcgaggaggacggcgagcggcgccgcgtaggaggccggcgccggcttggacggcgacggggcgtggtggtggtggcgcgaggagagggaggaggggaggtggagcaggaggaggaagaggaggaggcgaagcggcggcggcgacattggagacaatgtctggatggagtcgagtgggaaatggagtggagtgtgtagtggtggttagactggttggttatatcggcgacggtattaggcgggggcagctgaggcttggttgggcaaatgggcaagggaggaaagaaatgaagaggatggattttgatgggtgcagcagtaatggaaagtactccccattgcagataaggcattgatgtgtgtaaatttgctggtaacagttgaaattctgctgttggttttgctaaccatttatgttgttggattgtgtgttccatttctaagcattgcacccccaagatggaacggaatcagatctcacctgcggaagttccgctagtgcaagaccggtgatacaatgtctctccgcaaaccacagtcttcgtttttactggcagaaagtaatataatgcagataatttcattccactgcattcccttccccacgaaacactgtcatgatcatcgcacgatttggagtttgatagcattcctcacctctacatgctctgccctggtttgcctcgtgaagccgacatgatagacatcttttgaagctacgctaaggatacttgaaattgcccaaccgtgcacggcagacacttccctcttgggttgcatccccgtccgggtgaatctaaagagttcgtttagccatgccatctgccggtcccagcgaacacgaagccatcagtccatcacgatgccgggcaaacatgcacagtttttgtacatcagcatacgttaatcatggaaaactaaacaacctgttgtcagtttgtcacatattcacaatgtagccatgtgacattgtcgttctgtgattttgtcaccacagctcgctccccacaggatgatgtcgcggccgtcgaatagagatgggtggttttttcacatcctcttccacgtagcctactggttccctggacatgatcacgggaatcacagtgcacacaggtgacaggtcggcatctggcggatcagtgtccacttagactgtagagtgtacagtactcgccagttaggcacagccgcatagatgcaaatccggaaatgctgcgatatccttcacaatagatttagcatgaattcaataccactgcagcacaaaaataaatagagcaaacagattatcttatggaaaactgttgattgcattctatgtacgactagcacaaaagaaaaaaatagaccaaacagatttcatgcatgagaaatgactttccaaaacttgcaaatgaattggtgtttacatacaggttgccgattgtgatgttctgtctaaaacgcaaaatagacaatgatacaaaatctgtaaccccggaggcgtgtataaggagcacttgaggaaaaggaaaaaccaagatgaagacatgctgctgtagtgctgtctaagaaaaaaaaatcatggtccgctacttgatagcagacgaagcagaagcagcagaaaaacaaaaaagaaaaagaaaaagaaaaacaaagtataatgtcagcagtcagtcagccagccaaatttcgccaacctgcaaaattgcacgtgaggaaagatcagatcaatatatcaccatttatctccatcaattcaaagacagcagcgcatgcagtggaaatcatcgtcaacagattgaattctgcatatactagctaaatgcccatgcgttgcaacgaaattaaaaataaattatgtcattacttttcccaatgttaattgaaaaaaaaatcatattttctttgaaattcgatgtgaatggattatgctggttcatatggctcaccttttgatgtagagtggtagatgatggattcactgatttgaatttcaagcacaaccgtggttacactgacagcatgaacccacataagtgcataggtatggtggcagattcaccaccaccaccattgaggtcttttaaaggagtatagatactattttttctatcacattcaaagtatattcgggataagattaccataaattatttgacaagtggagtataggtaagttggaagtattcctgtgttcaggtaagttctctcccacccaatttcaacattgagcaatcatcatgtttagtccttggttttacacaaagctagtacaaagttcagttttttaattatgaaccgaacaatcttaccaggttttgatgtcaaagaaaaaataacaaggggggacaataggtaccaagtaatacatggcatattttgcactatatataaaaaaactggagggttccaggttagcttgcaacaaaaaataacttaagagaagaaaatttttgtgggattattactacacaatactttacaggaatagtgttataaataatagagtaaagtgcattggcgatccttaaacttgtagggttgtgtcatataggtccgtaaactatcaaaacgcatatccaggtcctagaacttgtcaaagtgtatcatttaagtcccaaatcgacacatcccctctaggatcctacgtggcgctgatgtggcatgccacatagacgtgacgtgtcattttctttttttcttcttttatttttctttttcattttcttctcattcttcttttttttttctgctcgggtcacatagaaaggagacgaaacgggaaaaaaagagaagaaaaaaggaaaaggaaaaaaattaaatgggttccatttgtcagtcaaaatgatgccacatcatgtccatgtggcatgccacatcaacgccacgtaggatgctgaaggggttatggcgatttgggacctagatgacacactatgacaagttctaggacttgaatatgcattttgagagtttagagacctagatgacacacccctataagtttaagggccatcagtacactttactctaaataatatgttaaaagaatgataatgtaaaggatctcaccatttgtcaaaaggtgggaaattactagttcattccaagcatctgggactccaggaaggcaccaatgactgcaatcaagtatggttgaaggatgactccatataccgatatgagcatcacttctgaaggcccccatcaaagtcacattcaagatagttgcaggaacgctcatgttcaccacaaccccagcgagtatatctccaaattcacttctgtcatctcctttggcctcagctgtaggaaattctgttacttcacataccttttgatttgaaccactgtaagtatgcaaaaagggaaaaaaatacaaatgagtgtatgtctttcgcaaatcatttacactttcttcaaaccacaacagtagcagtcttgttttcattaggtgcctttataacacaatacaagaagaacaatacactggaaaagatccgatgtatgtgagaaaacacacctccaatgagatggctcatacgtgcggaaaaagacatgtgttcgttttaaatccaccttttccttcacccatgaagcccatgtttcaagtgccattttgaaagcagaattaatggatgtacctagtttaagcaaacctccagcctcaaaatagcagcccctgttaaaaacacaaaacaataattacccattagtgaaacagggaaatgacaatttagtagattgttcgtaaattgtaacaatttgcaataataggaatccacattagtagaaacacttctgaggaatatgcacaaacataacttaatagcataattgaaacacaatgcaattatcgacagtgtatatttcctaactacgactattctggtgaaggacggaatgcaccaacatcagccatcaggcaattttgacaggagaaacaaaaacactggtacttgtgttgctttgacctcaagtaacttcactaagattgcaaggcaacccatcacttgtttttgtcaatttgttactatcaatacttttgatcagtccacttcatgattcctgaacaggataaattgtgttgagctcttaaaaaaaatactgtctagcacccctttgatctaggggttgcttagaagtcacatactaaataacagatatctttcaaagcgacactgtgctacctatatgccaaaccattggcatgcacagaacatctatccaaggatttttcgcaaaaacaaatgtattggagcaaacatatattaggttcatgatttttaagttaactgcagtagatatgacaacaattctaagaacaaattggtgttgctaagtacaagtacaataagaaaactcacatatcaaataatttgctgggagtccaccaatgccctgagttgaaaataagcacatcagcattctcccatttccggctgatattatccatcttatcaagcttgagaattgctcggaccctttttgggctactgcgaggtgcagggctctgttgtacaagaaacaccgaccggaagaactctacattcaggttgaatgacgcaaatctcactcctaaaaaccggatagtctttgagatctgattgccattaacctcataaacagtcttgggattctccacccctgccatgagcatgcagatgaaagattcccactgtgtccggctcatggagtcccccacaaacacaaccctcttccccctcagccgttccaacacatccctggcactgaaccgcggcaagtcgcatccccttggcttccaccgccatttcaggtagccggtgtccttcctcccatttgccaggcaattgaatcccctctccacaaacgggcaatcggagctattgtacaaagggtacctcctgtccggcacccagcttccgtcgaacacgtcgcaggactctaggttgtcgccggcgaactcggcgaccgcatggccgcggccctggtaccggaagagatacagatacagcgcgcaggcgagcacgagcgcgacggaggaaaggaagaaggccaaggcagcgcactcgaacgacggccccgagggcgcccaccaccaccacttgcggtgcgcggccgccgccgccgacacccgcgggctcccgacgccgcccctcgctgtgagccgcgccgacgtgctcctgctaaagctcccggtcaccatctcgccgccgcatccgccgccgcctgatctcccatcacacaaacccccagcagccaaatctgctcgaacaaatccaccggcgcggcttcctatcccaatacgccgcgttcgaatccctccgccaaatcgggccggatcgaaccttgggggggccacctaaccccagtcccgcgcacagctctccagatcacggagcaccaaaatctcttgctgcccaccacggaagaggaaggaaggatttccacgacgaccgggatcagggccggctactcaccagattccaaccacccttcttctccggcgatcgccggagcggccgcacccagccccctgagcaggctccggaactgctcgatatcttagtgggcgcgtcgcccggcgacctacggctacgtcagcgctggcgcggcgcgaggaggaggaggagggccaagtccgaggagtagaggaggaagacgacggctccgcgcagaggaggagggcggtggctgaggaacgcgtgcgatttaaataccagagcttccagataccaggaggaaggaggtttctaggctcactgacctgtggggccagtatatgacctggcccacctggcattgagttgcagccgctctgcgctacgtgacgtgacgctttgctttttgactttggcggtgtcgagaggagggtggtggttctctggtcgtgcgcggtggtgaggtgaggtgaaacgagtggtctaagaaaaaatttaaaatttgttatatcgtgggaccgagggagtatcaccctaccggtaacatcaacggccatacggagggtcaagtgttcatcggtacgaccgtactcgcccatgatctgtccacatcacgaaggttaggggaggtctgcaacttttctgccattctcagctcagagttaaatgtgaggagaaccggagatgggcggctgatggattgggaggccttctaaacgaacacaacgccggatctaggccagctttcatgtgcggcgcgttagtgttccatggcctgatctaagaggccgaaaccttcgggcaatcctttataggcccaactacaacagcccacacgtccgtggggatcccgttaggccgtttccgacccaacagctacggaccgcacgttctcaaagtccggcctgggcacatctgttgcacgtaggaaaggaataagtttactttgtgaccctcaaaagtgatcgaaatctaatccgtaaccctaaaccacaaaaccggatacctcgacccctcaactcttaaaacaagtgcaattcggtggttttggaggacggtttcgctgacgtggtgcctacgtggcattctagtcatcaaataaattaaaaaaataaagtggggcccacctgtcagtgagtcctctcctacgttctctctttcttcattgccagcagcggcgggaggacggggtgagcggcggcggctggcggcatcggggcgcagcgcagtcggcggctaggacggcggcggctcggccgcggaggctcgcgatagtgggaggacgaggggaacggcggcggcggcggcccaatatgctgctcgtcatcctcgcccttgcggttaccggcgcggtctccgacggctcgcgagtcgctggaccacatctccatcaactgcatcggcgtcgggggacatgtccggctgccgctccgtccactcgcgcccgttcagcaccgatgaggagggcgaggctcctcgtccccgctcagccgcggctcttcttggatagtcccgactggaggcagtcggcggcggggagggagtgggaacggaaccgggacgatggcgacgagagaagaggaagctggctcgcgtcgggatcttggtggttcgtcggcgatgatgccgtgtgcgctgatgtgcaatcttgagctttttaatttctgttttgcatgcatatagtggctggggctgaagtctggcttgttctttccagttatgcatgtaacgaactgctgatggagatgaataaatagagaagaaaacagagaagctgcggtgactggtgagacttaagcagcacaaaaaccactctgttcagaactctgttcttcggtttttcagtttactgttcacagtcttacaatcttcagagtttcagagattcagtgaggttgagcgtgtgagttgtgagcgaattgcaagtttcctgacgacggtggtggtctccccctctcccccgccgtaggcgacgacgcgatggtggagagcgcatccagcgcgccgttcccgagcgacaggagcgtcacgccggcgatcgtcgggagaggcggagcagccacgagaggcccttgaggctggagcagaagtacaccgccgccgtgtcaccgagcaggtagaacagcacggcgagccaagccgccatcacgccgtagccaagaacccgccgctccacaccgaacacgcagtcgaacaggtacaggtagtcgacgtagccacgcgggaatcgccggcgatcatggccatcctcctcggcgacgtgctcgcacctctccccatagctctcaacctggaatacgccgccgccatcgcgacgcccccggatcccgccctccttggacgacgataccacctccggcggtgtgccgccgcgcggcaagatgatgaagaagaaggcgagcaggagcaagaaggccacggtgacgctggcaccgatcagcacccttgtcgccggctagtgcggagaacagacgacgaccccatctcgccgagagctggcctcgccatcgtcgactcctccactgcggggaccgcttcagctcccgccgggtggcgccacaccgcagcccatgccctgccgccggccgaaggggaagaaggggagagaaaaagagagagaagggagagagggaggaggaaggaggactgacatgtgggtcccacagttagtgggccccacattttttctgtgtgtgaatgacaaacgggtcccacgtaaattttttaactttaatgccacgtaagtgccacgtcaaacgccacgtggatcaaaggcttggtcaatattgccacgtaggtgccacgtggcgccacgtcagcaaaaccgctctccaaaaccaccaagggagtcaaattgcaccggttttaagagtttggggggtcgagatatccggttttgtggtttagggttacggattagatttcgatcactctttaagggtcatgaagtgaacttattcctgtaggaaactatgttggaaaaagtacaccgaaggtccctcaacttgtcaacgagttacaaaatcgtcccctaaccgcaaaaccagatatccaacgtccctaactaaccaaaaccggtcacaaatggtccttccgtggttttcaccccggttttgtcctatgtggcggctgagtcagcgtgggacccatgtggactccatatatcaggctgccacatcannnnnnnnnnnnnnnnnnnnnnnnnnnnnnnnnnnnnnnn

SEQ ID NO: 11650 - DNA, 6701 bp, Oryza sativa
  unsure (1)..(6701): unsure at all n locations
nnnnnnnnnnnnnnnnnnnnnnnnnnnnnnnnnnnnnnnnnnnnnnnnnnnnnnnnnnnnnnnnnnnttcgtgcgcaccactgacctgcattctcacggcccaaatcctagtacatgttactgaacaaaaatttgccaagatttttcagggacagcgagacgggcaaagagcttgaggaggcggcggtggcagccatgggggtcagagaagggagagagagagagataaggaagggagagaagaggggaaggaaaagagagagaggaggctgatgtggcagtctgacatatggggcccactcagccgctacgtaggacaaaaccggggtcaaaaccaccagagaaccatttgtgactggttttggttagttaagggacgttggatatctggttttgcggttgggggatgattttataactcgatgacaagttgagggaccttcggtgtactttttccaactctgttcgcaccgggaaaaaggtctattctacctcatagtctgatttctctatctcaatcgttaaaccaaacattaagcctatctcaactatcaattcattttaccaatatgacacctacatgaatttttttaaaaaaatactgtagaaatcacgtgtaatttttccaccctcaccttataaattacaattaacgaagaaaaaaaaatcaggacccacgtgtaggtggcccattcgattgagaagtaggagcccgagcttgtccaccccgccactggtgcggatttgaagcatgaggagagaccagctagaggcaaggcgtataataacgtgctatcatcaacagtagtggcagagagtatcaacgatggtggtggtggagagaggattgaaggagcactccggcactagtgcttggaggtggtggcctcgtcgttggatcggtgcaaccatgatccaaggtaataagtatctagatactaccgtaggatcgtaagactatcagattttagaaattacataattttatataagatatataatatgttgtataaattaaaatatataatattgattttgataaatttaattggtttttatgtaaacttgagcatatttattcacattattttcaatcaccttattaaataatatttggtaggatcgtagagatcgtaatatcgggatactatccaagatttcgtaggatcgtgtggaaataaatagtaagatcgagtaactatgaaaattacgatattagatgagatcgatatcgttttgaattcgtagcatactatcctagtatcgtaaaatattatacagtttggggtactgacaaccttgaattgcatgtgccccagcggatccaaccgctgacacactcaatggcaaaaggagggattaggctatcagtgcacttgacgaagatgaaggatggccgatgtgtgagaagataggggagtggggagtggggaggagagagaggatgacatatggactaattgctttattattattattattattattattattattattattattattattattattattattattattattattattattattattattattattattattaactacgtcaatatcgacgcttatgtgtatactgactcatcacgtgtggaccaggtgaatacgccacgtcggttgaaaccgctgagcaaaccatcaaaggagttcactcctcattttatttgttaagccagggtagacagaaaaaaaccgaaccaaaaagaccggaactaggactgaaaaagctgagaaatttgatcagtatcaggtgttaaaggaccgaatttcattcggtcaattcagttagtaccttcgattaactaaataaactgcacaaatcaaattttggctcaataagactattaaggtccagcaacccaattaaatcgaattttggcctctagcatgcttcgatatatggcccgtgatagcgaagagagtcaatttgtgttttgtgggtgtgtgtttatgtgtatggtttttttaatctggaacttagacttgccctgattattttagaacttttgatatttcagtcatgatcgagatcgagactgattttcttgatcttcattattttcctaaattaattggtttctatttttagataaccgaaacttgtagaagatcaaagatcgagaccggattttttggtttgaccaaacgtccaaccctagttcaaggagtcttaatgttacggtgagaaaatgaatcggacttaaactatagttgaggaaaggcaatataaactttttccttacaacatggtggaagtgcaaaacttccggtgatgtgcttgtgagttgtgatgcgatcactcctttcttatctctacttacccaactcacctctttcgttttccacgcgtacgtttttcatactgctaaacggtgtattttttatgaaaaattttttatataaaagttattttttaaaaaaatcatattaatatatttatatttattttagctaatacttaattaatcatacgttttattttacgtgctagggagtgacggttcccaaccctcgttccgaacatagtatcttcgtcgcttcggtgaagcgaaccagggagtcaccgagtcggcgtgataacgaagaagaacggcttccagaacgtctcgtcaacccaatgacaaagaatggaattaaatttaaaaatatactgttgatttgtttttccttagaaatattcgtggcgtaaaatttagaaatattcgtggcataaaatttttagcagaaatataccatcaatctcgcacaaccgttgtgcaaagaagcgtgacgacgcacaccgcgcagtatcgcgagaccgaacgtcttgtccagcggttctacttaattagtgatcaattatcctaattatcgaataataactagtgattaattatcctaattagtgattaattaacaattaatcaatcactaattaacaattttcaaccgtcgtaatcgctcactgattgagagagactgctcggtctcgcggtttggccgcgcgagaccgtgtggtctgacgccgtctgcacgcacgtcctcgatttcgtcgtttggtgtcacggtttcattgtacggggccgacacctgttatagatgctatttgcgtcgtcacgtccacgtcacttatgcgaaacggttgcgcgagatcgacagtatatttctgctaacaaatttacatcccgagtatttatgaaaaaaaaacgaatcaatagtatatttttaaatttaattccaaggaatggcgagttcgtgctgagcacggacgctaacttgcacgggacgtggaggcggatctccggttaaatgcttggccatacgaaaccgcttggtgagcgagtgggtttacatacggttttggtttgaatctgtcgcaggtcgcggcgccagacggccaggggcaggccagcctggtctcgattgtttcctcgcgagcagcgcgcggtggcggcgcctggtgggctcggggaatccctctgcagccagcgcgtccgcgaaatgcatgccacttgtatatggaccagcgctgcacatgcacaagccgcacgtgccgttccgcttggtagtgaaatccaggggcggaccacggtgtttaccataaccagcctgcttatctcacacaacagaacaaaaacgaaccacccatttcaacaaagttggtcaccttgttctccacagttgacagtaaaaattctcgccgtagctcgtttttcccaacatggccacgtcactgccggccagattacttgtcccatgcagctggacaaagtaccgtttgaccccggtcccttttgtgatggcgacatcgtatcgagagggacagccagatctccggtatggaaaattggaaactggaaagcaacggacgtgttcactacgatctgtggacccgatacactggccaaaaatggagacaagccatgagcctcagacaccgtggaggctagccgtgcacccagctgtgagcgtggctaaaacggccgcgagcacccacaggattcgctctcccacaccatcggctcgttcgcacaaaaccactgcaccacccaccggtttcggtttcgcccaccattggaggcgaatcccctcccttcatataccacgccgcggcagctcggcgatcccagaaaggcagaagaaatcaagaaaccaaccaccaactagctactgtagttgactgacagtgatagtggcagtcatgcaggtcgtgggaaccgtgcgtgtcagtggctgcggcgcggtggtggcgccctcgcgccggcagtgccgcgtgtccgcggcggtgctgacggccgcggagacggcgacggcgacgcggcgccgcgtgacgcactcgatgccgccggagaaggcggaggtgttccggtcgctggaagggtgggcgaggtcgtcgctgctgccgctgctcaagcccgtggaggagtgctggcagccgacggacttcctgccggactcgtcgtcggagatgttcgagcaccaggtccacgagctccgcgcgcgcgccgcggggctccccgacgagtacttcgtcgtgctggtcggggacatgattaccgaggaggcgctgccgacgtaccagaccatgatcaacacgctcgacggcgtccgagacgagaccggcgccagcgcctgcccctgggccgttggacgcgcacctggaccgccgaggagaaccgccacggcgacatcctcggcaagtacatgtacctctccggccgcgtcgacatgcgcatggtcgagaagaccgtccagtacctcatcggctccggcatggtacgaatctctcgaaatgttgatgccatttctctgcttggtttcaatcttttttttgcttagcattgttgctgaatccatggcaggatccggggacggagaacaacccgtacctggggttcgtgtacaccagcttccaggagcgcgcgacggccgtgtcgcacgggaacacggcgcgcctcgccagggcgcacggggacgacgtcctggcgcgcacctgcggcaccatcgccgccgacgagaagcggcacgagacggcgtacgggcgcatcgtggagcagctgctgcggctcgacccggacggcgccatgctcgccatcgccgacatgatgcacaagcggatcaccatgcccgcgcacctcatgcacgacggccgcgacatgaacctgttcgaccacttcgccgccgtggcgcagcgcctcaacgtctacaccgcgcgcgactacgccgacatcgtcgagttcctcgtcaagcggtggaagctggagaccctggagactgggctctccggcgagggccggagggcccgggacttcgtgtgcgggctcgcgaagaggatgcggcgggccgcggagcgggctgaggacagggctaagaaggatgagcagaggaaggtcaagttcagctggatctatgatagggaagtgattgtctagtttaacttgtcttggttgaattctgaattcccagtcctagatgatcatgccatttcgttatcatctctgttcttgtgttctctttgcaatgcagtaaattggtaatagttaatggtgctttgatcttggaaatttggcgttgatgtattttctggtatcattagtgaagatagtttggtttcttttcacatttgatgatttgaaccctcaaatattaatgttgaaatacagaatttcacatttcacatttcagttgtgcctgcacactgacattattcgcatataaaattgacatgaccgtttttttattgagggaattgcacagttgccagcatcgtgtccagttgataaacggatgcagcagattataaatttcccttgtacagtcatctatgtacaagaagcatactagttgatagaaaatcccttttcttttcaagccaattgtgaaaccgcttcgccagaacatttgagacaagcaaaattgcagttaatgtagttgggataacgtaccactgcctgcgtgtacttggtgttcagaaatgtcaagctcaaccgaactgcaccctgaagtcgttttggtgcctttgatcttggaaatttggcagaaatgtattttctgatatcgttagtgaagatttttcttttaacatttcaaccacaaaaattgatgttcaaatacataattcaattgtgcctgttgactgatattagcatataaaattgacacgaagtgtgtagttatttctatgccagcaccagttgataaagggatgcaacagaacagataattcccttgtctaataatctaatgtccttgtctaatcatctatgtataagaagtacagttaatagaatatccagcacatgaggggcttttcttttctgggcaacttgtgaaaacactttcggaagaacatttgggacatgcaaaaaatgcagtcagtgtagctgggataacgtaccactgcctgcacatacttggtgttcagtaatctcgagctccactgaactgcaccctggggtcttcccaactccatggagcgccatctttctcctcatgcgttcagcctgctcccacctctccgacgaggccatgatatttgacagcaagatgtactctgcatcgttggttgacacacgacgggagtgcaattggtggatctcacttgatacgagttcagacatctctgcatcgccatgcannnnnnnnnnnnnnnnnnnnnnnnnnnnnnnnnnnnnnnnnnnnnnnnnnnnnnnnnnnnnnnnnnn

SEQ ID NO: 11651 - DNA, 4796 bp, Oryza sativa
  unsure (1)..(4796): unsure at all n locations
acatttgatacaaccaaaatttcagttaatgtagttggaataccgtaccactgcctgcgtgaacttggtgttcaaaaatgtcaagccaaccgaactgcaccctaaagtcgttttggggccttagatcttgaaatttggcagaaatgtattttctgatatcgttagtgaagatttttcttttaacatttcaaccacaaaaattgatgttcaaatacataattcaattgtgcctgttgactgatattagcatataaaattgacacgaagtgtgtagttatttctatgccagcaccagttgataaagggatgcaacagaacagataattcccttgtctaataatctaatgtccttgtctaatcatctatgtataagaagtacagttaatagaatatccagcacatgaggggcttttcttttctgggcaacttgtgaaaacactttcggaagaacatttgggacatgcaaaaaatgcagtcagtgtagctgggataacgtaccactgcctgcacatacttggtgttcagtaatctcgagctccactgaactgcaccctggggtcttcccaactccatggagcgccatctttctcctcatgcgttcagcctgctcccacctctccgacgaggccatgatatttgacagcaagatgtactctgcatcgttggttgacacacgacgggagtgcaattggtggatctcacttgatacgagttcagacatctctgcatcgccatgcaccctgcaagctccgagcagggagccccagatcacctcattgggttcaacaagcatgttcttgacaatctcataagcttccctcaatcttccagaacggcccaagagatcaaccaggcagccgtaatgctctactgcagcagcaaccccgtaaatatcgaatttgctgaagattcttagtccttcatctacaaatcctccgtgtgtgcaagctccgagtacggcaagaagtgtgatctcattaggcttctgctccgaacactccatcttggagaacaaccgaatagcctcaatgctctgtccatggctggaaagtgcagagatcatcgagttccagcattcggtgttcctccattgcatgttgtcgaagatatttcgtgcgaaagcgaggtcaccgcacttggcgaacatgtcaaccaggccattcataacgaactggttcttccggatacggtgctggatgatgaaattgtgaacctttctcgcttgctctagcgaaccgagctgtgcgcaggcagagagaacacctgccatggtgaactcgtccggcttgatcttgtcctttagcatggagtgaaatgcttccagtgccttctcgcagcatcccattttggcataccctgctattagtgcgttccagttcaccaagttgcgcacggggattttgtcgaacaccgcttgcgcttcgtcggcattgccagccttgaagttcccggtgaccatcgacgaccacacaaacgcgttccgcgcaggcatcttgttgaacagctccctcgcggtctccatgtcccccgcggcaacgtaggcctgcacggccacggtccacgtgacgacgttctgcatgcccagcggcatggcctcaaaccaccgccgcgtttccgccatgtcgcccttccccgcgaacccccggatcagcgttgcccacgtgacgggagtccgtgagcccatgccggcgaacagcgcctccgcgctcaccatgtctcccgccgccgcgtacccggcgagcatggcgttgcacgtcacggcgttccggtccagcattccgtcgaacaccctgcgcgcgtcggccaggaggccgcacttgcagtacacggacaccagcgtcgtccccacgaggcggtcgtgggcgttggcggatttcacggcctccgcgtggagggccctgccgaggacgggatccgcgcgggaggcggttgccttgaggaggacgatgacaaggggcaggtggtgagtacgatggggcagtagtttcgagtagatgatagcggcctcccggaggaaggagttggaggcgtagaccttggcgaggttggcccacatgtctgggtcacggcatcctctcgtcaggtagagagcgtggagttgcctcgctcggctagccgccatggcgagcgctcgtccgccctagcagcggcggcggcggcggcggctcgcgggcttatataacgtcggggtgtcaaacaaaaatatttctgctattctggcagtgaaacttacggtttcgtaggaaacaatattactctgttgcaaatggacgatatgacaccgacagagatactaatcccacaaatcacaagcagcaaagtgattccaagacagattatacgctagccattccaagaccagtgcagcaaggacgctgtctaatggatttccatcaagcatcatcaggtttctgcataaggtggtacagttcaacacccaaaatagctacatcggcctcctcacttgtaacttcaacctttaaatatatactgctcctatccaaaagcttccttctatttccatcccttcactaaaaaggcaagggtcccaaaaggcaaagacgcaaacagaaagtaagaaacagagttgtacacctaatctgcatcaatgtccggtactgtaactatttgcagctgcagagcgctgtcagtttcatcatcggaggacgaactgctgaattcggaagtcgacgaaccttccggggcatacatatcatcactgtcttcattctcaacctcgtcagcgtagttcacgactttcctttgcctcttcccacggccgagatcaaccttgggagtagcaggcttgagaactttcagatcctcaacctttggggaagaaggtgcttcatcctcgacgccatgagcaaagctcacaatgctgccaagataaccgttatcatccgacgagcatttctcaccagtggaagggtctaacttgaggagattctcaatggcttcattgtcataatggatggatgttgcactgatcttcctgtccacaattgtctttgctccatggagtaatatagactgcaactcatcagcacttggcttcttggaagagttcatcaacatattttcgatggccaacttctgctttgacttctgcagtatcttttcctcgacagaacactttgtaatgagttggtaaacaaccactggtcttgtctgcccgatccgatgagcccgagattgtgcttgcaagtccataaatggattgaagtcaggatctggaaataggaaggccaaatcagtgcaagtatccacttgcaaattatataattagcagtgaatgaaaacatttaaaaccacttaccgtatataattaccctatctgcaccaggctgcaaattataatgatgtttgtcagtccagaggcataatcatactattgcagttgctggttaagagcttgccctacaggctaacagtttcaactgaaagaactaagttgatatgataatacattaccaggtcaactcccatgccaccagcacgagttgacatcaagaaaataaatgtttcactatcaatgtttttgtactcttctatgctctcctgcctagcagagagtgatgtctgcccatcgatgctgccaagtgttaacacagccatgaaatggccaaaagaagtgtcattcaattactagatatacaaggaaaagagcagcgaaagtctgaagcatataatttagagaattgatagaaggtagacgaatgaagcataccgtgcatatttgtatcccagggaacaaagaaaatcctcaagaatgtcaagcatcctggtcatctgcgagaaaatcagtacacgatttcccctttctttcaatcttgggagcaactgcaatttagcaattgagcagtgttatttctagcagtttaaacttcaggtgcagtgctaagatatgatagcaatataaggtccaatatgaagtctcgaaagaaccttatgaagaagttgaagtttgcctgatgaagcaataagtgataaaaacacatcttcagttgcttgctgtccaacttcaagtcctggaaatagatactgaaaggcaaaatcttagcatcttaggacagcagaaaaatttaacatgcacaacaaacagcacatctacttaaaaagggctctttgttgtgagcttgtgggtgatcggagggagcaaggcctggtctagtggtccttgtatagaaggcaggattgtaagaatggagtttaacaaactgatacattaaagccaattttaagcttctcgtttgctacaaattttctgtaaccactgcacacaaatcactgtcaaaatgagagactcggaaaagcaaaaacacccaattcctacatctaagagaaaagagaccaagttctgcatctgatcaacaaaacagaaagtaaaacctactggatgattgcagcattttctgagttccataagtatgttgttcagagaaagttttctgcctgcaaaagtacaaacaagactaacagtgttatttccatacgtaattaaagggatttgaaaaacctcatattcccatacgtaattcatagggacaaatatgcttttacaaagtgaatctgacttaaaattttaccagagcatgaaaaaagagcagaacgcttaactcaccattccgaatggcactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11652 - DNA, 904 bp, Oryza sativa
ggcccgcccacccaacccaggtgcgccacgctccacgccagcgccagcacgccggagccgatcaccgccgtaacaatgtgcgccgtcgccgtccataccgtccctgcaaaaacaaacccagttaaccggaaccgccgccggcgcaagccaaccaaaacaattctcaattcttaatcccagcccaactcccatggcctgtttagttggagggagttggcgatggggaatgtgagtttatgatatatgggagtttaagtatgtagtttggttgaaagatttgggaatttgagtgggtttgggatagggaattaaaaggtcgaattcccactaatctcttacctaggggaggcatgttaattcgtgagacttgaagagaattcgatatgaaaccacaatagatgaggactaaaaatgtaactctcatgaccaatcccaccatcaactccctctttaaaactcccattcctcttctctcgccaaacaggccgccaaggtgtcccaagaaaacaaatagtcgatcacccatgcggcacgcacgcccgcacgcacgccgtaccagtcaaagaaaaaccccaaaaaccgggggaagaaatcactaaatcaggaacaagaacgaacacgcacctgtccgctcgtgctcgccgctctcgacgtcttccggtgcggcgttcttgttcatgttgtcggcgagccccgcaggtgtcccgtgagggagagtgggcgaggagggatgcggccgagtcctgaaccgtgaacgaatctggacggtattaggccgtatatataagggaggcagctgaaagtgggctttaatcagggctcctgatagggccggcacttggaccagtagagagcgccggttcgggtcttccggactccattgggcagagtccggatgcaatgc

SEQ ID NO: 11653 - DNA, 851 bp, Oryza sativa
tatcaaattttgtcagtaccaaattttggtaagttttggcatgactaattttagtaaggcaaagttgcgtttggattgaagccaaaatagcctaagttcactattgaaatggcctatttttttggcatgccaaaatttggcttcaaaccaaatagacactaatcactattgaaattgtcaaatattggtaggcctaatttaggcctcaaaccaaaccagccctgaatctactgtgtgtagggatatgacgacacgtgaggctgtttggctgcgttggcacgagctagcaaagacacgctgttgcacagttgcacacagcacatatccataaatataatccatatataggcagattacagggtgtacataatgttgatggttttggaaccacgcagcaaactttgatggtttccggccgtgaattacgagccgtgtttgattttccagtgaatcgcaagaaacaatttgttgtttctgaacctgaaattcttttggtggcgtcaagagatggacgatgatctcacgatgatagatgagaggagaagagcagcaatctcatgattcatgcagctttgtagcaatgtgtgcttcgtggcggccgcatgatgaagcagaagatggctttccttttgggtcaagccctgagcccctgagaggctgagatatgtccagcacttcattttctaccacctgaatgatcatcagcatcactgtcttctcttcagggatatttagaaattaccaaaatcagacggataacatgctcactaactcaactgcagaaggtattagttcaaatttttcaatcatgtggttacaaagtactacctccgtcccaaaataattataat

SEQ ID NO: 11654 - DNA, 394 bp, Oryza sativa
cagagcggcggcggcggcatgtcaccctcactcccctcttcttccacctctcaacctttttgtcggtggggagccaacgcggtgactgggcatcgggggggcgccggaacacaaggcaacgacggcgtggaggagggtggtgccgttggcgcggcaagggaggtgctggtgacgatgggggcggtgggagaggaggagagcgtcggcaacgcgggaaagggcgacgaacggcgcggcaagggaggagttgagcgggcgggtggcgggagagcgagagagggcgacgggcggcaagggaggagctgagcggcggcgcgcagcgggagagaagctgggcggctaccgccgccgccgaggagggcgtcgcaacgggcggcagagagatgggcggctg

SEQ ID NO: 11655 - DNA, 788 bp, Oryza sativa
  unsure (1)..(788): unsure at all n locations
nnnnnnnnnnnnnnnnnnnnnnnnnnnnnnnnnnnnnnnnnnnnnnnnnnnnnnnnnnnnnnnnnntttcgtaaagttattgcaaaatttaaaattatatcattttaatatatttgaataatatattgagaaaacatatatattattattatatgagagaaaatataatgatactagccgcgcaagctgcgcaggccaccatactagttttttttaaatagtggacccacatgtaagtccatgtctcatattcttcatcacgtctccctctctctctttcctcttccttctcttcactcttcctcccatcacacttccaacaaacagtagagacagagagcccgagaggggtggaggtggcgatgaaccggagccaggagggcaccggtgactattcccctcttcctttcgtcctctctcctaggattggggtgccatggtcgtcagaagcaggaagggcgtggaaggcggtggtggttccagcagctccctacgagttgattgacttattattttttaatcatttacatgtgggatatatatatatatatatatatatatatatatatatatatatatatatgttttaaatttctttgatgattgggctatcacatgaatgtcacattagtaaaaacgaccatcaacattgtcaaggagtttttttgcacggggttttagtggttgctaaataaaatccgacctatattggggaccttttcaaaattctaatctgcttctatctaaaatgataaggtggttaagttgggcttgaaagtcgaactcaa

SEQ ID NO: 11656 - DNA, 312 bp, Oryza sativa
  unsure (1)..(312): unsure at all n locations
nnnnnnnnnnnnnnnnnnnnnnnnnnnnnnnnnnnnnnnnntggggcccactgactcctccctctttcttcttccccctcttccacgcggcgagggctggagcggcgggactcagattctgtgacattgccatggtatggcacggtgtgacattagagcaatctggggcgttgaaaataaatccaagggtcctctgcgccggcccacctgcaggcctcagtttttcaccccgcattgctccgtttcctgcccgagcgtgctgctcgcgaatcccccagaaccaccaccgccgccgcttggaagggggccggt

SEQ ID NO: 11657 - DNA, 691 bp, Oryza sativa
  unsure (1)..(691): unsure at all n locations
nnnnnnnnnnnnnnnnnnnnnnnnnnnnnnnnnnnnnnnncagaaagaggttggaatatgtagtagtattggaataacctgtacaacggcctttgccttttagtatttcctgttcctgtctaaaaaaaaaatcagcacatttccatttttaacggtatggtcatattctactggcattgcagtgtggtactggtacatcataattcttcgcatatcatttttacagaaacttcagagtacatgactgaaatttgtacagggtagcttgtacatatgtgcaagcttttcagaggctgctaaaacctcagtttattaccagcctactagttactattcactagtcaggcattctaattaaggtcctaattggcagcacggcagcacccagactgttgctactgggtgccttttgatctttctggcagcagtttcttacaaagaaacggggcatctgttcttacttcttatcattcttgttctttgccttcccgtttgctgagatagagtcaatgtcgatgagcattttcacgacttctctcatggttggccgttcaaaaggcagttgaacagtgcaaaggatggcaatgttcaaaacctttgtcatgtcctctgatgcatggctgctaacctttggatcaagaacacctgcaggattcttgttggccaaatgggatgaaacccacgagacaat

SEQ ID NO: 11658 - DNA, 769 bp, Oryza sativa
  unsure (1)..(769): unsure at all n locations
nnnnnnnnnnnnnnnnnnnnnnnnnnnnnnnnnnnnnnnnnnnnnnnnnnnnnnnnnnnnnnccaaataccaaagacttgaggacagatccgtaactgcagggtttttttactcgttttagaacataaccttgttataaactcatggaaactcgtacaggaagctctctgtggactttaggcactagtatttgagaaggcagctaatgccaagctagccggtgagcagggtttaccattccgacgaaatccggtcggatttcgcaaaatttcgacgtttcgacgagtctcgaaagtagaaatcatctaagatttcgagaagtttcatccaaatttaaatttgaattgataaaaaaaagaaaaaatcaaataaaatcttataaatactatgatattcatagaacctattgggatataaattttcgaaaaaaatgatatattatgtgtatttaaacttacatcagagaagaaaagaataaaaaaataaaaaaaggaaaacacttacatgggccggattaccgatcgaaatttcgatgatttcgatcggaatttcgcctaaaccgaccggttttcaagaatttatcggcaaactcagagaatttgtattcaaattttggtttgtgaaatttattcggaatttaccggttttccaccggatttcacgaaattctgaattccgccagtgcccaaaatggaagtgcatgtcggaatcgtaaaccctgccgtgagtgtttaagaaaagttattaagaacccatttccagtttctaa

SEQ ID NO: 11659 - DNA, 910 bp, Oryza sativa
  unsure (1)..(910): unsure at all n locations
tgctgcagctatgatctttggaactaggagccttagcctgctgtatgctcaaattccctgtgtgttcattgcctttgttgctgggttatacaattgcactgttagctttagcatcgataattctagctcggatcattttgtgcactaaagataccctgcttgatgtcatcatgtgggatcttggattaatctgtcaatcatgtccattttgattaatcgaaattccctgtgctgcagtttgaacttcagatgttatttctagctgaagaagaccactcttcagtactactttgactgagtttgtatctttgtttggcagctaactcatgaagaaaatcacacattaatactaccttgactgagtttctatctttgttcgttggataactcatgttgattaccattcggctgtcttggttgttttaagtttattacaacgtggcttctttaattgtttccccagaatttgagccatccaccaatttatttcttcagtcaatgttgttttccctgtcttttggtatctgtttgatgaatgaagccatacttcacatttcagatcttcaagtgaatttcatttggggcttgctattgccttctgttgttttggttacaccacaaatttcagcatacattacttgtaaattagtggttatggaggacctgaaagaaaatcaataatggttgctgtgggcacaaagtttacaatgtcctggagctgtcatattaattcagtactaacccaactgattgctcctcgcttttgactgtcctgtggctgtgatgccacgggtgattggtgactgttccatccaggccatgcctattttagcttgatttacaggtcctggattgcttatnnnnnnnnnnnnnnnnnnnnnnnnnnnnnnnnnnnnnnnnnnnnnnnnnn

SEQ ID NO: 11660 - DNA, 2007 bp, Oryza sativa
  unsure (1)..(2007): unsure at all n locations
atctgtttttttttctcataaaactaccagatgtttcagtcatgactgaagactaaaccgagctaaccaaaaatcaaattccccggtcttaaactgaattatttgcaatgtatttcagtcctcagtttcagctcaccaaaagttagagtttaagagataattaaagaaatgttattgacaagcgtccaaatataagaaatgccatcaacaagcgtgagttctaagaaatgttaccgtacaaacgactttgtctaaaaatgtcatcgtcgttagggttctatccattccacgtcgataaatacattgttcatcctgtagcacttaatggtgcggtatggatggaatcctaacaacaatggtatttttggataaaatcgcttgtacaatggtattttttggaactcaaacttgtcgatattatttcttggatttggacgcctgtcagtgacattttttggattatctcaaagtttaaagcaagtggnggngtgttttggtttccctttttctaacaataacccttttcgagttgtagtctttgaaattttttcccggcatatcgatatgaaacatactatctcgtgctattcggtatttttttaaaaaaagtttaaaagaacaaaccaaatctgccaagcgaatgagcattctaaatggaccttcagctagcagcatcagtgcggtgatgaacactgccattctgatggacctttggcgagcagcatccgtgcggtgaaaactggccctccgtttagttttctccctgcagccttcacgtaaccgactgtagcgaaatattctgtcggcattgcgtttccgctttcgcggtgaactggcccggacccggctgtgtgtgtcatcccggccccggtcgagttccgcgtcctcacggcgtcacgggtgttgggttcctcctctccgcgtacgtactaacccccgtacacgcgcgcgcacggggaaaactgcccgtctcgcttcgttttttccacccgaaatttagttgggaaatcggggatcccgcgactccgcgagcgaccgagccatcaccccatcagcccgcccatcacctcagcacagcagctagcagccgttgcttgtttttccagcttcctcatgcacctcacaccgctgcctttaaagcccacctcccccgcgccgcgcgtccccgtctcatctcatcatcatcatcgcccgcggccaccagccaagccatcgccgcgcgccgtcgtcttcttgagcttggcttctttcttcctctctctctctcccctgaccaagaaggggcgccgtggccatggggggattggcgccgtccgcgccgtggcggtggagctggagcgtcgcccgcgccgtcttcttggcgtcgctgctcgtcctcgcctccgcgcagcagcagccgcgcccgccgcgggccccggagatgtccgccgtcgacgtcgacgcgatcctcgccagggtgtgcggcggcggctcgtccaggcaggcggcgcccgtgccgccgctgcccctgtgccacgagctcatgcgccaccgcggcggggtcaggcgccaccaccgcaggccggcgccgccgccgggacgcgacgaggaggtcgacctgcgctacggcgtcgccaagcggctcgtcccgacggggccgaacccgctgcacaactgaggacgccggcgacggcgaggcgttggtcagttcttgctttcttggacacatcggcatgcagccgggctcatcatccgtcgacgtcgtcctctcttgttcttgctttccgggtgcactttcttggagctcggaaaggacttacaatggaggatcgatgcttactacatcagcatggcacaataacatagatagaattgcatgtataggctagttcttcttcttcctcctcccaattcttggcaacatctagtaccatgtttcttgtagctttcttggcctgcatttctcaatgcagaaaaaaannnnnnnnnnnnnnnnnnnnnnnnnnnnnnnnnnnnnnnnnnnnnnnn

SEQ ID NO: 11661 - DNA, 2302 bp, Oryza sativa
gcgccgtcggcctctcgtcaatgcgcccgcccgcacggtagagcatctccccgttctcccttctcgctccatctcctccccttagactcgggtagtagcacgagtagcctccccgtagttagccggcgccacctggccgttgccgtcgctcgccgtgtgctcgccgccgtcgccgcccgagctcggaagcgccgctcgtcgccggcctcgctcggcgtagttccacccaatccgacgctagcaacggattcccgtggccgcgtagatactctcgccgccgggaaattggccccccgtgacctcgtcgccgttttccccttttcccgccgccggttgccgccgccgcgattcgccgccgtcaagctccctccggcgaatccgagccgttggctcgtctccccttgtcctgtgcaaccacccggtgtgctcgctttcgcctgtatcgccgtggttcgctccgccgctcgccgcggtcgtccgctgtccgttctggccggcgtcgtcgtctacctcccgccggcccgcgtggcagccacgtaggcgccacgtcggcgccagctcagccaagaccgggtcgagccgaccccggtcagcccctccccgtgcgcgcgttccaccgcgagccgtgaggctgcgagtgggaccgccgcatccgcatccaccgcgaaccgcgcgcgtgcaccacgtccctctcccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggcaagcccgttaagctcggccgagccgccctttctctcgggtcgcgccctagccgcccggggaagtctattttccctccctccttccttttcttttcttttctttttcgaaaaggatttaattaaatccttttcctttagaccaaaaatccaataatcttagaaattcaatatcttcccaaccgtaagtccgtttgactccgttcaacttccaaaattcctcaaatctcgagatctatctaatggcatgcttagaggtcattaatagggctttattttcgctgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgaattgataggatcgcacttaatctgttgtcccgtctgcaaggcagattggtagacctacctaatttgttggatttgatccttcctttgttaattgtgataccatgtccccttgcaaccatctagttgcgtctcgatattcgtgcacccagtgcgagtatcgacggacgccttcaaacttaaaatctgaaaaaacaacttgggtaaaacttgagttttacaaaagacttggaaaacccgacacctgggtcggtgcttgcgaactaaataaatttccaaaaccgcggaccggggaacgtaccgggtgtatggtttcccgctcttgcacttaaggaccgtttccttggaatttcatccaaacataagacaagtacgaccacatgggtagaatgggacacccctggctgagtaactagcttatcaggggagccttgatgtcgagagacatgtggattcgccggggtggtgtcggggaggacccctgggcttcctggcacaatatggtctgggacctaacctgttgttggtctgggacccctctcgtcggcatatggtaaacctgtgtcagctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttaactactgcttgtgaaattgctgttgtggaaaggggttcgatgtttgaaaaatctgtagctgatggaatcagctaggcccgggtggccgtttgaaagttgttggcccgggtggccgtttgaaaagctgttggccgggtgccaacctcgtttcaaaatctaaagactgatacattgcacatactccgaccggacgagacgcactgtctcatccgtgtcgtttgagaagcactcatttagttgtttcag

SEQ ID NO: 11662 - DNA, 1875 bp, Oryza sativa
  unsure (1)..(1875): unsure at all n locations
nnnnnnnnnnnnnnnnnnnnnnnnnnnnnnnnnnnnnnnnnnnnnnnnnnnnnnnnnctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaagggttaagttccaaatcttgtcggggtgaaagtgcatcgccattgcttcaatttgatggaccgatgaagttttcagttttcaaagtcagggctctttgtaaatcagagaagtgttggctatatttgaaggacaacagttcaactgatcccagccacgcggaagtaagactactccctgtaagggggtaggtctcggagaagagttttgcctcacttcgtcgctgttttagttgaaggttcaaccagtgccgcaatcagggtagcacttgaagaagcaagttgcaaggtatcagaagaattaagccgatccccgggcaaccgattgaattctaaggtacacccatgaggccagttcaaccgcttagcttagacaggtcaagcaggtttcctggatttacttgtcatttgagttgggaccagtccaagcggacatagggtaaatgatttacaaatgccagattcaattttcatcctcttatagccagcgtggtgaattctcaggttaccaaaattgccaacctcaacagttcagtccaagataagtaagtttcaggagtatccgcagttctggcctaggtcagttcaagcagaaccagtcggtccagttttggcaaagcaaaggaacagaaaggtcgaatccagccagtgcaatcgtgcaggtttgatcaaccagtcaatcaatcagttcgaagcagaatgtggcagttcaatgtgcagatcagtcagaccgcccaccagcaccggctttctttctagccatcccagaatctcgggacgagattcctgtaaggggggtagatttgtaacgccccgattttcgttcgggtttaaaaatcaattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgagaaatagttttaatagcacaaaggtcattgcatcaatttaaataaaaagaaaacaaaataaacttccccttcctccctttcgggctcggcccaaaatcctctctccttcccctcccgcggcccggcttgcctcccctttttggcgcaagtctgcttttcctccctcccggcctcccctctcactcaggccgacaggtgggacccgtggaccccacctgtcatccccaacctccggccagctccaaccgccgcccacgccgcccactccctccgccgatcccgcacctcccctcgtcccaaccggcgtggacccgagaccccttccacctcgcgaccacatcccgccccactccccctctctccccgcgggaatcaacgccacgccgagccgccacacccccacgacgccgccccacttcccctcgaaatccgccgctccccggccctctcctcgcccccttgagctatcaaatcaatccccgtggactcctcttccgggtaccgagctcgaattcgcc

SEQ ID NO: 11663 - DNA, 4173 bp, Oryza sativa
ccctctcctcgcccccttgagctatcaaatcaatccccgtggactcctcttcctttttccccgttttcccgagtcccccacgccctctaccgagctctccacgccgatccccttcgccgccgctcgccggcgatctccagccgcccgccaccgccgctcccgtcgctgccgcgctgcgccgccaccacctatagcatcacaccaccccaccgcaccccggcatccactccatctccctcctccaccgccggaaccaccttcccatcgcgaggccgagccactaccgccacacaccgccttcagccggccgctgccgctgcgttagtcgtcgccgcacctcgccgcttgcgccgtcggcaacgccgtgccaagctctaccccggcctccgctccgtttccccattccaccaccgcaaccacccttccaccgtgcatcccgagccacctccaccatacgccgcctccagccgtgtgccaccgtcgccttagccgccgccgcgtcgctccgtcttcacctctcgcctcgcagcgccgtgcagcacctcggtcaccgttgttcatcgccggaaacccaccggaacgtggtacctctcggtcgccggtgagccccaccattcctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccgccatcctttccgccgccggtcgcctccccatggtcgtcccgtcgccggcgctcctcggtgaggacccccttcatctcctttccctttcccctcttttcgtcgcctcccgtgcgtgccgtcgcgccggtggtcgtcgccggcgaccatcgggccgtgcgccgtcgctcccggccggccgaccggtgagctggctcccgctcgcccgtggccgcccgatcctccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcatgcgtggactcggtccacggtgcgcccgccacccgtgagtcaccgtcaggtggggcccgcttgccggcgccacctctcccccgtcggatgacgtcataattgatttaaattgcgcaataaatcggtaataattctagaaattcattaaaatggctcaaaaccttctaaaattcatatctaattcattcgaactccgaattgagccattcaacttgcaaaattcatctaaaattgagctctacatgtttgtttactttttatgtactgttttcttggtgtttattagagtttttcctcgttttgcgtgccagcgtgtagtttccgtcgtttcggaagtccgcggtcgcgaggaaaagagttcagaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgcgccatgtttacttgatatctgttctttgtcaaccttgggtaataaattgactagcttgtgttacttatgtgacctagctagaactatatgcttagccatgcttaattaccactagctcagtcgatgggataattgcagtattagacattctagtatcttgttgagctgcgtgctcgagacatctggccatgttttatggtcgtaattatccaactaaaatgcgactgaatggtgggctgtggatgcatggttttgcgagtcgcacccatagcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtacaggtgggttggttgggcctgttcaacgtggtgtagcgttgatcagtggagatttaatattactttaattactcaacagttttactgttttgctcaataaaatgttttacaaccgcctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaaagtggtatcagagccaacttgactgtaggttgagccaaatggtcaaaccgtaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttcccgaagttgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaacaataaaagtctactcacaacataacagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaagggttaagttccaaatcttgtcggggtgaaagtgcatcgccattgcttcaatttgatggaccgatgaagttttcagttttcaaagtcagggctctttgtaaatcagagaagtgttggctatatttgaaggacaacagttcaactgatcccagccacgcggaagtaagactactccctgtaagggggtaggtctcggagaagagttttgcctcacttcgtcgctgttttagttgaaggttcaaccagtgccgcaatcagggtagcacttgaagaagcaagttgcaaggtatcagaagaattaagccgatccccgggcaaccgattgaattctaaggtacacccatgaggccagttcaaccgcttagcttagacaggtcaagcagggttcctggatttacttgtcatttgagttgggaccagtccaagcggacatagggtaaat

SEQ ID NO: 11664 - DNA, 2526 bp, Oryza sativa
  unsure (1)..(2526): unsure at all n locations
cgcctttatgcaaatagccacaaccgtccttgtgttcccccttgcacgtctgcatcgttggtgtggcttgctgagtacggtggttgtactcagccttgctattattcccccttttcagaagtgtagtgcttctgagctgaagatggagttaaaggaccaaggctcagaccccagttaagttttgcctgtggagtggagctaaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatctgggttgtcgcttctttgcacttcaggcgggagcactatcgttgcacttggattataattcaaatccaagacatctctaattgcttccttctcatcttccactatcatattgtgaaggataacacaagcttgcattatgttgataacgtccccctgcttccataaccttgctggtcgacgaataatatcaaagcgtgattgcagcacaccaaatgcgcactcgacatctttcctcgccccttcttgctttaatgcaaataatttgtcttccgccaactgaggggccgtcactgtcttcacgaatactgcccattctggatatattctatcggcaagatagtaacccatgtcatattgtgttccgtttacgttgtagtgtaccctggagcttccccttttattgcttgaataaatagtggcgacttgtttagaacgtttatgtcattctgagacccggcagtaccaaaaaaagcatgccatatacgaagatctttagttgccactgcttcaagaatcatagtaggaacgcctttgttaccactagtgaacatgcctgcccaacctttcggacaattcttccatggccaatgcatacaatcgatgcttccgtacattccaggaaaaccacgagcctcattttcttgtaagattttttccaattcatcggctcttggcaggcgtagatattcgtcaccaaacttttcaatcaccccttcagcaaattttcccaaacattccaaacaagtgcttgcagcaatcctcaagacttcatcaagttgatcagccgcggttccataacctaacatcctgatagctgctatacacttttgaagcggtgaaagactattcctaccagttgcatcaactcgttgggtgaaataaggagaccactcactaagttcatgtacgatacgcagaaacaacggccgtctcatcctaaatctcctacgaaacatttcatcggtgtagataggatttgcggaaaagtaattagcgacaagatcatcatgacctcgttctcgatttcttggtatgtacctccttggtccactctgtcgacgacggcgagatacggacgaagcttctccatcacctgcagccttgaattcttctgctagcaactcttcgatgatctcatcctctgccagcaactcttctacggtgaacacttcaaaattgtcggcttctaggaagtcatcatcttcatgcggctccatttacagaatgaaaaggagtagagggtacggtagtggaaaggagcacatatacataatgaaaaggagtagatggttccattttatagtataaaattgaggcttgaattcacgttcacattcacagaaacgggcatgcacataactgaagcattcacataataaaggagcacatatacataatgcctgtaactgaagcatgcacattcacattccagaaagaaactgaagggtacattcacattcacataagcaaattagtcctctcggcactccaacagaaactgaaactgaagcatgcacattcacattgcaacaactgaacctgaagcatgcacattcacattccaacagaaactgaagtgcacattcgcatttacaaatcacattcacattaattcagaaactgaaactgaatgagacctctcggcattccaactgacctcacaggatgtatatatctaccaggatgtatacctcccagccatgaccacaatcaaatcaatatttagctcccagtatatacctccaatgatcaagctctgaatttatttcctaaatttcccctttctgatcatttgcagattctcatcaaagtatatgtatagagacatacactgaacctgctgaaagattatatatactcatctttttccctagattatatatgtatagagacatatatgtatagagagagtacaaaaagaaaaggaatgcaataaaaggctaatatgctcatctttttccctagattatatatactccatatcagtagtatagtgtatcactgaacaagctagttcatttcagttacagggttctagctaactaaatctctgcatttgagtttgnnnnnnnnnnnnnnnnnnnnnnnnnnnnnnnnnnnnnnnnnnnnnnnnnnnnnnn

SEQ ID NO: 11665 - DNA, 4133 bp, Oryza sativa
tccagaaagaaactgaagggtacattcacattcacataacaaaattagtcctctcggcactccacagaaactgaacttgaagcatgcacattcacattgcaacacctgaccctaaagcatgcacattcacattccaccagaaactgaagtgcacattcgcatttacaaatcacattcacattaattcagaaactgaaactgaatgagacctctcggcattccaactgacctcacaggatgtatatatcttccaggatgtatacctcccagccatgaccacaatcaaatcaatatttagctcccagtatatacctccaatgatcaagctctgaatttatttcctaaatttcccctttctgatcatttgcagattctcatcaaagtatatgtatagagacatacactgaacctgctgaaagattatatatactcatctttttccctagattatatatgtatagagacatatatgtatagagagagtacaaaaagaaaaggaatgcaataaaaggctaatatgctcatctttttccctagattatatatactccatatcagtagtatagtgtatcactgaacaagctagttcatttcagttacagggttctagctaactaaatctctgcatttgagtttggctcgcttttgcgaattatctcatggcagctagttcatttcagttacagggttctagctaactactgtaaccatataacaaaggaagggattactgacattaataatcaggtagtataaacagagtaacatctagagatagcttcatccaatccacaatcaattcataatataaacaaccatcagatttttatttctctcaaaagttgaatataacctcaatatcattaggataaaatgctgcatgatgcaaaaaaatttagagtcaagtaattaaattgtagaatgccttttccaaacgagctggggctgccgccgccgcatccgaggcctcaggtgtgcctcccttcttcttcctacctgcagccgccgtggacatctcagcagcacccaaatcaagcgaggggagttggagattgggggagtgggagattgggagagattgctgcgctatatgctggagcaaatttcccggattgggggagtgggaggggagttggacgaacctggatttcgcggggaaatttcccgcgcgcgcgctctccgcgcgggatcctgccgcgccgtcgcctcgggacgacgagctcgtacaacggtgctgagcttgcctcttccgcctcggagcacgggtcgtcgccatcgcctcgcgagaggacgcagctcccgtcgcttgactcaaccggggggttttttgcataaaagacatcacagagacggggcaaaaagacccgctgtacgtgcccttagcctggccgaccgggttgtagtacaagtatagagcagagacaactgtattttgatttttgcatgtgcagctgctcaccaggagggattataaaaacgaaactgggtttcacacacacaaaacgtttaacgtgcacgttggttttatggttttgtgtaccacttggcaggattgattcttggaacttgcagtgtggatatcatcaccgtagtctactactggatgcttatggtggtgtttggatccaaggactaaattttagtccatgtcatattagatgtttgacactaattagaagtattaaacgtagactaataataaaactaattgcataaatgagagctaattcgtgagacaaaatttttaagcctagttaatccataattagcacatgtttactgtagcatcacataggccaatcatagattaattaggctcaatagatttgtcttgcgaattagtctagggatatggaatgggttttgtcattagtctacgtttaatacttctaattagtgttcaaacatccgatgtgacagggactaaacattagtccctggatccaaacagggtctatatatcttctccgacgatcatgggcggatccagaagaagatttaagaggggacttatctccttcttccttcttcaatctcccctactctcattttctctttattattgccctttcgtctccccttctatcaatggtgatctagcggggtagggggactcgagtcctcccagcacccacgctggatccgccccaatcgacggtaggagcgagtattaaaaagtggataggtctaagtgtttagatggagaagaaagaaagaaaggaaatgcgttgtatgcacaagagatgagccatgtattcatgatgtagtacatatttatatgttactattatatgagtaaactatttgattagctaaaatattaatttttaaagttagtaattgctgtactattaaacttgttctaatgctagagttgatctgatgactcgaaaaatggagtttaaggctgcgttcgagcgcaggagaaagagagaaagatagttttgttttccgcgcgcacgcttcccgaactactaaacggtgtgttttttgcaaaaaaaattataggaaagttgatttaaaaaatcatattaatctatttttaaagtttaaaataattaatactcaattaatcatgtgctaatggctcacctcattttacgtattttcccaatctcctcaatcccctccttctcaaacacaccctaaggcgtcaggtgtatgatgcaacagcaaaccgatcaacagagccatggttcaatgcagctagctagtttagtgtaatcgcacaatttcttcacccatctactaatatgcaaattgattaagactcaccacacacggtaacagctataagtctacaaccgatgtaccgaccggcaccatttgcatgcgagtgcgcgattaattcaccaaattatcaacccatgatcatcaagttgccccatctttcttgggacaaggaaaaaacacgaaagtgtccgtcacagtctcgttttctccccaacttttgaacttcctttcgaagctagccggattgtgtacgtgatcttggtgttgtttcgatttttttacttgattaatggtgttgtttccatgcacgatcctacccaaccctttattatttcatttcatcggcaaatgtaatgcccagtgacggaatttgttctgaccatgggactcaagaactgttcggctaaaaacgtcactcatttttatccaaatcaaatggaggcacagagaccggcaaaagtttgtggaagtaaatgcaccggggtgttacgagagtcgtgggtgtatgaccttattagggtttaaattccaataccaattctatagaaatttagcgaggctatgaattatcattggtctccatttatttaaatgcatgctagaaaatattttgtaggcgtgtaagattgcgttcagaagtgaggtgagaaactttacctccccgtatgtaaaacggagcgatttactaacgcataattaattagctaaaataaacttgaaaatagattaatatgatttttttaaagcatatttttttagaattttttgaaaacgctgtttagcagtttgaaaaatataaatgcagaaaacaaggacatttagcattttgagaagagcgcgcgtggaaaataagattagatggtaaaagaataccaaaatatggtttattaactactattagtacgtgtgtggtgatatgtgatacatgtgtgggtgggtgcacagagatggacaaaataaaacgagaccgaaaaccgatttaaaaaaccggaacactaatcttatgtttctagttcggtcatcttttgataaagaccgaacatttttttaggtgtcttcagtcgtctgtctcaaaggaccaaatacccgaagtgcccaaagatagggcttgcttagttcgctggccaatttttttaagtatataggcacatttaaagtattaaatgtagactaataccaaaacaaattacagatttcgtctgtaaactgcgagatgaatctattaagcctaattaatccgttattagcaaatgtttactgtagcatcacattgtcaaatcataacacaattaagctcaaagattcgtctcgcaatttacatgcaaactgtacaattgatttatttttcgtgcatatttaatattccatgcatgtgtccaaacattttatttaatattttt

SEQ ID NO: 11666 - DNA, 2509 bp, Oryza sativa
  unsure (1)..(2509): unsure at all n locations
nnnnnnnnnnnnnnnnnnnnnnnnnnnnnnnnnnnnnnnnnnnnnnnnnnnnnnnnnnnnnnnnnnntaaagtattaaatgtagactaataccaaaacaaattacagatttcgtctgtaaactgcgagatgaatctattaagcctaattaatccgttattagcaaatgtttactgtagcatcacattgtcaaatcataacacaattaagctcaaagattcgtctcgcaatttacatgcaaactgtacaattgatttatttttcgtccatatttaatattccatgcatgtgtccaaacattttatttgatatttttggccaaaattttttaggatctagatactcccataatctaagtatgtgttttgttttgggatgaggtaagatgggttggactcatccttagtttcggatgcgattatctcgtctgtctatttagcacgagggatgtgatggtcttactttaaagaggatgacccatatgtcaaagaaaagtgggttggattgatccgctagtttttgaggaaccagtccaatccaaatctcaggagaatatccatttcagggatcatcccctctcacctattcccaaaccaaacaccttaaaaagtgagttcgatccaatccaacccactccgtcccttaaaccaaacacatactaatctaaccatcccaagtgcactttaactctcttaaatatatattgagccgatccataccccacaaccgaaaataatactaactcctacaaccattaaaaatgtgtaaaatctctgtggcccaagtggcctagtccaagcacctctcccactttcccacgtataggagccaactcatgaaaagaaaaacaaccaaaatttaaattttcaaatttaattttgaagttgatttcaaaatattattaatatatttttaaatttacttctaagttgttaaagaacacacgtttaaatgttttacctaaaatttattttttattttctaatgaaacattttagctcattagaaaacttgggcaacagactaggtggtgttattttctcctaatatgtagatgaagttttttttacgtaaaaacggggtggtattaacgtataattgattgagttttaattattataaatttgaaaaatagattagtatgatattttagagcaactttcatataaaaagttttcgtacgaaacgtatcgtttagcagtttgaaaaacgtgacataaaaatcttaatctttatccaactcttattagagaaaataagattacgttattacctaagggtgtgtttagttcacgttaaaactagaagtttggttgaaattggaatgatgtgatggaaaaattggtagttcgtgcgtgtagaaaaattttgatatgatggaaaagttagaagtttaaagaagtttggaactaaactcctgcaatgttccaagtttcaactcgtttcacacgagccagtgtcaccgacaagcaggacccacgtggcagattttggcgccgccgcgtcgcctctactccctccagcggtcagcctccttcccaaacaagctaccgcccagattgaacttgaacgaaaactctggagggaaaactcccgccaagataaaatcttcccccaaatccctcctccttctcctcgcaatcattcctcccaaatctgaaatcttgcaaggactccacgcccgagagggagaaatcgagggatcggcaatggcggacacggggagcctgaagaagatggggcgagagctcaagtgccccatctggtgaatgtttgattccccgctcgatcgattcgatttccttttttgcgcttcgtctttggattcgcgttctaggacgatttttggttcttgggttcatctctcttttttctcggccatcttgttttctcctgatgttttgttggttgattctctccgtggtcctgaaactatttctcacgggcgattttcttttcgttcgtgtggcttgcgatttgttgtgctttgtattgattagaaatcttgttcttggcagcctgagccttctcagttcggcggtatccatctcctgcaaccacgtcttctgcaagtaagtcttcatctctcactattccgcctcgtcgtaatgcagttaaaattcacagcgtcctggatggtcttctccatttcgggcttatatgctgaaattttccccattctgcagtgattgcctcacggaatcgatgaaatccacgtcgagctgccccgtgtgcaaggtcccgttccgacgacgaggttagtgttgtgctcttgctgaattgtgtctacttaatcacgtgataggcatgaaaaacacacgaattaaactaactgcctaggtttagtgtcactcatggatcggacattgaactattagagtttcttatgtactccaaattcgtagtaatagaatatgtcacgtccggtcctagattcgttttttatgggactgaaggagtagtgcttatcggactgccggtgataaatttgcttttcgctgagcatgggc

SEQ ID NO: 11667 - DNA, 1913 bp, Oryza sativa
aattgtgtctacttaatcacgtgataggcatgaaaaacacacgaattaaactaactgcctaggtttagtgtcactcatggatcggacattgaactattagagtttcttatgtactccaaattcgtagtaatagaatatgtcacgtccggtcctagattcgttttttatgggactgaaggagtagtgcttatcggactgccggtgataaatttgcttttcgctgagcatgggcagcacacctcattcagcaatatttcaaaatttgatatgaagtactgtatttgatgaacttgacctttagtggaaacttggatatgataccttaatggcttcagcttgatatctacaaggtccaaaactgacactcaagggcttggtttgcttgcagaaatgcgaccagcacctcacatggacaatctggtcagcattttcaaaagcatggaggctgcagcaggtaccaatgttgtctcaacacaggaggctcctgtggtaaaacttgcaggtaattgtgttgtagcatgttcttattctattttctagcatatgtgcaaagtagcaacctcattgattgatttagtaagtgatttttttgtaactccttttttgtactacactgttcaattcagttacaatgtttgttttgcatctcttctgtgctacattgtcaacataagttaacagtgattgttctgtgcttctttgtctgtaccccattattgaattcatttcaacataatgcttgctggataattggctctctatgaaaaaaaatctatgcttagagaagatggatagttgtcaatctttagctcactatcttgttcatgtttgaagatggatcagattgtgtcaacagcgggaaaaattccaaaaggtcacaaaaatcattgacacgaaaaaggaaggtaacatccgagatggaaaaaaatacagcaaaggatgctacagcttctgcatcccaacctactacaaagccttccttctctactaacaaaagaatacaagtgaaaccattccctgaatctgagacaccaataagagctgagaagattatgaagcctgaagagccaaaaaataatctgaataatgatgttgaaggaaagaataaagcagtggcatcgggtcaacctggaagtccttcattgtcaccctttttttggctaagggaacaagaagaacaagaaggctgtaccgctgagacgttaagtgaaacgcaatctttagacacacccttgcgtcataatgcaccctcttttagcgatattaaagattctgatgacgaaatccctttaaatacaactccaaatgtaagttcttctgaccacctctaccgttctttttgaatttttcttttggcttctcattttgctacatgagtttcagagcaaagctgcggctacagaactctttgacagtgaaatatttgaatggacccagagaccatgctctcctgaattgtattccactccattgaaaaagcaggtattttgctaagtgcctaagtggatcaagaggcactatacttttctcacttttttcctcttttatgacctgttgattttcatttattttgcatttaatatttgatgactcagctattttgtctgttcagagtaaagctaagagtaaactagatcaaattgaagagaagggtgatgaagaagatgtgcatattggtggttcatttgataagctgggtaatgcaagtaatgcagctcagcttgtcaatacaaaagcaacaaagcagaagagaaagaaaacaagtcccagtaacaaaaacagtgcaaaattgtccaatcgtgctgagccctgcataaaaaagtctgatgccaatcaacaaggttcaaatagacgtaaaagtgctgccctaaaatcttgtcagaaaagcagcagtgctgtagggaggaatactt

SEQ ID NO: 11668 - DNA, 1879 bp, Oryza sativa
ggagaacaggaaggtaagaataaacttgagaacacgacaatgacacctattattttacatgggaaatgcaaaataaagaggcagtatgtacagctccttcagtaaggactgcatctgttaagtacaagcaagcaaaatttagcgaacaaccagattgttttggaacggagaactttggaaaccttcaagcatgccctgcacgtaatgttttactgaagaagtgtgaggtatctactttgaaggtttcctgtgctttctgccagaccgatgtcatcacagaggtatcttctgacttctgccgtgtttatatgcaaatgtccttttctccaaatctaacatattccctgctaatgaacatactcctagaagataaccaaatctccctccttttctcttttaggagtctggagagatggttcattatcaaaatgggaaacaagtccctgcagagttcaatggaggagccaatgtggtgcactctcacaagaactgccttgagtggtttgttatcctttctagtgcaagataatatcagaaaaaaaaaagatttcagtatgcaatattaatctgaatattttttattattttcttgaagggctcctgatgtctacttcgaagatgattctgcctttaatcttacaactgaattggcgagaagcagacggatcaaatgtgcttgctgtggaattaaaggagctgcacttggatgctttgagatgagttgtcggagaagtttccacttcacctgtgctaaactaatcccagaatgcagatgggataatgtaagtccatatggtgttctttatatatattttgaggcagtggtttcaactataccagaatcatttctgaacgtttgacagccataaatctgtaccttattgttttgtttcaattttttcattggcaggaaaattttgtgatgttatgccctctacatcggtctacaaagttacccaatgaaaattctgaacagcaaaagcaacctaaaaggaaaacaacactcaaagggtatcttttgaacctgttgtttgaaacatgtttcttaatggttgaacattgacatgtacgagcacttactgtagaataaccggcttttccaggtcatctcaaataggatccaatcaagattgtggtaataactggaaatggccatctggatcaccacagaagtgggttctctgctgctcatcactttctagttctgagaaggtgctttcgaaaattagtcttattttcctgaccctgatcgaattaatggcatttccttcatatgcattacaactgaaacaaaatgaataaattactcaggaacttgtatcagaatttgcaaagttagctggcgtgcctatttcggcaacttggagtccaaatgttacccatgttattgcatcaactgatctctctggtgcttgcaaacggacgctgaagtttctcatggcaatcttgaatggcagatggattgtctccatagattgtaaggccatgtgctactaatataactgtgctgaacagcctatattcatattgatctggtgccccttgttgctaactgacaactttgtgtcataggggttaaaacttgcatggagtgcatggaaccaattgatgagcacaaatttgaagtcgctactgatgttcatgggatcactgatggtcctaggttaggaagatgcagggttattgacagggtaaacatttcttgccattgttatgtacctcattttcttgcaaggatcactaaaaaaatcttttgatagaacaaaattggtgttaacctgaaaacagtgccaaatctacttgtccgttggaacaattttagcttgatataaaagaggacaagcagaaagtaccaccaacatgatatgttgctatgaat

SEQ ID NO: 11669 - DNA, 3524 bp, Oryza sativa
  unsure (1)..(3524): unsure at all n locations
nnnnnnnnnnnnnnnnnnnnnnnnnnnnnnnnnnnnnnnnnnnnnnnnnnnnnnntgttgccctgacaactttgtgtcataggggttaaaacttgcatggagtgcatggaaccaattgatgagcacaaatttgaagtcgctactgatgttcatgggatcactgatggtcctaggttaggaagatgcagggttattgacagggtaaacatttcttgccattgttatgtacctcattttcttgcaaggatcactaaaaaaatcttttgatagaacaaaattggtgttaacctgaaaacagtgccaaatctacttgtccgttggaacaattttagcttgatataaaagaggacaagcagaaagtaccaccaacatgatatgttgctatgaattaaaagaaacaggccgtaatacttcatgcagccctgcacttatgcatgccatagaataaattcatagacctggtgttgacaattccacacatttggaattttggatgtgttctaacttctaagcaatctcacgtgggtattttttacgcctaacaatcacattgttttttgttcttttttacccttgcagcaacctaagctgttcgacagcatgaggttctacctccatggggactacacaaaatcctacagaggctacctgcaagatctcgtggttgcagcaggtggaatagttcttcagaggaagcccgtatcaagagaccagcaaaagcttcttgatgacagctctgacctcctcatcgtttacagcttcgagaatcaagatagggcaaaatccaaggccgaaaccaaggctgctgatcgcaggcaggctgatgctcaggctcttgcttgcgcttctggaggcagagttgtgagcagtgcatgggtgattgactcaattgcagcctgcaatctgcaacctctttgaatctagaagactgcctggtgccaaaatgcgagttcgatagagtaagaaacaagatagaaatctaagatgcacagggctttgtaatgagacttaaattatttgaaaataagtttactatgcgttgcaaaagaaactagactgcatttctatggaagttgactggatagtcatgcgccagatggttttcctggcctccttttgtaatccgttagtgcacaacacaaacatacaagaatgatggcatcaggcaccaaaaacgtttagcagcaataacaaagattaacaagataattcttagtagcttattgaaaacagaacttgagtaggcttggcgagctggatcaagtgacattggccctatttgggagagttaaagattctgagaatttgatgagaagctaggttgttcttataatataggtgacaatttgtattgtttggagagttgtagattctacaggaagttgtagttaccggaagctccccaaacagacccattatcagtctttaggctgtgttctaatgtccaagttcccaacttcagattttcaatagaaaaagttgttgtaaaaaaatcatattaatctattttaaagttttttttataatacttaattatatgttaataatcaaccccgttttccatgcacggggaaaagtcggaacatagccttataagttaaactctttagacccaaacacttggcccatccacctttacaatctttcacaactaactcggcccacttaggactcacgtgccaaaaacatggcgtcgccaaacaaaaactatgccaaagttatttgtaccaaagcgtgtaaatttcaacttgttgttctgatagtaactactctcaacttgtcaattactccctccatcctaaaatataataacttctccaccaacattctcttctcaaccaatcacagccctccaccattcaattttcccacctgcctccacttctcctccaagcacaacattcctctatttaatcctaccaactttattaataaccgtgtccaactctaaaaatacttatattttaggacggatggagtacttatactgtgactgcaatttactctttattttactattagttgccacactattcacattacacagttagttcaatggtgatctaacatacccattatcggtctttaggccatgttctaatgtccaagttccccacttcagatttttaatagaaaagtttttgtgggggctccagccccccaacatccacattgtatccgcccaatggacaaatgggatggacaaataaggagaactgctatattgcatagtccccatctttcagtagctacggagcaacatgtatctgttatcccattgttttgcatctgcatcgtaagaatttttcgctatccttgtcggccccttgttcaccataacctactacgaattagacaatggttttctccgttaagcatggattgtcgtaaatagagccaaccttgtatgatatgaacgatgtcggatccaccacgacgggccgatgtgccaccgctaccatcagcgcgagctcactgctgttgtcgctctgcttgtaacttgtgatcgatgtggtgtggtgggcgagcttggaggcatcacagttgcattccttgcctatggatagtctaactgcatggtgatcccgtcattctcggcaatccactccaatgccctcctagatgtgtggttcaaggcgatgtcggcgtagtccaccagttgctgctcagatagagggacgaggtgctctgtcttgatgtagtgggcgctctccacagttgccatggccacgaaggcccaacacgaatccatattgtccaacttatacataggcctggtttagttaccaactttttcttcaaatttctaatttttccatcacatcaaaactttcatacacacgcaaacttccaacttttccgtcaaatcattccaatttcaatcaaacttccaattttggcgtgaactaaacacacccataatccacttacataaaatttattgtttatttcataatcaccaataagactcatggtgtaagcacatgcaaggtttgccatttcgttttacatatttatattggggctaaaattttgaaatcttagaaatttcaggacacaaaatttgaaatttagatagattttgattgagtttgaataaattttgaccatattcaaatttttatagaaaatttcaagcgaaatagtttcatgccaggggtccgaaaatttggaaattttgaactaaaatttcaaacgctaactacaaaagcatatagttactagtgatatgatactccacatcacatgtcagagtaaaatattaagggtcacaagttaaacaaaagatagttcataaatgcctatggttaatggttaatagtacctcctgtcacaaaataagtaatgttttagacaactacacggtcaccaatgcacttgttttattataatattttaaaattttatttaatataaatctaaccatattatttttgaaagttggatcagaatatttaaagaaaaattgatcatcaaagttgtattccaaaaatttgtgaatgatggagtacaacattggagta

SEQ ID NO: 11670 - DNA, 1446 bp, Oryza sativa
  unsure (1)..(1446): unsure at all n locations
agttactagtgatatgatactccacatcacatgtcagagtaaaatattaagggtcacaagttaaacaaaagatagttcataaatgcctatggttaatggttaatagtacctcctgtcacaaaataagtaatgttttagacaactacacggtcaccaatgcacttgttttattataatattttaaaattttatttaatataaatctaaccatattatttttgaaagttggatcagaatatttaaagaaaaattgatcatcaaagttgtattccaaaaatttgtgaatgatggagtacaacattggagtagtacactccaatatggtgatcgtggcaacgtggtacctcaacttgtttcaatatggtgaccatggcagcgtaacacctcaacttgttgagttccatggtgatgctctccaattctcactcgagagaacggggagggggcatatgtcccccacgaccaaaaaagctatctcatacgacgggaaaatcaaccaagcctcatacgacggtaaaatcaacggtcttggtctctcgtactccctcctatatataatatatttgaatatattattagacaaggttttcaaagttgaactataaaagttaaatatagtatatttttactagggaaagtgaaacaacaatccaggccatgcttcaaaattttccattccaaaacatcctggttgttcaatatattttatgtgattgttcttaacatcccgccatacgacactataagcatgcaagtgaccagcagcggagccaaggcccggccaggctccgcctaagatgctgtagtagattagcacttcattaatcatgcaacaatagaatattttttaactaattaccctaatgaatgtttgattagttgagaaaattagcaaagcatataattaaggctcatgccatcacatgtttgcattctatatatgccatcacagctcatatacaagcgtacagctttgataatacacaataatcgtcatatcgattttaactcttacaccaattagctcgtactgttaattttacttgtgtcaatggtaaaatggtccgtagagttgtacaagttcattttcatttgtagtactagtcatctgtcagtggcttgcccggggtcaataaaattttttagatccgctactgcaagtgagcatgtggtcgctcagtcactcaaaacaatgtgtagattcatagaagctatgattatttcttatgcaggataatgagtaccggaaccattggtctattcatcatttcaaacggtctattcatcatttcaaacttgcagctcatccaagtcttcattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11671 - DNA, 781 bp, Oryza sativa
  unsure (1)..(781): unsure at all n locations
nnnnnnnnnnnnnnnnnnnnnnnnnnnnnnnnnnnnnnnnnnnnnnnnnnnnnnntcctggtacaagaatcaaatcacaccatgagttgagtgagtaattaatgagtggtcgaatcagataatgaagctcttgactgtgatggccaccttgacaacttgagttattagtaccaccagaatcaataatgagtgggagtgagttcgtccccgtacgcattgctggctttctccatcatcttccgccgagcggcccacaacccaccagttgacacttgaccgcatccagcccagcacggcctcattgttgattggacctaaacatgatttcaacgggggaatatattcacaattggagtaagttcacatatcatccctcaactttacatcgagtctatataaggtcccttaactgaaataccaggaatgtctaccccttaaatgttcaaactatgcaaaataggttacatgatagtacatatgggttgtttggataacgtggcatcctagtcagaataaaaaaaattgtggggcccatatgtcatcctcactccttttctcctctctctctctctatcctctctccgtcaagagcagggcaagcggggtgcggagcgannnnnnnnnnnnnnnnnnnnnnttccgtggtgagctcgaaccggaggcgacgtagctccatgaaggagcggatcacctccgaggataggtgcgcgctcgcgcgaacaccgtaaggaaggatggctcggccgacgacgaggacgacaaacgacgcggcgggcggagt

SEQ ID NO: 11672 - DNA, 729 bp, Oryza sativa
ccaccgcgaaccgcgcgcgtgcaccacgtccctctcccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggcccccttcttgggccggccagcccgttaagctcggccgagccgccctttctctcgggtcgcgccctagccgcccggggaagtctattttccctccctccttccttttcttttcttttctttttcgaaaaggatttaattaaatccttttcctttagaccaaaaatccaataatcttagaaattcaatatcttcccaaccgtaagtccgtttgactccgttcaacttccaaaattcctcaaatctcgagatctatctaatggcatgcttagaggtcattaatagggctttattttcgctgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaatatgttgcttgaaaaatattatgaattgataggatcgcacttaatctgttgtcccgtctgcaaggcagattggtagacctacctaatttgatggacttgatccttcctttg

SEQ ID NO: 11673 - DNA, 7556 bp, Oryza sativa
gccaccccagggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatatataagttaaacagtacatagagatgcaattttttatttttatttcatttttttatatttttttcacactaaggagaacataggaaccaagtgtataaaaaataaactcaaacggataaaatatgtgacatgtagaattttccaaaactctaccgaaacggacaaaatatgtcatctattaaaataggcgtaactttctcatacggactcggaatcaggcaaatagtatatgcacggacatctacagaaaatgatacatccgattctcccccgctacgccgggttcggcgatattaaaacctccaaattccgcttgcaagattgtgttttcgaggagagaagtttttcggtggagctttggaaaattccacatgccacatatttcgttcgtttgagtttattttttacatggttggttcctgtgagttcctaagtgtgaaaaaaatatcaaaaaaataaaataaaaataaaaaagttgcacatctctctcctctgcactagttcggagagagaggagaggagaggaaaaattctacatgtcacatattacgtccatttgagttcaatttttctatggttggttcttgtgtgtccctaagcgtgaaaaaaatatcaaacaaataaaacaaaaataaaaaatttcgggagggggggcgccagccactctggcgcactccccctagccacctcagcatcgccccgccacgtcggcagggggacggcgccaaagaggctggcgccgtcctgttgaacgacggcgccagccactctggcgccccaaaaaggactatttttgggataagtttttttaggagtctatttacgaaataagtttttcaaaaggaccaaaatgtgaaaaatccagtaataaacatggtacgtactatcagggaaagcagatcgatggcgtacactggagccaggaattgaaggcaatgttgttacgacgttgattatcctagcgactctctggactttggcgccggtgggtcatcgtccgtgtacgtacagatctcgccggttttggtccaccgatcaatgccgctctacctaggaagtcaaggtaactaattaagtgtttgtttcatggggccgtatatacgacgttggagatcaacttactagctcctttcttttttggaaaaaaacatatacatactcctttcacccaaaaaaaaaaataagtacaccctactcgtataatcatctccagaaaactgaaccggcataatatttttagattgacgaagtcaacacgtacagacacctcgctaatgaagggtacgtcatctaccactgaaagaataaatagtcgtaaatgtgaatacctatgtcaaatctaggatttgaatccagctgggctggttccaccacaagaaacctaactagttgagttacgctcccttcacacaaaataaataaatttagtatggaacgaagtgtcatatatcgtactatgtactccctctgtccttaaatataagagctagcttttggttggatgaaatatatactagccaatattatgaatctggacaaacttcgattcctgtttaaattcgtagtattatgatatatcactttcaaccgaaatcctgtatatttggagatggaggtagtatacgtctatttattttagaaagaaaggagcacagtacagtagatgccaccgctagaaaaagggtttgtactcccgatttgtaaccccatatactacgaattcgggattaaagatgcccatctttagtcccggctgaaataaccggattatcaaccgggattaaagatggagccaagcctggtccggttggtaggctttttttctttttattgccattgttcttaactttgaatattgatttcactacatccccaaatcatccctaaatcgtgaaatccccgaatcgatcatcacagaacaatccccaaatcgatcatctccaaatacatcacaaattctaaaaaaattacatcacaaattttaaaacatacatcacatattcacatcacacatagatcaaatacatcacaaattctcaaaaacaaattcatcacaaatccttaaaaaaacaaatcctctctgctcacggtcacgccaccgccgccgaccccgccctcgcccggccgcctgccctcccggctccgcgcgagcaggccgccacggctctccgctggcctcgctcgctcgctggctgctcctcattcgctcctctatcaataactcatcgatctaccgataggaagaaggaggggataagatcggcgcatataagagagagaagagagaaattaaagaaaaggataagagagggagcaggaatagaaagatgaggagtttgggaggataagtcatatggattatatacggtatatggatttaaccgggactaaagatcgatttttagttcgaacctaaaaatcaccggcccactgatagcctctgacagtaaatgaaccaggactgaagatcattcagggccgatagagttttaaaccgggaaaaaaaccatctttagtcctaatttctattcaaactatattattgtggttttttggtaaacccagcaaaaatggtctctcaagtagtgtgcacacatctggtggcaattgtgactcgtgagttaacttgtacaaggtccaaccacgcacggttgcacggaagggcttaattaaaaatggaaataggagtaggtcataatttggccatatctaggtggaggctactacgtaccctacctgcacattgatccagctatggacggttcgtagtaaatcgtgatcatcctaggatgcccatgtacggatgttcggtgaacttgcatgtcttattataaaagtgtgactgatatcaatacaacttactctatataccatttttcacaagtcatcttaattatgtactcctttgtattaccttagcatcttaaattccatactcttcggttgtaaattttttttatttaaattagagtcgtatatagtacagtagttgtacaggtggatgcttttaattgatttatgactcacatccatatacagctgggtgcacccatccataatcacaactcagccagccgctctcctgtgggttttcaggcggcgcatctgtttttgtttcttgatgactagccaacatgggttttgctcttcttccctttcttcttcttcttcttcttcttcttcttcttcttcttctaaatttagtgtggtggtacaaccagtaggagcaccatgatggtggtagaattatgtttatctgaattattcaaataattagggctataggaccttgccaacaccgatgaggagctagggaagggcagctaccataaaattagatctaagagagaagatacaaaggacaggaagtgttaaagattgtgtatagattttgaagcaatccgtaccactcaaaagttactacttcatatgttcccacaaaaactttatttttgtgttttttttcaacatttgaccgtccatcttatttgaaaattttataaattttttttaaaaaagttgtcatgtataaagtaatattcatgttgtgtcatctaataataaaaatactaatcatagaaaatttttaaataagacaaagagtcaaacgttgtatcaaaaactaaaaaatggagtctttgtgggacggagggagtaatatactcgtgtccattccaaaatataagaaccgctagcatttgatctttttatatataaagaaaaggatttatggagtgtttgtcttatcaatcatctctcattcaaatttctccatgcgtcaccctcaaccaccctttcaccttttttttactaattgaaatggtttatgtctccagcttctatcaacaggtatatggccaacgagtcaagagaagataaaaaaaaaaagaacacgtagattctatgacaatatactatagaaactacattattcaaaatggaattaaagactgctggctaccgatttcaagagtatagcttcagaacacataatatcctactcctcccatgaaagcatcaaggaccaagaatatatagaaccagctagaagacacgaagataacatgtattgttttagatatttatttgttattgaaaactatataattgcgacaatgccaaaatggccaacataagacactagtagttactaattttgccacagtgtatattgatgaaagaggtaaggtggagccacattataatagaaaaatgagatagctattagagaaaagatgaatagttggcggaggaaatggagaatgggggaagaggagaaggtaaaaactttgtctcacatatattgaaggaacatgtgtttattatggtagcagtgctattgctagatgatattaccagtattttattttcaacattcacgatgatgaaccaggtaataggactttttactacttttttattctcacattgtggttgcccctatgttatttatagagcaagtgttatagttcttgaagagatatcatgaggtatgaggtatcaaatattacactaaatttttgttacctcatggtacctaagaaccataaaattgcttttattgttattttactatgcggccggtgtacgtactgcagactacggcagtgtgcagtgggatgtgggcaccttcttcttgaagtctgaaacagtcgtgacagaaggtgcatgggcattggccggaccgtgatcgacgaaattaatcagcgctgatcgtaggtgcaggcgactgtagattggtaagtcgcatcgtacgcctttgctagtgatcttgccaacaaacctgcagaccgaacggctgcacgtacaggccaccaacgatcgatcggtgccacttgcaacctgcattccccttcttttggcattgcagttcacgtcccccctttgacacactcctgcattcatcgatctccggcattcttccctgctatgtacacccgtttaattctctgccagtgcacactttatatcaggtttaattttcaaacacgcagatcgatcctccataaatttatcatgcgacaatagcttaattgattagatcgatcccgcttgctttatttctgctgctcacgtaatcatgtcccccacgaccgatcgatgtagtagtattccgatcgatctatcgcgagatagatcaccaggtttggttttttttaatgaacgcataaaagaattacacgtcaacgatgatggatcgccggatcgccaccacaaacgccggccgcttgcgatatgccatgcgatgcagctaattagcgcgatggcacgcagcgcagatccgccgcgaaagctcgcgctgcgtgcggtgtcttgttccgcttgtcgcgacgcactttgcacagttattctctattccaaaagcgcggcacgttttcccggtagtgcagtgcaggtgtgcagggggtgcagcaatggcggcttgcgcacgaagcaaaacacgtactccagtaggggagtacatggcttttgcattgctctcgcgcgctactatgctacgtactaccatgttggaattaacgggtggcgatcgatcgaacgagagaggacacggcgccctgcagctcgatcgatcgatcccatgaacggatcatatatcatccgatcgatccggccatcgatcgatcgatcgatcgacagagcaacatgcctgcatggtccatgtaccaaaattaactaccatagatattgcaacggcatccggtcattatttcagcagcagcagcagcagcgagagccattctgctttgcatgcatatgggtccgaccggccggccggccggcagcgagggagggaaatgcagagaggagagacagagagagccactttgcagtgcattttgccacaagctactgtaccatttatgtaaaacaagaacatcaaacagggacaaaggctggccgttgcaaggtggctttgcaaggtcccccattaacttcacatgctcagcacacaccaagatccactagctaattaagatagccaacacgtacgtacatctaggcctggtttagtttcccaaaaatttttccaaaaaacatcacattaaatttttggacacatgtatagagtattaaatataggttaaaaaactaattgcatagttagggaggaaatcgcgagatgaatcttttaagcctaattaatccatgattagccataagtgctacaataacccgcatgtgctaataacggattaattaggttcaaaagattcgtctcgcaattctcgcggtttacaggcgagttatgaaattagttttttcatttcgggccgtttcgccgagtacacagtagaagcactgtaggagtaaaaaggtcacatgcctgcacacgccgagcaaacgtcacacgactatatatcacagtatcacagcgattgtgccaacgtaccatttggcttaggcagacttattccaagtctctgtcacattggatgtttggacactaatttagagtattaaacatacactaattacaaaacccattccataaccttggactaattcgcgagacgaatcttttgagtctaattacgccatgattttgacaatgtgatgctacagtaaacttttgataattatggattaattaggcttaaaaaattcgtctcgcggattagctctcatttatgaaattagtttttttggtttaatactctaaattagcgtccaaacatccgatgtgacataggctaaaaagttttagccccatctaaacacccccttaagctcctatatatacatcatatcaatcagggcatcaggccccctacatggccctttttcatcgtacgtctatcggtctacagtatatgttcctggtacaagaatcaaatcacaccatgagttgagtgagtaattaatgagtggtcgaatcagataatgaagctcttgactgtgatggccaccttgacaacttgagttattagtaccaccagaatcaataatgagtgggagtgagttcgtccccgtacgcattgctggctttctccatcatcttccgccgagcggcccacaacccaccagttgacacttgaccgcatccagcccagcacggcctcattgttgattggacctaaacatgatttcaacgggggaatatattcacaattggagtaagttcacatatcatccctcaactttacatcgagtctatataaggtcccttaactgaaataccaggaatgtctaccccttaaatgttcaaa

SEQ ID NO: 11674 - DNA, 7721 bp, Oryza sativa
agcgtggcggtcgggaggatcgacgaggacgcgccgtgcgagttcggcgccgaagacgcgcgcctcggccccgtggcggcgccgccgcacgtgcggcggagccgcagcgtcgcggtcggcgccgggcgcgccggcgtcgggttcggcgccggcgccggcgccatgaggatgggaccgggcgtcggcgtcggcgtggtgcgcggctgacctgaccgacgcgagtgacggcctccggcggcgcgtgcagcaacagtagcacgcacgcgtcgcgtgtcgtcgtcgtgtagtagctttacctaagcttaggcttgctgtcttttcatggttcgtgaatcgtgaacacgaattatttacagctttttttgtgtgtaattgtgtcgctttcggtgtgatgtgtagtatatgtacatatcctttccttgtgattactagatttgtcacgatttggaactaagcagccagtttgacatctgcacgttactttccatgcatatcagcatatgcatgtgctgtattatcccagcaagtttggtgtgtatttcttgatttctagtagtagtttatacttcatcaaaagaaaaattaacctaaaaagaaatataacctcctatagtataataaatctagacaaacctctatttaaatttgttgtactatgtgaggtcaaattttcttttatattggtttttttgaacgggggagtatgtactatttgaaaattataaatcgttgcaaggcatctgtctccaaccaagtggtcgatcgatcatagaaccaacctactccaattatctatccaatgatccgtacgttaagtttgaccttctgggatgagccgatgtgtgcacctgtcgaagtttgggcgcgtccgacttttgcatggctacacgctgtggcaacatcaggaattcaggatcgtcccagtacctctcactgtcccagtgatactcagaccctgtttagatcacaccaaacttgctttaaactcccaacttttcaaatcacatcacatcacatccaaaactttcctattcacgtaaactcctaacttttttttcaaagtaccaactttttccaaacttctcctcaattttagaaactaaacacaactttatactacagaggatcttacggctttgtatagggagctaaaaatatgagaaaacaactggggaacatatgaaaaaaaatggacgtcagagctttggttattggagtagtttatttttctaaattttgtagctaaaattatttagggtgtgttcgctggagctagatcctaactagcacagtgcacacggaaaacagagcggtcagttagcacgtgattaattaagtgttagctttttttttcaaaaatggaacaatatgatttttaagcaactttcgtatagaaactttttacaaaaaaatgcatcgtttagtagtttggaaagcgtgcgcgcgaaaaacgaagtggagggagccaggaaccagccctcctgaacaaacccttagattcgtccaaaacagatattgttgatgagcttattctggtacgtgaaacatgacggatcatttggatataaataataaactattataatcttgaaaactatatttatttgattttacaaaaattctacatataaagttttttaagaaacacattgtttagtaacgaagtagcatagttgagatcaattttagaaataattctatatataaagttttttaagaaacacattgtttagtaacgaagtagccaagtcaagatcaatccgatccgaacgcagcctaagaaactagagattatagtagaaactacatgcgcacttactaaaactatcctaaacttgacctatgcgacagggatggactcccttcgacgagtttcctccgacaatatcgatccagcaaccaggtcagctcttttcttcaccactaccctcctccatgttgccgttcgccctcgtcggcgccgaaaggcataaacctgtcagcgtggcccgtctagttttgtcccagtcccagcaccagctcaccacttgctatcaaccgcgcgtctcttgcgatcacggtgtagtctcgccaaccacccctcctccgccttccagaccatttctctaagcccaattctccatgtggtgtttttttctcctgaagataaagataaagataacgatgaagattaactgttttatgtagaacgtggtggtattaacgtataattaattgagttttaattattacaaacttaaaaaataaattaatctgatattttagagcaactttcatatatagagttttcgcacgaaacgtactgtttagtattttgaaaagcgtgatacgaatatccaaaattttattcagtttttgcagtgaaaactaacgggtttgtctcctcattcacatccggaatcctaaaccttgaacctaatcccacagctggtcgcgacgtggtctgaaaacgttcacgcgcgcgatggacgcgctcacgcgcattcgttagttagttagtttggatttccggtggaatgcgatcgggagacgggcaggccaggcttccgaccgagacgccgccgaggccctagagcgcaactcccaaggctgtagaacaatccgtggaccgcagcgtctctcagccactcaccacggcgacgtgtcatcccatccagccatccgtcgtaccccacgtccaaatcccagagcaccaccacatctcccccaattttcccagccgcgaactcctccgagttggttggcctacgcgcctagccagctagcgacaatggccgcgtccgccgccgccgtggcatccaccgcgccgccgcagccgctgcggccgcgccgggggatagccgtgccgtcgtcatactcacaccgcgcggcgacgcggccgcgcctcgccgtctcggcgtcctccaccaccaccggcaccaccgagacgacgagcgaacgcggcggtgccgagcggttctacttcaacttcaccgggttccccttcccgctcgggccgttcctcaaccgccgcaccatccgcaccgaggtaattaaccccgcctgaatccttctgctctccggcggcggcggcggcgcgtgtctaatggcgtcgaacgaagcaggcggtgaaggggaggatatggctgttcgagcaggagcaggcactggggttcagcagcgtctccaccaacacccgcatgaccgtcatcaagctcaagtccggcggcctctgggtgcacgcccccatcgcgccgaccaaggagtgcatccaggcaagcaatccccgatctcccccgtctcctccgattcagcctcgtctcatgtcgccgccgtgcagcttctcaaggagctcgacgcgccggtggagcacatcgtgctgccgaccttcgcctacgagcacaaggtcttcttcgggccattcaccaggaaattccccagggcgcagatatgggtggcgcccaggcagtggagctggccgatcaacctgccgctggagttcttcgggatcttccgggcccagcccctccaagacgaggacgacgacaccccatgggcgggcgagatcgagcagaagatgctcagctcgcctgaagttggtagcgtcactgtcaccaaccaattcgagcttctatttcatcagcaaatggatgcaatttttttttatagctgtgtgcaatggtgtgaatttggtgatttcagggattggaccctatgtggaggtggcattctaccacaagccttcgcggacattgttggtgacggatgccgtcatttttgtttctcggcagccacctgagtgtatcagcaaagagtcgttgctggcatctgcaaagaacggcttggcagtgaagattttgagcaaaggaaaagaggtcccagatgaaccagttgtggacaataagctgaaccgtcaaaaaggtgattgtagtgagtttgatctgtactgtctaattgcggctatgagtgccatgccatatacaagaatcactttatttttaatgtaacctctgaaaagggtggggagttcctgcttttcattaagaagaagagagtagtgctcattaagaaacaaaaatgactgaaactagtgaaatatagtgctcatggtttagcagaaatagtgttgtagcacactagatcggtatgcaccagcctctgtttatcttttttgggtctggagtgcataacgatctttgttaaacaaaatcgtaatgttcactgctttgtttctgtttctttggtttgctgcatgacattctaaaaaaaatccttgcgaagctcatttggcaattccattctctgtgaagcttcagtgtaagggcttgaggtattcccatggactccatatgcctactatatcgccatatcggttatgaggtctttactctgtattatcctcaatgctgatattcagtttttttcgtcttcgctgtaatgccaaagattattgcctgtcctcagacatttaattttctgctcaaagcataagcatctgatgaaaattacagcataatgttttcttttcatagaatagggtcatatatcttccgcattgaattgataatactagaacattgcagtaaccttgttggtgtaacaacaggatgggagcgaatggtactgcaaatattgtttcttggtccctcaaatcttctggagccaaacgcaagttttgctcaaatgtctcagaagttgattgtctccccaattgtgaagacacttgttttcagcaaagttccagagaaggtatgttcatgtggtgaatggaaactataatacactagtatctgctgaacctggctgaacattaccttctgtgcttttgatctataggattcataaaacttagaattacaacttgaatgttttccacgggacgctacgaccacacattttatcctttgggtgtcaatatcttcagcttgtcattacaagctgcctctagtcagaagcatttcctttttcagttgcaaacctgcaatgtgtatgtaaatgagtcaatcatgaaaagttgcatgcccagactagaatatgaagcagctttaggcatccttcctatgtgctaccataatttatgcactgtctgactcattatctaaaaaaattgcactggctgacttgcaagttttatataccattgaagtgctgaagtggaatgacctgagatcccaccaagtagtatttctgatatttctattttgaaaaaataaaaaaaatcttaattttttgaactagcattttggtatttcacacttcccatacatttctcccaatgtcaagccattgaaaatttgaaatcgtctgcctctgcaggtgagagactgggtcgacaggatcgctgcagactggccattcaggaggataatcccagctcacttcgcagctccgattaacgcgaaccggtccgacttcttggctgcctttgctttcctagatgagttcctccccgagcgatctccagcatcgcccggcctctcactcctctttgcctcgctcatgggcaaggcggcgagctacttcccccctgatgacatgaagaccctgtcatccctggacgagttcttggtttcagttggtgctgtcaagaagacagtttcaggcagaaagcgatgatacggagagatactggcagatgtgttgttcatagttttgtgttgagatgagcttgttgctgctgtacatggttaacactactaaactgtactccctccatttcacaatttaagtcattctagcatttcccacattcatattgaagttaatgaatctagacatatatatctatctagattcattaacatcaatatgaatgtggaaaatgctaaaatgacttacattgtgaaatggaggaagtatgtagttagcctttatccaggattatattgtatataccttactgcagtctatagaagaggccaaaatgtttacaactcagctgaacatctgatgattctctatgactgggtctgggtctggtctatttggcatgactccggctacaacttcagaaaagtccaactaacggtttcagttctatctaaaaaagagtgaagttgctgaagtgattaaaaaattaactagtgatgtggagcaggtttaaatcgctcactatgtagcatctatgtcgataattcaagcattgtatacgtcattagttcaattcttcgtaggaactacccgtgagcttgcaaaatatatctgtttattataaagagatttgttgttcctgaccctgcttcacctccacaattttattacagactacgctcttttgtagttagattgagaaggccctatgagaatttctcttgcccgggctagcagagaggcattcatgtttgtcattttaatgggggtggtggggttcagtttagcatttagagagcacaagattagaatgctgtgcacggtgtctgtggagtaataattccttgttcagatcgagccaagttcagttaatgcagaaggtctgcatccatgagccgtcacaagccaaagtacatcatcttctgtatcctcacgcgtcagacattaaccccattataaccactaaccaacgcgttatacaacttctgatctaagtgcccactccatcactttcctcagatagtacacgcttttgcactactaacagcgacttgtacatgattttttcttaaagacacatagttagatccacatcaactctgaaaatgtgaagaaatagtagttcaaagctgcacacaatcacttatcactgtattttacatgcctttgcactactaattgtgacttatacatgttcttttccctaaacaaacatgattagctccacatcaattctgaacttgtgaagaaatagtagtacaaagctgcacacgatcactactactacaactgtattttttcagactgagaatgtgtaaacctcgattcctactccactttcctagtgagcaaaaccatcaaaacgtccccaaaattagcacagctcattgcacacgctcgctggacttgtctgaactctgaactcagaagtcagaactgacatccttgtcaggcaaaggtagttaagtcagttaccatcaaaagatctgaagaacggtaacataacgaccaacagtgacaaattttactggagtacgttaactccctgtaactgaagaagggttcagattgcaggctgtaaaataaaaactggagcagtaaatacgaaggcaggtcaaaaccgtgagagttaatgcgaaggggtgaaactgacgacgagccgccattaatttctccaaccttttctccgtcacaggatgaggcagagcaccatttactcctcggcgccgcgacgccaacggcgacgccgaccacagggtgatcatcatcagatcagaagcaaaagagcaggatatatacacacgcatgacctcatgaactactctcatgtacagggtaaagagatgaaaaaaagaagatgatatgcctttggcttctcattgatgatgtccagcccatcagccacagggagaaagagatggattatggaaatgacaaattgtatacagacgtcactgctgccagaaaagaacttccaattttttttctttttttctgcattgagaaatgcaggccaagaaagctacaagaaacatggtactagatgttgccaagaattgggaggaggaagaagaagaactagcctatacatgcaattctatctatgttattgttgccatgctgatgtagtaagcatcgatcctccattgggg

SEQ ID NO: 11675 - DNA, 949 bp, Oryza sativa
atacaccggtgcaaagcgaagcctctgcagccccgggcgccgatggtggacgcgtggataaaaaagagatcgaacggcgagcacgatttgcggacgcgctgcggcgatcgctccctcgccctctcacctcaatcggaccggaatcacctctcgccgacgccgtcgacgatagtgatggtaggacgaggaggcctgaagaagaacagatcgacctgccgggcttctgccttcgtctcatcaggtgccggctggtttcacctgcgctgcgcatgacgacaaggagcaatggatttactgaattttcattgatgatattagttgcgaccatggatttattagttacgttaatacggagattgtgacttattaacatgtaaaaacttgactttgtggcgaccagttcttgagttgctcttaattatcctcatcttttccttgcctgaactcaccttgtgagttgctacttgttcttattaaatttcttcaaaaattcagattatacaatattccgtattttattcactcacgtaattagataaacaatcacagtttttgtaacacatccatcagattgaatatttcagaacaaccaaaaacgctcatatgtattccagatagaaaaatacagtctacagattacaaagggataactcagtattcttgcaatttgaacaaaaaaaaaaggctgttcaggttacaatctggacgactggactacaatccttgcaacaatttagggattatttcatattacaaaggagtgaaggactacaattttttcaacaccatcctctttttccaaatttacagtcctttcaggtatagcgattttccctcttctgtatatattctgcagagaagatagagaaccaccatcataaagataaatcgaaatgagaaatgcataagttctgctgttatcgggaacaccagaatcaggaataagaat

SEQ ID NO: 11676 - DNA, 6995 bp, Oryza sativa
  unsure (1)..(6995): unsure at all n locations
nnnnnnnnnnnnnnnnnnnnnnnnnnnnnnnnnnnnnnnnnnnnnnnnnncaaggaatttcgattaatcaaaatggacatgattgacagattaatccaagatcccacatgatgacatcaagcagggtatctttagtgcacaaaatgatccaagctagaattatcgatgctaaagctaacagtgcaattgtataacccagcaacaaaagcaatgaacacacagggaatttgagcatacagcaggctaaggctcctagttccaaagatcatagctgcagcacaaactctaccatctgaaaagttctaaactcttctcaggaaatatcagtgaaaaaacaacggtaggaatgtaacaacaccatgacaatccacataattctaaacctcaaattgcatcgcaggatgcgaaccacaggttatctcctctcctcgtcaatccttctcggctccatgtacacaggcattggcgccgcaagcccgggcttggcatgagcacccctcttactgtttgagcgcttcctcgcctcagcttcagcagagctcgaggtctcagagctctcatcagcatcactgccatgctcttgctcagcctcatcatgcagctcttggactttaccattaccacagaaacctaccttcttcttgttcatcgctgacggattagccgcaaatgcggcattgcaaccttcatggtagtctttacaatccaattcgccattcattgccatctccccatgctctttgactagcaccttatcaacaaactccaagatccgggtaagctcccggctcaccgcgcgctttccctcacggatcatcgggtcaccgccctaatcagaaaacccaagatcagaacaccgttccaatggaatgcctacctaattgaatatgcccatggtacgggttctcatcacctggatcgagtcgagatggaagaggagggccatggcggcctcagaaatggcggcggggtcgcccaccctgcctcgcccggagagggagccccggagcgcggcggccttggaccggaggacggcgagctccttgaggtggcgcagcgtgcgggaccgccgcgccaggaagcggcggaagtgcgcctggatcgtccgcgccgcccgctccctcgctggtgaaggcggagcccgcgcacggcgtggcggcggcggcagcgaggccggtgcatcctcgtcgtcgtcctcctcctcctcgtcgtcctcctcctcccggtgcgcggccgcgcgggggcggtggcgagggttccggtggagcgggggcggcacgggcggcgaggcgaagcagcgcgggagggtggactcgagcgcggccacgcggcgcaggagcgagtggagcacggcgtggctgtggtccgacgggttggcctgctgcggctgcggatactgatggggtttgggctgctcgtactggtactggtactggtagtggtacgcgtggtgcgccgcggaggtgggcggcggcggcggcggcggcggaggctgggtctgcggctgcgggggagtcggggccgggggcgggggcgcggagccgaggaggagatgggccgcgatggcgtggaggaggtggtcggaggcggaggttggcgcgggcgggggcgggggcggcacggggtagtagtagctggtcggcgcggggtagcagccgccgtcgcagccgcagcagcaggagcagcaggcgggcggaggcggaggcgggtcgtggtggtggtgacgaggcatttctgcggatcagatcggcgcggcggcagcggcggcggggaaaatcacatcggggagcggaggggagaggggggaagggaaagggagagtgcgctgcgccccacgtgctccggcctgtctcagcacgtcgcggcgccgcggtttcgctcgctgacgggtggggccgccttgggtttccgctcggggtttatcgactggttggtcggcatccgtggacttcatcggcggctggccctgccgtgggttccaatgggtttggccttttttttttccggcagaattacgtgccgtgctggactcgcatctcatcactagacccacccgaagctgcccagccatggtacgatggttgctccatttttcagcaacggaaaggcacgattgcaacgcagcatcaaaatctcatcgcaacggaaaaacggattaaatggtagtagagcgaagaaacggcactgatagttaacgggtactgagatcccgtaccattgactgcatatcctaagtcaacagaagctgtacaagtcacagtaagcactaacacaaagacacggccgagcaaaatgtgttctttcagttcgaagtgtgccgtcaagagatgtctacgcaagagaatcattggaaacatcataagattcgtagtccctgcaatgcggaaattcatatagtatgtaagtcaaaaccaacagcctactactacctccaacccaaaatatataacaatctaatctagtaacagacaagatacctatccagattcgaaggttgctatatttttgggagtacaaaatttggcaggacaagtgagcgacaatgtatggtgcctagtgcttaccctctgttaaattacgaaggatgttgcgctgcagggttactgggctatcattcgtccttgttaaagaaactttcaggtaaggaaaattcttctccttgagtgaagttatccttctcgtcgtcctctggcttctgcatttttttcagaccgcatcaaaagtgtgtccagactccataaacaagtcgtaaacttatccatagatcgaaatctaattaattccgtgtaaatagaaaacacaaattcatagttagtagagacatagaaatgagaaagagattattggtatttcaaattaccagcatttctaggttgaagaatcggtccagtagttgtaaaacttcatcagcagagaattgtctatcaagactgaaggaatttaaagatggtcagttcagatcagagatttcatagaacagaaattaaattgaacatatagtcacctttttctcaagtattccattagaccatagataacaaagtgacgatgaatgcctacaaaataaagtacagcagatttattagcatataacagcaaaaggcatccttcacaagacatatcaagctgtatgcagcaaggttcacaaaagacaaaacaattttagtaaaaaatgccaaaaccaataaaggccagccatcacttcaaactaaagcccaaaaatatacaacaaagaactactaagttcacaaaaaacacaagacatgagatgcatatgatatcacagggcatcatgacatagagatgactttgcatttggttatcaaagacaagcaagcacttgccgccagaaaacactataataacgaccagtataactgcaagaccactaaacaccatggttcatcctccaattcaattaacattttgagttttttttttaagttatgtagcctacatgttgttttacattttatgatttattcctaatttacagtatcgtctggtgaaataagatctcttaaatttaggaaattcctaaaatgtggaccataccccacagtaatggtgtggaagctatgcacgtgccacaacaaaaagtcattgtggaaaactggaaattcaatttatgtaatatgtaacctaaattacttatcattcaactgatcgagtttcgttacatagaatgctacaaagatttgcagatactaatgagatttgaggtgacaataaacggataatcaacatggatacattaaaacaattagccataaatggaattgcttgaatcaagtgtgtgcattagcaacctgacttgcagagcgtaatttctcagccccatgaaagaaacagaaaactcaagctgcagacttagtattacattctagcctattcaactcagaaatgctttgctcttataaccttcattgcattctattaaacttagtatttgatggtacacttaaggttactcattcccagactggtcatcattactaaagaacctaaataagcactcctataactagctgtgcagtagagctcaaatataatcatgtgttaatattagattatactccctctatcccaaattattgggacccttgtagttcgagcaacaaaggtccccatattttgggacggatggagtagttgattagcaatttctagccatacaaggattttatagtaaactcaaaatctaattgatcaaagacgacttaattgatcaaagatgacctgattatggcatttatcagcaaaaccaacgaaacaagcaacttcatgaatttttggttttcaaaatagaagcgaggcatggtttcctaaaaagaggacgaggcccacaaaaattatgcataacccacttaattaatacttccatgaatcggtgtagaggtccaaattattctcactatatgaaggggggacccactctacctaccttagttgaatatcaacaataaactcctacctatgtaattcattgaacagtaacattgagaaaaaaggggatttgtaagtgcggtgcagtgggcgggagcgaactagatattccttcatatgtacaaatgtacaaaacttgtagccgtaaacccaaattgtgttatgtgcaggaacagaaatgatagagtactaaggatgccatattcattgttttgctcttttaggtgttattacaactgttgtcaagactatccaaactgacagtggcaggcttataattccaaaactaattaatcacgtatcctcgcacactcttaaccacggtaaatgtgttaatgcgatttcaaaacggaagatccaacctccaacctcacacatagtcacatagagctgttctctctttctctaagaaaaaaaggcatcatgtcagcaaacaaaagatcaagcaaaaactaaatacacatcagagcacgcgaaacaacatatcaccagaatgggaagctaaaggaaataacacggcgaagcatttttaacctttcagtttggacggagggtagaactcgagagcctgaagcacccgcagctccagctccacctgcgattgctcctgtacaccaacaagcgcacacacgacaaggacaagaaagcatcaacctcagataacagtcatgcgcatcccttgttcgtaagaaaaaacaaaagggggggagggcggggcgggaccttgggaagggacgaggcggaggagggcggcgcctgggccggcgactgggcggagatcccctcctgctcctcgtcggcggccgcctccatccccgagctccctttcgccttcgccaccgcggccgagccctagcacgccggaaacccgaggggaggggaagctggaccacgcaggctatgggagacgagcagcattcggccaccaacgataaaaatcgagcaggaggagtggaggcccaccaccaccggcccaccactgctcccggcctggatgaattttggggccttatgggtgttgtcaaacggaagcccatttaagaatggacttcacaatataaagggtcatgttgggcagagtaggcccagatctaacgttttcacaagattactcagaaatattctgatgaagattaatagccaaaataaaccttaccaaattttggcattaccaaaattttaacagaatttcttatatagtaccaaagtttggcaacaaactaaatgtatgcacatttaacaactttgccaaaaaaaaagtatagttagaaatgacatcaatctaaacagctcctgctcattagacttgagattttactacgggatgggcttgaccaaaggtttctacaaatcctaaaaattacatgtgggatggtctaattcatagtaattttgcaagaatgtagcgtgggctcaaatctcatgcagatcttcgtttgtgttcattctctctctagatttgtatattgttttacctcaagtatcaaaataactaagtttaggaattatgtgtgtggaattctaaaaattcaagttaactacaatcctgcttttacacctttccaaaaccacccacacagtttttaaagaaatccacacactctaaaatcttactattttaaaagcagagtggacattctggccatgtgatccgaggtggcatggttggagaacactcccacaccatgagaccactccacctcgcatgattttttcttacgacgcacttccaaattttacgccctgttatattgaaagtttaaacatctatttaaaatattaaatataggctaaaaaataactaattgcatggattgcgactaatttacgagatgaatcttttaagcctaattgctccatgatttaacaatgtggtgttacagtaaacatttgttaatgacagattaattaggcttaataaattcgtcgagcggtttattgatagattctgtaattagtttttttattagtgcttgaacaccctatataatatctgatgtgacacgttaaaactttagaaccctggatctaaacaccctctgacatagtaacattacgttgttcaactggttgggttgtgcgtgaatagtttctcaagtacaaagagacagttgtgggctgcaactgcatccctctgtcctaaaaaagacaaaccccgagtttgtgtgtccaattttaactgtccgtcttatacgaaatttttttataatccgtattttcattgttgttacatgataaaacatgattaatattttatgcgtaacttgtctttttaaattttttcatatttttttcaaataagacggacggtcaaacgttggacacggaaatcagggtttgtctttttttttttttttgacggagggagtactgccttgccacgttaactaatatagtgtggtaaaaaaaaatgcaaatttggaagtaaaatatttcattgtgcacgtaagacgattctaaaaaatgagacagtttgctatagttaaaaactgtgttactactagaacgtttaatctaagagactgttgggggaatctatatagataggg

SEQ ID NO: 11677 - DNA, 2731 bp, Oryza sativa
gttcaactggtggggttgtgcgtgaatagtttctcaagtacaaagagacagttgtgggctgcaactgcatccctctgtcctaaaaaagacaaaccccgagtttgtgtgtccaattttaactgtccgtcttatacgaaatttttttataatccgtattttcattgttgttacatgataaaacatgattaatattttatgcgtaacttgtctttttaaattttttcatatttttttcaaataagacggacggtcaaacgttggacacggaaatcagggtttgtctttttttttttttttgacggagggagtactgccttgccacgttaactaatatagtgtggtaaaaaaaaatgcaaatttggaagtaaaatatttcattgtgcacgtaagacgattctaaaaaatgagacagtttgctatagttaaaaactgtgttactactagaacgtttaatctaagagactgttgggggaatctatatagatataaaatttagaaaacgaactataaatcagaatatatgaaagttcagttttttctattcttatatgcttttactaccagccaactaattcagaatcttaaactctttcaaagaagtttatgtaattttcaacccattagcatactgccttctggaacactgaagtagagttaagtaaaacaaaactgtcaaaaagatataaaagatataagagcatgtatagtagcagactattagccagctataaacatattttagtgagataaattatgagagagaagagcaacaggctacagccagctgcagtacggactctaaaacacagtgtgtgtatgactgatgagaccatatattaatagtatagtaagcaactattgtataaattgattattaggttaactataggtaaataaaagctagcagtgaactatactattaaactttctctaagtagccgacctcctagtggcccatcatctccatcatcacctctctagaacacacatcccttttgcctttcctcccggatcgaacctatccgttatttaatccgacactgggtaagttttgtcggaatgatacacgaatatacacaacttctagaatatacttcttcgtctcattaaaaaaatattttttagtttttatacaacttttctttttcatttaacttcctgtaattattatttttaattatttgatgataaaatataaataatattttatatgtgattattttaaattttctaataaaacagacgatcgaatgttgaatacataagccatgtttagttctttggccaattttttttaagtatacgaacacatatttgacgtattaaacgtagactaataacaaaacaaattacaaaattcgcatgtaaaccgtgagacaaatttattaagtctaattaatctatcactagcaaatgtttactgtagcaccatattatcaaattatggagcaattaggcttaaaagattcgtctcgcaatttacacgcaatctttgtaattagttattttttattttatatttaatattccatgcatatgtcaaacatttgatatgacatggtgaaaaattttaccaatggatctaaggctgtgtttagttcctttcaaagttgaaaatttaggttaaaattggtacgatgttactgaaaagttatgtgtatacgacaggttgatgagataaaaaaaattaaaagtttggatataaacacaggctaaatagtcctgaatataaagtcccccagaatccgaacgttagccccctctccttttcctgtccaaaaggccatctcctccccaacactgggccgcgccgcatcgtctcccatgccatgccacgccaaagctggacagcgcgctgtaccgtgcgcgcattgtgcgcacaccgtctctctctcccctttccccctgagacagaggacgatgagtcaccacctcaccgccttggcttggctagcactagcagtagcccaacacagcagcgaaggggagaagaaagaaaaataaagccgttggcatgcggacacggcggcgcctcgcccaagggggggggctctcctgcacggtcacgcacgcaccactgtgacacacaaacgctgccacgctgacgaggtgttcagagagaggagagaaaaataaaagaaagaaagggaaaaaaaagggtctcgtctcatggtcggtcggtgtggctggctgatggctgtgctcgccgataaaaaggacaccgaggctcggtgaggttgacagcactgcacttcacagttcacaccaccttccttccttcccgactccccacaccggccggtctccttctcgctgcagggagagagagctcgagctcttctctgctgctgctgctgccatggcgattccgttgctgctgctgctcttgctggccatgtccacaggctcaggtacgtgaggccccagcccaaaacctgcatcctctgcgagaaagggacaagcaaatcgaactcgtgtctgttcagttgttcttgagtttcttgcccatttttgttattaccaccgtgcacgtagttgctcgtaggaatctttgcctggagcaatggctcaatgtttatcttgcaatttcttgcgcatagcctctttcccccttttgttcgtgtgcacagtagaaacatcgaagaggagagattcactccgagcctctgctagctagtgctagatttgaatcaagattgagacatgcatgcattcagttctgaacttttga

SEQ ID NO: 11678 - DNA, 4451 bp, Oryza sativa
  unsure (1)..(4451): unsure at all n locations
nnnnnnnnnnnnnnnnnnnnnnnnnnnnnnnnnnnnnnncagttgttcttgagtttcttgcccatttttgttattaccaccgtgcacgtagttgctcgtaggaatctttgcctggagcaatggctcaatgtttatcttgcaatttcttgcgcatagcctctttcccccttttgttcgtgtgcacagtagaaacatcgaagaggagagattcactccgagcctctgctagctagtgctagatttgaatcagatttgagacatgcatgcattcagttctgaacttttgagctaccgatttgagctaacctgtgttcccgtttggcggcggcggcgagcagatggggcgttctgcgtgtgcaagcccgaccagagcccggcggcgatgcagaaggccatcgactacgcgtgctggcgcggcgccgactgcacccagatcatgcagtccggcgcgtgctaccagccgagcaccatcgtcgcgcactgctcctacgccaccaactcctacttccagaagaacagccccatcggcgccacctgcgacttcggcggcgtcgccaccctcaccaacaccgaccccagctccggcacctgcaagtacccggccaccgctaggtacattcccccaaaaaacctccccttctttcacatccttttttcttgtgttcttgttcagattaatggactatggttaatgtttgtggttagtgagttcttggacctggaaaagaaatgagagtatcttaggcaatctgcagttttggcctgatgctttgcatcaatctagattcttttatgtgagcacgcacggccgtactgactgcagttagatttgtttaatttaccgagaactcactgatctagaagagtatatactgtttctgcgtctaccaatacgtatattcagagccgtgtatcatgctgcgagttgcaaatttgcaagttggcagcgccgaacctggaataatatactagttgaaagttgaaacaatgttcggtactaccaaaaggttgcatctttccatgcaaaagtagtgttacttgtagttcatagctggtttgctgctttgcatatggttcttgtccatgtgaaattaaaaggcattcttaacggatcttctaatcggagcttaaagcaacgtcttttgtggatgaaagcggcttgccggggtctgccggccgccgcgctaccctatctcaaagtacattgcacctacacaccagctcatcagtatctgcatatacactccactcagactacctttcttcagtctaagcatgtccagaattttcagtgcacaatgtcttcaagaatttataaaggaggtttcttactttctttgctcactactacgtctgattttttgtgtgcagcggcgtaggcaccggaatgggaaccggaaccagcaccggcactggcactggagttggcaccggcggcaccggcactggtggcgcaggcgtcggcgcaggcaccggcacaggcgttggcacaggaaccggcaccggcgcaggcatgggcaccggtgctggtgccggcaccgggatcacgaccccgggatcgaccaccggcactcagggaggcgccctgagcccaccgtttggcggcgcatatggcccgtcggccggcgccatgaaccccgactacaacgaggccgcgccggcgcgctcccagctggccgccgccacctccgtcctcctcgccgccgcaccattcctgttccatctcatctagagccacacaagggggcagtggattccgtctcgtcggtggtgggggcgcacggcgccggccggagtttggtgggcattgcaatgcagcggcgttgccggcgttggtgctttgtctcgcccgcgctttccggcctgtgccgccacccctgctggttttgatcgatcatcagtgtattcagtagtggtactgggagtactccttcagtagtagcctactctctctgttattcaactgacgaactcttctccctcgtgtgccggtgactacccatcataccatgtggtgtgttgtttgtaccggtgcaaatgcgtaggtgaagagagatctagagatattctttcgtggtagtagcagtttgtgtgtgtttcggacatatctgtgttactgttcaccgtgtgtcgtgttttttatgctgctactagtactaatagtagttggtggtggccgcttttctagcttgttactcctcagtgcgtaccatgctaatatgttgggactcctcgttgtgaactcgtgctgctcccctgcgccgtcacgtgctctgcaccgcgctacgacgctgcgtcgcacgcctggggctcaggcgagcacatggacggtttgcacggacgtggtaggagcagcatccgatctgggagatgtgttgggtgcagtggtctggttcgatctggaggagtattttgtctcgcgagctttcgggagacgtggggttccatcgcggtgcgtgtgccgcgcgaaacatgccgacacggcgagaccgacacattggcctcgcgaggtggtggtgatctcttcgggactcggtgcggtgcgggaccaggccagatgcgcgcggtggcgactggatgcgtagacccggtgaccggcccatggctccgcgcagcccacgacgtcgcccgctgatggcatgggctcctcctcgcctcgcgatgtgcggctcggacaccggaaaactcgttccggcctgtcgctgcaatgggacgcgctccgcttgatgatagtcgagtctaacattcgttcctaaaccgaaatatcaggtgtatcccatcctcccactcactataccatgcctaagtgttagctttggtccctcgacagtatagtgaccggttttggctccctcctctccctctccttcttccctctcttccccatctctcagactctcaagcgtgcctcggacatcgtggccctgctcatcatcatcacctcgtcggcatcctccacctccaccgacctcgctgcccttctcgtgctcaagggcgtcatcccccacgaccacgactctgttctcaccacctagtcctcctccaccaccaactactaccttaggcgtggtgttccctgtcaccccaactacgccgcggtcgccgccatctacctccccatggactccctctttggcgccctccaggccttcctgcccccgcaccttcaccgcctcgaccaatccagtaacttattcgagctcatccctgccgtctttcttgcctccccgacaatttgctacctcaacctcttcagccacctcttagggcctctccccgctgcatgtcggagccagtcactcacctacctccgcctctccgccgccaatgttgtcaccgtccgaaatctccagggctcgtgcaatgccgctccctcggcctcatcaacctatcccacaacgtccatgaggggtccatcccttgctccctcgctatactcgccaccctccgtgtcctcgacgtccctcgcaacagcctcaccgacaggatccccacacacctcatcgcctatcaaaacctcgtcgtgctcctgctcacgaacatcatcgccaaatcacagagggaacaaccaaagttcaacgcctctccctcttccctctcttgccttgtcgttcctttccacacgcacacagtgtcgtcaagctcaagctcaatatacttgtggtcatcgtcgacgcgtcgtcacctccattcaccgatggccccagctgacgtcatatcccctcttgtcgggcatcctctagtagctgtggactgtcgtggcccctacttcgctgttgcgcgccgctggagcccccttcttgccggccgcctcgctccagggagaggggcaagagggaacgagttggtcgctaacatgtggggcccactcgcctcgttagtcaaaaccagccattatattgctgagagaacaaggttgacacgatagtgttagtagggaatgagctatacctggtattttgattcttgaatgaatttcagactcaacgacaaattgtgagggaataagttcaccagccgtccctccactttacgtcgagtctgtctgaggcccctaatctccaataccaaaaatcttcacccctaaactatataaaactgtgcaatttaggtcctatagcagtatggatctctggtttcgctgacgtggcatcctagtcagcaaaataaataataaaaatatatagggctcacatgtaagtgatatgaaaaaagtgggatccacatatcttttttcttctctcttttctttttctctcttctcctcttctcttcaatgaaggaggccgccgatgggcggagcagcgacgggtgagcgcaaatgtgggtggcggtctgagcgctggcgggcctgcaaggccagcagcaggcgagcgcgacagcggtcagcgggcggagggcggcgagcggcaggcggagcggcggcggatagagcagcggtgggcggggta

SEQ ID NO: 11679 - DNA, 753 bp, Oryza sativa
  unsure (1)..(753): unsure at all n locations
nnnnnnnnnnnnnnnnnnnnnnnnnnnnnnnnnnnnnnnnnnnnnnnnnnnnnnnnnnnnnnctttgaatcgtaggaatgaaaaaacagaggattctggcaggaatacaattgtaaaacagaggattgtgaaacacaggaaaaacacaggaatgaccatttgattggaccagaggaaaaacgcaggaatcagatgagagagatagactcagaggaaattttccaagaggttagacctcttgctaactttcctccaaaatatacataggattacccattccataggaattttaaaggattggatatgattcaatcctttgtttcaaagcccttcataggattttttttccataggattgaaatcctccaaaattcctacatttttcctacaaatcaaaggggccctaaacctacaagagaacaaagactgtaaaaatgtattgaaattcacattctaacaatggaaaattaatggatatgttcatcccattggccagatgtaacgaatcttacatatatccttgaaaaatggaataaatcaaatacccactcactttgtctagaaattgaacccccatgactaattatgcccgattgtgttggttcattgatgcttctggtcaactgagtggagaaatcaacaaatcagttttcacagttaaaaaagaataacacaatgcaagcatacaaataggtatacaagagtttgcaactttatttaactataatctacattctgcaatttctaccaaaa

SEQ ID NO: 11680 - DNA, 96 bp, Oryza sativa
catacccccattaccctctcctcgtcagcaaggaggagggcctgttggtcggccatggtctcgaggcggtccacggctccaacatcgtcgggggcc

SEQ ID NO: 11681 - DNA, 2884 bp, Oryza sativa
agtggactgccgccatgaacttcaccaacgcgggcctccctaggaccgcgttgtagggcagactgaggtccgccacatcaaagttcacccgctccgtgcgaaagttggcggatccaccgaaggtgaccgggaggtcgatatgacctagcggccaagtgtgatccggcgtcacaccgataatcggctgggacgggcggagcaccatccccggggccttgatagcgtcaaaggctgcggggaaaaagatgttgagggctgctcccccatcaatgaggacacgccccagcttcacgttgcaaaaagtgggggaaacctccattgcgatctgtcctccccgggcaacgcacggtgggtggtcggtctggtcgaaggtgagggcaacctccgaccaccgcgcccggcgcgtcgcctcatgagtaggggccccggccagaagctctcgcttcatggccttgaggctccggcgagaaacgtgagcacacgctcccccatcgacagtggcaatggtggccccaggctcttggaaacctaggtcatcatcgccgtcatcgatgaccttaacgggggccttctgtttggcctcacttcggcgattgccggaaggaaccgccggggacttgccctctggcgctctgcctcctctcctcctcccatttcctcgtccgctcagccaaacttttgactgcgcggcagtccgcgaggtcgtgaagggaagtgttgtggacgatgcaccacttgccggttgggcgctcccagagcgccggcctccttctttttgtcgcccgcaggcctcccctttcgggtggcccgcgaagcgccctcgacggcgaggacatgaccctcgtcgtcggtatgggctgacctcttcttcctcctcctgtcacgccgccctgtctgagcagcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcagttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatatgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccagaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacgacaggcgggtgacgcaggagcgcgcccgcagcttggagcgcgccctggggcgtgctgccgtcgccgtagacgaggaggcgacgctccccatctcggcgcccttctccatcacccgtggatgtcgaagtcgcggatccttcgatcctctcgagcacctcctccctcctaggactttggtgtggagggggcggtggagtacgagctcgacggcgtgggtttggctccccgtcgtcaccgctaacactcggagagaggttgtgcacctttgcttgttcagccattgggctgaacaggaaaagcttggcgcacacgaaagagtgcgagagcttagaaaaacactcgcagagccccctacctggcgcgccagatgacggagcttggggctcctcaccgggagaccgcgcaggcctccctttgccggttcggccgggggccctgggtgaggttctaagctcttggtctgtggaaagttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttcctttttttcttctctctaagtgggcaaggtcctccttttatatctcaaggggataccacatgcaccatctctccctctctttcttttgtgtggggactcatcctctcttccctccaacttgacttctcttcattaatggacagagatttgtatggctgccgtcccaatgaccttctgatgggacgacccatacctacctccacttccgccggaagcaggcgcgacgtgggaacatggctatctgctgacgacatgaccattgtcagaccggtcacaaatcggtcattcttgtccaccacgtgtcagtttaacaatctgcatgttcgcccttcttcatacaatatcttgcctgtaatggttaggatgaagcctgacatacatctgactggaaccaacg

SEQ ID NO: 11682 - DNA, 790 bp, Oryza sativa
  unsure (1)..(790): unsure at all n locations
agtgctattctactacagcatcttagggggagcttggccgggccttggctccgctgctggtcacttgcatgcttatagtgtcgtatggcgggatgttaagaacaatcacataaaatatattgaacaaccaggatgttttggaatggaaaattttaaagcatggcctggattgttgtttcactttccctagtaaaaatatactatatttaacttttatagttcaactttgaaaaccttgtctaataatatattcaaatatattatatataggagggagtacgagagaccaagaccgttgattttaccgtcgtatgaggcttggttgattttcccgtcgtatgagatagcttttttggtcgtgggggacatatgccccctccccgttctctcgagtgagaattggagagcatcaccatggaactcaacaagttgaggtgttacgctgccatggtcaccatattgaaacaagttgaggtaccacgttgccacgatcaccatattggagtgtactactccaatgttgtactccatcattcacaaatttttggaatacaactttgatgatcaatttttctttaaatattctgatccaactttcaaaaataatatggttagatttatattaaataaaattttaaaatattataataaaacaagtgcattggtgaccgtgtagttgtctaaaacattacttattttgtgacaggaggtactattaaccattnnnnnnnnnnnnnnnnnnnnnnnnnnnnnnnnnnnnnnnnnnnnnnnnnnnnnnnnnnnnnnnnnn

SEQ ID NO: 11683 - DNA, 585 bp, Oryza sativa
  unsure (1)..(585): unsure at all n locations
tctacccaaatcaaagtgtcgcattgctcatcctcctaacaaaaaaatagtactattatttagacatgcatgactaaattaacagaaaatctaagtatcaatgaactagtaaaaagtacaacaaaccaaacctcaggaaggcaaccaagaaatctccttccggtgtcagttccttcccatgcagtcctcctttttggtcacatgccatgtctgcacttcgaatttgtgccatgttcctccctgcaatactcatcatcgatgtataaaggaacattcaacaataggccaaacctgtcctgctatatcggaaacaaaaggattaaaccaaatagcgggacttacccacctgagctataacccatactagaaaatacgcgcgccgtttggcgtgcttaatatctaaaccgttggttactttgtgtatgtataaaacatgatttataaatgttggtttttagtatgtgagcatgaagaataagtttaacataggcttatatatatcggaaaatagttatatataaaaaaatannnnnnnnnnnnnnnnnnnnnnnnnnnnnnnnnnnnnnnnnnnnnnnnnnnnnnnnn

SEQ ID NO: 11684 - DNA, 366 bp, Oryza sativa
  unsure (1)..(366): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataggaagacgcgctggtctctttcctgcgggcaaacgctgacgtcttcgcatggagaccggcggatatgcccggggtccccagggaggtgattgagcaccgtctcgccgtgcggtcgggcgcaaggccggtccggcagaaagt

SEQ ID NO: 11685 - DNA, 621 bp, Oryza sativa
  unsure (1)..(621): unsure at all n locations
nnnnnnnnnnnnnnnnnnnnnnnnnnnnnnnnnnnnnnnnnnnnnnnnnnnnnnnnntagtatcttgttgagcggcgtgctcgagacatctggccatgttttatggtcgtaattatccaactaaaatgcgactgaatggtgggctgtggatgcatggttttgcgagtgcacccatagcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttaacttggtgtggatggttaggggagggttatgcaaagggtttcgtcacaatcactcaacatggtgacgtgtgcatcatgggcacatgatgacaccgtgacatgtccgtgggttgtgtcttgtgggtacagttgtgcacctctggccagagtaaaactattcaatagccgtgcccgcggttttgggccatcgaccagattcaccgtgattagtc

SEQ ID NO: 11686 - DNA, 4477 bp, Oryza sativa
aatttacttgattgtttcgtcctgacaaatctgcatgcttttggtcaacaaacctaggattacttgacattgactcatataaaccttagcttcttctcttctgtgatgtcacattctttttggggtggctgttgtttgttgtagctgattgtagatgctatttaatacttctgatggttgtcatattccatatattctcttcatgttacttttttgttcatgcttatttattttctttatttttggatgtttgctgatgcatattaattaatggaatgctaacttcatttcaggagcttgagaagttaacacaaaagttcagtgaaaatgtgctggatgcaactaagaaatttgagaaattaattactgataagaatgaaattgatgggttacctgccacagcacttggcttagcagcacagactgccgcgtcaaaggtatataagctataaacaccattattgaagcttaaaagttctctcttgattcatcacactgacaagccattttgttagggtcatgaaaatgcttcggctgaaaacggaccatggatcatcacattggatgcgccaagctatattgctgttatgcagcatgcacggaacagagcacttcgtgaagaagtttatcgtgcttacctaacccgtgcctctagtggcgaccttgataacaccaatatcatcagtcaaattctaaagttgaggctggagaaggctaagctactcggctacaagaactatgctgaggtgcttgcatttgtcactgtttccacattaaaatcatgtatacaattatctaacttttctaaactagttttaaatcctgaaggtaagcatggctcagaaaatggcaactgttgaccgtgtagaagagcttcttgagaaactccgtgctgcctcctgggatcatgctgttaaaggtagccaatcaaattattgagtatcttctttgtatttctcttgtgttatttatgtatcatctttgttttcatacatacctgtcttagtgtgagcaaatttttgtggcatattctataaggagtaggcatcttttgaggttcgaatatcttagctgttggtttctgtgtgcagatatggaagatctaaaagcctttgctaaagagtctgcttctccagaagccaatgacctggctcactgggacctaagcttctggagtgaacgactccgggaatctaaatatgatatcaacgaggttctttctttgctctctagaaatgtttaatggatttcttatgatcagtactgttttgatggctaaactgtgatgggttactgcttttgtccatatatacgttgagctgaactctattaaatgtgctcctgttgcgatgatgggccattgagttgatttctagcattgctactgcaggaagatttgagtccttactttgcactacccaaggttatggatggcctcttcagtctcgcaaataggctctttggtgttagcgtagagcctgcagatggactggctcctgtaagcagttgttttcttttcttcagcccactatatgttaatgttctgcagctattgaccactgagttacctttttcaggtttggaatagtgatgtcaaattttactgcgtcaaagattcttcgaatagccctgttgattatttctacttcgatccatattcaagaccatctgagaagcgtggaggggcttggatgaatgtggttttttctcgcagtcgtgtgcttgctcgcaatggttcacctgtcaggcttcctgttgcccatatggtgtgtaatcagaccccaccagttggtgataaacccagtcttatgaccttccgtgaggtaagcaataataaatatggcaatggtaaattattccagatagtctccaatgtatgagtattctgttacatcaatatgtggaaaactgtacactaaagtactgatgagagcatcagtaattatcaaattcacctgaagattgtgacacacctgcttccatatcaattaagtagtgctatactgattatgagggtaatttcttttttttttggcatgtgtcttttgtaggttgaaactgtgttccatgaatgcggtcatgcgctgcagcacatgcttaccaaacaagatgaaggatttgtttctggtattcgtggagtagaatgggatgctgtagagctgccctctcagttcatggagaactggtgctaccacaagtaagatggatctgtatcattttgtttttttaacttgtagccttgaacctgtttgttaaacagttgttttgttggtgccaggaatactcttttgagcattgcaaagcattatgaaacaggcgaacttcttccagaggaaatttatgcaaagcttgtcgctgcaaagaatttccgtgctggcaccttcagtttacgtcaggtatgttttatattttatttttgtctgtattgtgtataggtcatggtcacatacacacatcacactaatatctaacaagtgtatgaagtaatttatgcttcctttatgcctatgttctttctaaatggctaatccttgccatcccttctgcagatacgttttgctagtgtggacatggagctgcatacgacttacgatccaaatggttcattgtccatatatgatgtcgaccgaagagttgctgagcgaacacaggttcttgctcctcttccggaggataaattcctgtgcagctttagccatatatttgcaggtttgcaatgctttaacctacatgtacattcattcatttatttgactgcagatctcactattttttttattgacaatctgcaggaggctatgcagctggatactacagttacaaggtatattgctgtaaacgtttaaaacattacgttccttctgtggcatatgagtatgctgaaactagtatcttttctatgtgcacagtgggctgaagtattgtcagctgatgcattctcagcatttgaagacgttggtttggacaatgagaaggtacagtttttcttgttttcccccatccagggaggtgctctggatgtgtcaaaatgacttgtttagtagtcattttcttaacttaatttgtttatttggccaaacgtatattttgccctacaaaacaatgtgtggcacatagaatacagaaaggatataaaaatcaatgatattgactctagctatgactttatctaggcaattgaggaaactggcagacgattcagagaaacagtccttgcgcttggaggtggaaaatctccactcgaggtaggcttctggtgcctttgacagcatctcttgacatggatgctttatttgtgcaataagcgtatgtaaagggcatagtttgcactaacttatgtggaataagacgacgtacgctaactctggaaatgaaaatgcaggtgtttgtgtctttccgcggacgggagccatcaccggaagctctgctcaggcacaacggcttgctacctgttgctgcattgtgataactcatgctcgattgtccccttcttttttcttttaacttgcgaaaacggcttgtaagatgttattgattgatggcatatcagcaacacgctaaaagtgccgtgtcctgcttacaacatgaaaaacaagttgctgtgcacaaccattatataatgatcatcgctgcttcttgccgttcactccgttgtttctctctttaacattgtggtcttacacgatacagatttacaacaatgaactaatacgtttcttgatttatgaggcacatatcccaccggaagagtcactgaatcgtactccctccatccacaagagctgtacgtataatgtttgtataatgtttcttagtttttccacaagagttgaacttattttgtttgtgcctcgatgaataaatggatcggaggagttagtgttctccttggtcatagtgaaaaaagagttatacgtacaactctcatggatggacggatgagctcagcgtctcagtcgaatctaaaaattgacggaggaagctgagagacggacgggagtcagtggtgggcgagcatccgctccagctgctcggcgacgtctatgatccacgcctcgtgcgaccggtcgccggcgacgaactctctggcgacgccgtccacctccaccatgctgcaccctggcaccttgaccaccttcctctcctccatccccctccgcacgcccaccacctcctcccacttcccccgccccgcgtacaggttcgacagctgcacctgcaccccgctgcggtcgtccagccccagctccgccatcatcgccgccacctcctccccgccctccgtgtccccgcgcgccacgcacgcgttcagcagcgcccccagcacgtacgagtcgggcctcatcggcatcctccgcaccacctccagggcctcctccaccatccccgcccgccccagcacgtccaccatgctgccgtagtgctccacgccggcctccatgccgtgcaccgccgacatgctccccaagatctccct

SEQ ID NO: 11687 - DNA, 6365 bp, Oryza sativa
ccgccctgttggggcgcacgcgggccctgagcatctcctggaacacgtcgacggcctccgcgaagctcccggcgccgacgtaggcgctgaggatggcggcccaggcgatggtggttttgtggggcattgcgtcgaacagggcgcgcgcgtggtggaggcgggcggccctgccgtaggcggtgaggagcgaggtccaggagcagacgtccctgcaggagacgttgacatcgaagacgcggcgggcggagcagaggagggcgcaggaggcgtaggcgtggatgaggccgttggagacgtaggcgtgggcgtcgcaggcgacgaggatggcgagggcgtggagcgattctacgaggacgcgcggcgaggcggcgtggggaagaggagcgagggaggcggaggcggtgaggaggaaggagaaggtgtaggcgttggggaagaagggattggtagcgatgatgcggcggaggcgcgggaagaggcggagggcgcgcagcggggagtgggagtgggagggcgggaggagggagcggaggagcgagttggggaagaagcggtcggctaggagcgaggagacgaccaggtgggcgtgggcctgccggagctgcgcggcggtcagccaagggcgggacagtagcagatgcagtgccgccggcggcgccaccatccagaccgagccagagccagcaaacaagcagctcccctgctccaggtcgaaggaaaggaaatgaaagtagtgggggaaaagaaaaactgggccgaatttgttcaagctcatgtgcgtgggctaactcatgcatgccggcccagcccaacagatgccactcggagttgcgggagaatgaagatgaggaggggacgacaccagcacgtcacgtcacgagcagcagcggcggcggcggcgaggaggagtagagtaggtgaggtgaatcgggggagggaggaatccaagaagaagcaggtaattaatcgatcgatcgggagggggagatggctcgcgcgggcgggcatgggatggggaacccggtgaacgtggggatcgcggtgcaggcggactgggagaaccgcgagttcatctccaacatctccctcaacgtccgtcgcctcttcgacttcctcctccgattcggtccgttttttctcttcctacctcttcctccttatccttcccataattcctccatggacctgcactggattcacatttatttctgcttcctctactcaggcatagccacatttctctggatctgcattaccctttttcctttctactactagatctgccttgctccttccctaactgggcttccacatttccattagtcttggcgacacagctatgcatatgcaccaaccaaaatttcatttccactctccctgccttccacaaatgtgctctacctcacccatgtacactagtaccatcaactctaaacccattctgcctcccttctaatctgaacttgtttctgccattgtcaacacagtatctataaatcaagcctttcttctgcccttccaacagctgccagcgtcacaccaaacaaactaacttaagcatattcggaaattcagttcagtaacggtgttactggatatagacctttaattgttcttaaatcttttctacgatatgaattctctggactataagcttattaaatcaacgttagttaagcttccattgacaagacagcatatttcctgttggccagccaactactccagtgactatgttctagtcagtctgatttgcacaattgtcattatctaaaattttgcataattgtggagtagttgttacttggaaaggagggattggcttggtgcttttccaagccctgtatgcttcttattatgtccattaaaccactgtcaaaaacaaagcttgaaagataccttgaacattactgtgcagaatatatgtgttctgtactttgccctccgtgtatacatttagtccagaatgcatattgaaccttttcaatatggtccggattaaggcactggtaactatcataccttccatttttgctccaaacaagatgcattcacaacataatcgctccatgttgattaggaactcgagcatgtcagcaaaacagagtggactgggggtagcatatcttatgcatgcatgtttattcaagttaactaatatgcttacacaggtttgtatgcatttgtgcagaagctactacgaagagcaaacttgcgtccttgaatgagaagctggacatcctagagcggaaactggaggtgcttgaggttcaagtgagcagcgcaacaaccaatccatccgttttcaactagtaagtgcagttaagggctgcttgtctgcacataagtagtgctttcaatgtgttatgggttcaaaaggacagagctttggatgtctgtattgtgggtgcaagaggagaggttgttcctgtgtgtttctctgtctgtgtgtgtgtgtgtgtgtgtgtgtgtgttaatctgtatgcagtgccagtagcgtgcaaggcagcttcttttctactcaattccatgtacaattgtaacgtgttccaagtttgtgtggagataactaaccgattgttgagtgcaaacctgcaatgttgcctgcttgcttgttggaatgtggagtttttcccttgtaaaactgtaactttttaggggaatattgcacgtttgcacgcagtcggacaaacgccggcccgaattttttatttatggtaattattatccttgaaattaaataagtagtaaatcatggaggggatttaggaaaatagaatggacgttatctactaggacatccagtgatggacgctgctgggaacaacgtccgagtgtggacgctcttcctaaccacgtcctcccatggtgcagcctagcagcttcttcctgtatgtcttgactgccgcggtgcttccttaccgcactaacgctgcctctagtgatttgggcaggcagccatccaggggtgtggcgtgtgcccttctcatatgctcgcgtcagggataggtaatggcgctgcagccttttcaaatgtacaggggtaagacaatcgatcgccatccacctcaagatttcaagaagagctacgttacttgtagaagccagcgttatgtgtggcacacttacactcggtgatgacatccccttcccccaatctcctccattttgtaggcgccctcgatagattttcgtttttcttattccaaagtgaatccattagcaagattcgtatatacgtatatgttcatgtgctgcaaaactaaagcagatcaactgactatttgtctattatgcacccctattacatgactaaacattaacttgtatgaaacatgtgttcctagctatatatgtccgcatggatgctattgtcaggttttcttactacatgttagtttggtattttaatttggtttacgacacccgtgctgctccaaatggcacatcatcattgttcatgataagccgatcgatgagcatagtcgcttggagtgatggagcgaggacagcgctgccgcgatgaattgatagaaggagaggagagcttggacctcaccgagaaagcccacgactggtctcgccaggccacaccgccggagacacaagggatgtgacgaaaaacaacgagggcggctagttgcggcaagcctcagcggcgtactgagactataaaggtcacgatttgaacgagagaggaattacgaggactgctgtaggcagcgaagcaagcccaagcttatacgagagtctagctagtcggcgatggagcagcatgcaggtcgtggacgccgttacaaagagcgtcctcagctggacgttgttgtgaacaacgtccatacatggacgtttcacaaaacagcgtccttcttattttcataaatatcagtttccatttactaagtatttaattctgagactattaattactatagtaaacaaatcgggacgccggcactgaccgaacggttggtgtctctaaaatgtgtatgatcagcctgttaagtaatccacactttttttttcttttcccttgaaggagagcaatttcttatttggggaatggcgctattatcatttgaatatatacagcaaaaatcgggaccataaaaccaaaataagagaaaaaaaagggtaaagaaatcctggaaggaatttattgggaaaaaaaatgtggtgctggtgtttcatccgtcttgacaaccacataagagaagccggtctctcgctgtctgccctgtgtctcgctagggacctcacaaaatgaggagtggtagaatagttggagcccacaggccgcttctcttctcttctcctgcttctgcttctgcttctgctgcttcttctattcgaacttaccttcctcttgctcagatcttcttaatcttccttcttctctcatctttcgtattcaaagctgtaaatgactgcaggccgaaggtaggatccagcaatattttgctccgatcctcgcaacatatattcttgtttcaaaggtaattaattcgttgcgattgtttcttaattactccattaatttccagatactatatacatgcttgcttgctcggggatcaatataatattccattatatatgtttgaaagagggagttctctctcgctcgcttaattttgttgttgatgcagttgctcatcaatgaatgaatcaatcaatgggaaaatgaatgagttattcgcagtggcaggtagggcgggggtggcgatgatgaatatggtgtcgagcagcagcatccaaccggggcagatacatagcatatggcagcgacgacaaggaggtgagagtagagggagatatgtggtgatgagcagcggcagcgtcaggaagagcagcagcagcaggaggagggtggtggcggttatccgggccgtgggcgacggcgcaggtgaatcgacgagcggcaaggacgaggaggaggaggagaagaggcgtcgggaggagctggagcggttggtgggtggaccggaggacgcgacgttcagcggggcggacctggcggcgctgataaggagcaagtacgggaggtcgtacgacgtgacgctgataaagaaggagttcatggggcggaacctgctggccatgaacgtcatgtggaagtaccgggagcagcggtccttcccgctgacggaggaggagtacctgctccgcctcgacgacgtcgccgcctccctccgctgctggggcgccgtcgcccacgtccgctcctccctcgccaagctcaaggaccgcccccgcatcggcaaggccgtcagcatcttcatcgacatgcccaccgacgactccggcgcccgctccaacgagtggatctacaaataatataatcccttctatttatttatttatacttcatcgccatctcgaattctcgatggatcgatcgttaattagctaccttgctccttaattccttcatgtatttgcttcagcttcagctcaacgatcgatcacacattcacactcttggaattgtatgtacggccacttattaattacctcaagattcatcctctctgcattgtcttgtgctgcttcttgctagcttcagctccaccgacaccgatcgttaattatgctcgatcctctacttatttgcttcggctcgacgtaccatcactctctcgctcctcaatacattagtatgtacttcaacttgatcactgatgatgcctcgtgttatcttcttcatcctcggctcttcctccagtgctcaggtagagtaggacgtagatgcgccgctggattgttcacagcaaatatgcgccgttcgatctgtcacttgactatctatcacgggaaggcccagtttcggcccagtgagttacttgtgtttgtggactaaactgcaggtccatttgaggcccaactagctagtctaaaccctccaactctctcgtctctcccctgcaccatcgaacaagagagacaaaccccttccttccgccaatggccgccgccgccgcccttcgccggagcctcgctgctggccccgccccggccctcctcctccgccgccaactcctcatgcgcttcctctccacccagacacagtcacagacgcaaacccccgccgacctcgccaccctcaagaactccattcgcagcgccgcccacaccccggaagccctcgccgacctcttcatctccggcctctcccacccggccttcctcgccgaccgccccatctttaccctctccgtccaccgcctcgcctctgccggccgccgcgacctcgtcacctccatcctctcctcctccctcacctccctccccgcaccccacccctccgagggcttcctcatccgcctcatctccctctactccaccaccggcatgcccgaccactc

SEQ ID NO: 11688 - DNA, 20112 bp, Oryza sativa
  unsure (1)..(20112): unsure at all n locations
ccttccgcactctccccgccgagctcggcatcaagcccagcgtcgtctctcacaacgtccttctcaagtcctttgttgccagtggcgacctcgcctccgcccgcgccctgttcgatgaaatgccttccaaggctgacgtcgagccagacattgtctcctgcaacgagatcctcaagggctacctcaacgcggccgattacgccgcctttgatcaattcctcaaggataacaccactgccgcgggtggcaagaggcgactcaagcccaacgtgagcacctacaacctccgcatggcttcgctgtgctccaaagggaggagctttgaggctgccgagctgctggatgctatggaggcaaagggcgtcccacccaaccgtgggagcttcaacaccgtcatccaggggctctgcaaggagggggaggtgggtgctgccgtcgcgatattcaagaggatgccagaggtgccgaggccgaacggaaagggggtgctgcccaactctgagacctacattatgttgcttgaggggctagtcaacaagggtgtgtttgctcctgcattggaggtgttcaaggaatgcctgcagaacaagtgggcgccgccgttccaagctgtacaaggactgatcaaaggattgctcaagagcaggaaggccaaacatgccaaggaggttgccatggcgatgaggaaagttgtcaagggtgacgccaaggaggagtggaagaaggttgaggctgaattttcgttcgagcctactgataagaaagcctaactgctaggaatgatggatggcacaatcagaatgtcagttagacgattattttacacttcaaatccattgtctgattgcatgtcttttgtgcgcttgtggccaactctatctagcctttcgttccgtttagcgcataagattattttccatatgaggtatttgcatttcgaacaaatacaggtactactctttggtggtttaccgtgtagaccatgtaacttgaatgatcacatatgatgcaactctttccagttccttatcttaatttatctcaaacttggtacatttcaatcctctatatctttatgtgaataacccaaaaaataatacagattagtcatcatcatcactgttataattgttggatgaagatgctctatgtactgttttctgtttggttactccatctgcttgcctgaacaatgatgttacagaatgtggtgttgtattaatctgccgtctggatgtgcaagtttgttatgttgtacgaattgttttcaccagctgaattacaagatgctattctgagaagagtcgagcataattgtgaacataagggacaagttcagcttgacgatcgtgtgacatgactttggctgtatctgtatggagtgctgaggttcttcaggttattgcattggttggcaggcaccctttaccgacttattaccagttatagtccctcaagttgagaactgacatgaatgagtgatactgaagttgcatcttgcagccggtcgggtgcgtccaactgtgctgattggattgcagaggtgcctgctactgctgatgttggtgggagtctacgtttgaagtggataacatcgagccactggtaagtgtctcctttttttcccttttcatgtgtcttcactattggcatgctcattgttcatatgggatagaatatcttgtatgcatatactttttttttttggctggttgtaggttgttatcatataatttcatgttatgtttgcaagtcgcttcttgccaatgctaaattgctcgtgctgaccatcatgttccatattaagttgttgtgtcgggcatcgtcggcaagctctcacttgctcgtgctacaaaatacagagagacagcgtgacagtggctcgtcgcagcaggtactctgcattccctgtgtgctgcctatatgaccactgggtgtcaaatcttgctgttgcttttctttcatttctctgcatctttcctttgcctgctttcttagtttcctccaataatggatatggagtattaggagcaagtatttatatggctttgacaataacctgcacgtcacattattatcttgtttttgtcttcttttgagccgtcttttgtgtggctgtggttcaatttctccactattctctcagacaaatacctattgtagagtaagttattttacccctaataataaaatcatttattgacctaaccacctttgaacctgccatactatatacatacaactgttttagagtgatgtcactgctgtctcaaaaggtagtcaaaatcttaattagacttgtgtcgtatcaagccagaaagaggcttttaattacagtatactataagggtttactaagaaacagactttgataaaagcacaccatccaaccttattgtcttcaatacgcataaataaataaatataatagatgcagtgagttttcgattcaaattcaaatgctcttaattgaaggaacgtattggcattattacattgcaaagtaaagacaattaagcagaatcaatctaagtatatccagcgctaaaaagaaagggaaggaaactaagataagttgtggtgttggtcaccggctgcggccttggccttggcctggagaggaggatgatcgtggtgggcaatgccctccacggcgcgcagcagcgcgtcgatcctggtggtgcctgtcccaggcgaaggaggagcagcggcaggaggaggaggaacgtgggcgttgccggtggcgttgaaggcgacccgatcggcggcggcgcggacgaggtcgtcggcacgatcgcaggaggcatagaaggcgtcgatgcggttcttgaggtcctggatggcccccgtggtgcggacgggctcggcgatgaaggcggccacggcgtccaggagggcgtcgtactccgcttccatcgagtccaccgcgctgtccatggcgtggcggcggcctcgatctctcgctcgcgtgcacaacacaatcacaatgcaccaaggaattgaaggaagaagcagagggctccttcctcttcgtgttcgatcttctctttaatctgttattacttctattattactacgttggttttatagatatatacacgtattacgtagtaacaaaccgcctctctctctgcatctccacccaccccgactccgtcgattcggtctcccttacccttttctagtaggatgggaagagatcgatcaacatacatacgtaggagtaatatgcaggtaccacacatacatacatgtcaaaaaaccttaacaaactgtcacatactctttcgtttcataataaatttatttttttgactccttccatttatcctaaaataagtttattttaagtaatcatcattgtatcaaaatttgtgaaagtaatataagaaataattatattagaagtacataaaacgaagaataattatattgggatgggataaagtatgaattttctggggtttttcttatgttagtatatgtgtgggatgtgtgaaaaatgaacttatctttatgacagaggagtacaatataaccatatactcctcctatataattaactttggtcatcaacattttattatgaaaatacatatatttcaattgcatatacaaaatcatgtagtacatatacagtgtcttgacaaatatttacatagtattttaatcttatcaacacttcgaaatatatgtatagcaaaaaaagcaatttaccttatttaaagactgtatatatgccttaataaaaatatattatagtactcctccgttctaaattagatgtcgttttgatttttttttataatgtttgatcattcatcttatttaaaaattagtgcaaatataaaaataataagtcatacttaaagttttttttataataataaagcaagtcacaaataaaataaataataatttcatgatcttttgaataagatgaatggtcaaatgttacaaacaaaaaaattattttagaatggaggtagtaatatgttttcgtgattgatgaacttcattgagactcaaattcatttttgtttctgaaaagagaaaaagaaaaatctttctgttgttcacaaagaaatcagtaaaacagtcgtagcattgggggtcggggtcttttgcaggcttgcaggttgaggagcactagacgctgtggagtggagggaggcnnanatggcggaacagtagccaccatgagctcctcccactcccatgctcatggcggcctcctccccacctcccgccgccgctagcagcagcgggcgactcgccagggtgcgcctccacgacctggcgccctacgatggcgccgcgacccccgcctacggccgcgccgtccatgccctctccgcctccctcacccgccacggcgccgccctcctcgacctccccgacgcccacgccgccatcctccgctgcgccctccaatccgctcgcgccttcttccgcgccaacgaccaacccgccttctacctctaccgcgcagggggcagcgcaaggtttaggaattctctcttctgccttccattctgaatttctcaatctcaatcgctctcctctgaatcgcagtaggacatccgatgacggcggcggcgacctggtccctgcttgcatggacgacgccttcaggtgtttcggtgaggctgcccgcgctgctctctctgcgattgctcgccatctccgacttcgtaccaagtaagtacaaatacaatgcaatgcctgtttttttaatcccttcatctatgactagtaacatcttgctcttcacacttactcacaattgagttggtctctatacattttccagtgtattcgaccacttgctcgatgatactccattgcctgttaatgaggtctcatcctcggagttgctggtggcttattccaaccaacacctccacaccgatcatgcttcttctactgcctgtctcggctcttcagtgcctcaagttgacaggggcttccttgtgctcattgcttctgatcatccaggaattgaggtatccatgtaacaactgtgcaaagttcaattttttttaacctttattggttttagttttccttgaaatacattactgttttcttagtttatttatgctttttagctcatcttttctccctgctattctggtcgacacatttcagttttattcagtgaattagcctataagtgctgcctggcctctagttcacattgtttagctacttctctggtaggtttgtgacccaaatggccaatggtacctagcagatggcatttcagggcctggtgacctgttgcttctgactggaagggcacttagccatgttactgctggtttgcgcccaacttctcgctacaggatcacaaatgagactaggtcagtactatggtaacaactgatggtttcatcatctcatttcgcctccattttttcgtggttatatttgtatacttccctacatggatgctactgaatgatttgatatgataaacttcttattgcaatttcctttgctgttgtagagcatcactcacctttaggctaatgccacatgccaatgctatactggattgctctcctattgcagcagctgggcactgcgtaccccagatgtaccaacccatatctgcaagccaatttatggatgacttgtgtgctgaagaacgtgctgtttcgaatcattcggaagcaccttctgtgagtataaatccagtaccgcatcaattcaatagcatgcatggcatacatccatattcagctatagtgatgcatgagagaagcacacctcaactctctaagagtgggaaagtgacatgttgaaaaagcaagaggatttctgtacatgtaattgtgtctttctcatgtgcgcaaaactaccggattgctcatatcttgccaaatttggattgcaggaatctcagggcagcttcattagtgaaccatctctcagaagtgtcctatcagatccattgtcgtaagtttttccttgcggaatgtaccacttcatcaaagaagcccacgtcatatgtatagattgtcttattctgcatggatcattcttcatatgtatttacctataagttatatgctagcccccattttctttgagagagagactgggagacagagtgatagacaatcaggcacacatacaaaaatgaaggggagaaggagcacatttttacttagcttaatcaaaattgaataactgatataaacctacataaagttttgttccttttttttccaaactagtgtggatgtcatcaccatattatttagttaactacgcatcgcagtcagacaacaagcacgggtgatgaaatggtatttggtctgttgcagtggggcttttcttgaggatgctatggttctgttatgtggacactctttcggtggcctcatgctgaagaaagtcattgaaatggtattttttcaaaaaacttcatactcaggcttccagatggctattaattctcttgttgtaacttatgagggcaaagttctctcttttactgtagattgcactcttcaatgtactagcttcaactagcaattcaatttgattattgtccttaacacagatactggcattgttcactaaatttgtgttttttgtttgaaattaaattatttatttatgtcttctttattatttaatagagggccctagcggtaggttatccaaaactggaatgtactacttaacagagaactgtgactattaggactttaggagtgctttttagtagcaatggcacattcttgtaaaaaggtattttacgcctgaagcagttccttgtatttcacacagcatatatcataaaacaatagattatgtttctacaataactatgcgacatatatttaataaaagtgtattttcaagtcatttctattttacttatcttctgatccagtggggtgacaccaacaatcatgccagtttttctatttttactatgattaggcaagatgcaccatttgcaatggagaagttgatccggccaccctgtttcctaatctcggtatatttctgactactaattttcttccacgaaactggcattatctatgtctcacctgctcacgtactgctgttagtattttggatataatagctttaagagcagtagctacagtggtgaagatggaagatgataggagactctttcataatgctgctcttcgcaaacacaggaaagaggtgaccgaacgtatggatgtgctgaagagcactggaggtagcagagtacgtaatgctgtggctgtgattgtgaacataccctcaagcaatcaatggtggtgcatggatctgaataattactttcattgttttaatcagggcaatggtgagctggtgttggatgctgaaaaccctacatcacccaggggtgtgcagtatccatttgtagtgggcgagagggtcctgatcatggtacaaggagcacagttgcttttggctcttgcattactaagaaataataaagggcagaaatgaattcttatcgttaagagcatttgcagggaaacagaaggacgcctgataaatttgttgggaaggaggcagtcatcacatcgcagtgcttgaatggctggtgagtccatttggatagctcgctttgaaaaacagatggcatttttgggggtgatggaagaagatgtatgtgaagttgttgcgacttagaactaattacaaatggtgaatcgcaggtatcttgtgaaggcggttgatagcggggaaagcatacggctgcagtatcggtcgctgaagaaagtgtcggagctgcagcttcagtcagagatgaggttgcagccactcaccttcctgcacaacaaataccccagtagtggcagctgagttgattgactatcatcagtcttaaaacaaaaaaaaaagaaaggagaagcatatactgtagcagaatagtcatgaggcatgcatcgccatcaagcgtgttttgttgtagtaatactaataaaaaggtcagttagaaaagtgtggtgatagttaatctggtgatgatatgaaaagggtctatcctattggaaggagaaatgtcatgtgggggttattaaaaggacataaagagtttgctaggaagttccaaattcctagcggtggatgcagcgggtcagccaagccaaaccacaaaccaaactgacttttctactgcactgcaacgcaccagtagatgccagttggtaattcttgatccaagcgtgaaaatgtgtaactggaccggctgggcacttgcagaaaaagtcgataaatgtgttgtgtttgctgtgacatcactacgtcagtgattgtttggatgtatgctcctgggaactcaattggactcacgataccgccatccatgtccatggcgctgagccttctcttcgccgctgcaccacgagctgttgcctcgttccgcgcctcttcggcgtcctccccggcactcgacagcggccgccgcccgcagaacgtccccggcgacttcttcgtcggtcagccctgcacctaaactcatcattaatcgctcgccatttatgcgctgcttcagttgaatttgtaattcgctgtctggctgcagatcaccgatgcatcgactgccagacctgccgctggatggcgccggtaactagtctttcatatatgcataatatgcttgatgcttcagctgctttgcttggtgatggtgatttgaattgaattgaattgcaggaggtgttcaagagggtggacggaaaagccgccgtggccgcgcatcccatctccgacgaccacaggaccaaggccctgcaggtagctctgcctctcttttactgaatttcaatgcaaaattaaactatgcctgccattgatgcccaggctctgctctcctgtcctactgcctccattcacaccgagaaacctgcaaaagacattcttcaagtgcaaaacatgttccccctccccatcgacactcatcttctccctgtatgacttgctctcctcattccggatttcacccaatttatctcaattaaattaatactctcatgttatatatgtcatccatcctgcactgctcaaatctttccagggtgtttatcattgtggttatcattctgaagactcgtttggagcaacttcttatcttataacccatccagatggaaacatactagtcgacaggtagattccaatgcacttactaaattgtttatatccctagtacccatcttgccatggccagacaaacaacttatcaagttccaatcggatacattgatagttttccttctgacaagtattcaatttcacaaattggtagcatttttcacaaattggagatcatctctagcaagtcttcttgtccagcttacatgtggttatcagtaggtcttctgatatttttctgattttctagcccaaggtatacaacgaaactggcaaataacatcgaagaacttggtggagcacgctacatgtttttgacccacaggtatgtttgaactaaaagttgtataacatgtttatctattttttgtttttctgaatgcgccgcttctttattttaaatattttatttggatattgaatagcgtctaatgagttacttacagggatgatgtagcagatcataggaagtgggctgagcggctaaaatgtgagaggattatccattcgggcgatgtaagaccctcatgcaaacgattgcatctttttgtagcaaattttacctatagttcataacttgaagtacgtagaggacaattattcatagtttgcactacatgtactagtgtagagtctagcttacctatttttccagcgagttttgctctcagatgcctctcctgatattctttactgcaattaccatgctcatgcaggtagagcgtgctaccgtagatgttgagcggaaacttactggcaatggtccttggaacattggagctgatttcgaacttatccatacccctggccatacccaagtaagaagttcaacttaatgaaataagttgtttaagcaattacttgttgccttcagtatggaaggcttctctggattgggtgaaacattcttaaacatagaacactaaagagtagcagggtgaaagatatgtgcgctgttgttggacattaagagcattttttttcagggttcattcattaaaatgagcatttttttttcagggttcggtctgcttgttctacaaaccagtaaaggcgcttttcactggagatcacgttgcaaaatcagaagaatctgatgatttatatctctttcttatgtacagcaggcaaccaggtagaatcctccctagattttgtctaactggacataactgtgcaattgtacaattagcttacaaatcggattaataatctatctattgcataaatttgcagtgagcttgcaactggacagcatgagaaaattgttgaagttagacttcgagtggtttttacctggtatgcgctcattcaagcattgcggatagagtataccttcttaggaaatgagaaagtccctgccttagcatttagtttctgttgttttctttaaaacggcatgattgagtcactgaacactgattgctagttttttcccttttccaggacatggctatcgaatccattataaagatgtacacgctaaggattcagcaatcgagtccctcatagctataactacacaagctaggggcatcttataattctctctaccttcagacttcagtgtacataaataacgatcaattctggaattaagtgaccaagaggaaatgtacttttttttgaaagaccagcgtaggcggctggcattctatttatcttagaaggagcaatgtacaaattggcgatataggaaatgtaaaaatttacacccatgatggcaaacaggtttgtcaccatgtctatgatcttctctaaatcttggtacctcccatgcttcaaaattttatctcgtccaggacttggttgcatactagttgtatgaatgattcgttactttggaagacgcttgtttctttcctgccaaattttctattgtagtcagtaaaatgcaggtgtacatgcttgagatgccctagagtaagcggcaggcccaagttgacaggggaaaattgctcgctgcgatgcgaagtttcctaaaatgacatccagatcagtatccgggcaactgattggtgtggaggtcggttgcttcgctgaatcttttggcaacatgaagttagtaactgatctagcatctctaatttagtccagaacatatttattgcatcctatcttccgaaaacatttgcaccaaacaggtcgtaattatcaataactgaaccttgagagaactgaaaagaaaaacccagcatcatactagctggtccggttaacagtctagtaatactgtttacacccaaatttgacatctagggataaaataagaaaacttgccaaagtttggaagtctgccggttttcctctgtgagggccggtctgaccggcgtgtgttggctggtcagaccgccgacaatgggccggtcagacctgcggtgtgtggccggtctgaccggcagagtccgagctctcttcgggtctcgagttttcttgctcgggaaagctatatttcgtgtttactttggtttctatcccgagttggacgtggagaagggcttgtagagggcaagaacaacctctatttaaggggcaaggccgattcattgtaataccctgaatacaatctacttgaatcgttcttttactatgttttctattttaccctagtttagtccatctttgtcggtttgcgccgtaaaccgtccgccgccgctgcaagagtgcgacacctctttgtaggtttgtcctaaaaaccttctgttttgcccacgagacgggtagttatcctcatatcgatctaaatcggcctagaggctgattttgatctctaaatcggctccgctagccgatttagctgtttttctataaaacccatcttgatttagccttttggctagatcgaggtggttggcgatttcatatcactgcaaggcgtttagttgttgcgatcgtgcttgtctacttgtcacaaaaagttatcaacaaatacttatctcaaaaacatatctataatgggtacagactcatttcatactagaactagagtagtttattattgatcgagtgttaaaatgggcactcagtaaaaaaaagaaagaaaagaaaaagggaaaaaatcgagccgtacgtgcaggatgttgggaaacggatcctctgactttggtggatgttggcgtttgctgtgacgtcagtcgtgagggtcgttttgtgcatctgctgccctgcgcagagcgaacgctgctagttgtagcacgcacgctgtcgctgacgctgctgttccgccatggcgttgatgatgagccttcgcttcgcccccccagcgtccgtcgctgctccgccgccgcgacgaccacgagctgttgcctcttcggcgtcctctccggcactccaacgccgccgcccgcagaacgtccccggcgacttcttcgtcggtgagccactgatcgagccctgcacctgaaatcggtctccatttaatttctcttcctgatgcgcttcagttgagtttgtttgctgcagatcaccgatgcatcgattgccagacctgccgctggatggcttcggtaactagtctttcatatatgcatatgcttgatgcttcagctgctttgcttggtgatggtgatttgaattgcaggaggtgttcaagagggtggacggaaaagccgccgtcgccgcgcagcccatctccgacgaacacaggaccaaggccctgcaggtagctctgcctctcttttactgaatttcaatgcaaaattgaaccatgcctgccattgatgtccaggctctgctctcctgtcctacttcctccattcacaccgagaaacctgcaaaggacattcttcaagtgcaaaacatgttcccgctccccatcgacaatcatcttctccctgtatcacttgctctcctcattccggatttcacccaatttatctcaattaaattatattcatactcatccttgttgcactgctcaaaacttccagggtgtttacctctgtggctatcattctcaagattcatatggagcaacttcttatcttttaacccatccagatggaaacatactagttgacaggttaattccaataagcttatgaatttgttcatgtccctaagtacccatctttccatctccagacaaaaaaaattatcaagttgtaatcagatacattaattgctagtgttcctgctgataagtattcaatttcagcacagcgtactggtcaatgtgatagcatttttttcctcacaaattggagatcatctctcccaaatcttattgtccagtttatatgtggttatcactaggtcttctgatattttctgattttacagcccaaggtatacaacgaaactggcagagaacatcgaaaaacttggtggagcacgctacatgtttttgacccacatgtatttccggacttaaagctgtatcacatagttctcttttttaattgcctttttttaacgcactcccttttattttggatattgaagagcgtctattgagttacttacagggatgatgtcgcggatcataggaagtgggctgagcggctaaaatgtgagaggatcatccattcgggcgatgtaagaccctcatccaaacgatttcaaagaatcatgatcatccttctgtctgaccctagaaagacatcgcttattcctgagtcctgactgatcctcatcgagtactcaatcaacactgtcaaactttataacctgcagtacaagtactgattagcagtacagagaggacagttatatcgtgtcagagcttgcatgacatgaacatagtgtagagtctgatttacctatttctccagtgaatgttgctctcagatacttctcctgatatttactgcaattactgtgctgatgcaggtagaggatgttactgcagatgttgagtggaaacttactggaaatggcccatgggacattggagctgatttcgaacttatccataccccaggtcatactgaagtaagttcaacttaatgaaagaagttgtttgagcaattacttgtagctttcagtatggaaggcttctctggattggatggaacatccttaaacatacaacatcaaagacaaagagtattagggtcaagatatgtcatatgtgcactatttttgcgcataaagattagattggattatcaccatatcctgtcccaaattttcctcaaccttagagacgaaggaacatgttctgtcaaaaattgtccaaagctcataaactgagatttggacaaccaatctaaccttcttcagcatatatagggttcattcattaaaaggaacatttttttcagggttcagtctgcttattctacaaaccagtaaaggcgcttttcactggagatcatgttgcaaaatcagaagaatctgatgatttagatctctttcttatgtacagcaagcaatcaggtagaatcctccctagattttctaactgaaggtaaatgtgcaattgtaccattagctgaaagtaggactaggattaatccatctgttgcacaaacctgcagtgggcttgcagctggacagcatgagaaaattgttgaagttagacttcgagtggtttttacctggtatgcgcttcttaggaaatgagaaagtccctgccttagcatttggtttctgttgtttcctttaaaacggcataactaagtcactgaacactgattgctagttttttttttccttttccaggtcatggctatcgaatccattataaagacgtacgtgctaaggattcagcaatcgagtccctcatagctaactacacaagctaggagcgtattataattctctctaccttcattgtgtataaataacgaccgattctggaatgaaggggcaagagagaatgcacttgccattttgtcagcgagagtggcacttcatatccttggaagatgatggtactgtttttgcttcacgacatttgcaatatatcaagtcgaaaatgtcattgatgcacaagaatctgtgcctttaatgttctttttttccagcagaagaatacttgtttatgatgacatgaagtttcctgcagttactctggcatctctaatttactccaaaatttgtttcttgcatcttgttttccagaaacatttgttgcaattgaacattaactatcaataactgaaccttcacagaaaactcaaaagaaaagcccagcatcatactagctggcctgaaacaaaattgaacgatgttacgcaatgggaacttaatttcggaatataatcacgtgttcttaatgatatcaatgaacaaaattgccctttcctcgaagttacacctcctggcaccgattccacaaaaagaatgctgtcccattcttcatggtacagaaaaattaaaagaggggcaaaaaaaaaacaaaactcccgttgtatactctttagtgttacataaggtacaaaactgaaactcttggccagagaaatcctccctgttagagcaacgcttccaagtattcgtcgacatatgccaaacatggccaatgatcggttcttattctgaccaatgtggaggcataacctacttccatcgaaaagaggaggtgataccttggtggtagaaatattaggacacgcacaatgcccatatccctcttgcttagatgagcataagtctctgcgccaacctcaaattcgtcttcatcaatgcgctgaagcgaaaggtttgtgtccactgagtatggaaccaatgcatcagcaccaacaataggagctgaatcactttcttcccacacaacgtttttaataattgcattgcctcttaggatggtaataagtgaatctccagcaacgctgacaacgaagggagccaggtatctttcaatagctctgatcaaaacctttggagtcacctcaagaagtttgacagatcgtgttccattaatcgcagctgaccctttccctcctgtcaaagggaaggtctcccgacctgtgttcgaacaactgttgcaggcctcccatagcgcatggaacagatcctggtaatactcagctgcatcctctttcagaatatcaggaggtacactggccttcagaaacatgtcctcaatgccaactgtaatgggttgaatggacccagatatgacttggcaattctctgtgttggcggtgatgacaacatcaataagaccaggtgatggttctcgaggctctaattctatcactactgaagcacaataacttgattctaaccggtggccgttatccaaaggcataatgtccataccagaacctggaggttctcctagaaggaaaggtacatgacatgagggaattttcccaaactgtgcacttgatgaaaagttaattgtcgccgcataaagggccggcaaaccatcaaccccttcagaacctggaactgctgaatcggatccccaagcatggttgaatggctctgaatcgaacctaaatgtgcaaggtatttttattttgagaccaactgagtggaggtagtcaggaatgcatgcaaagtgcctcctaaggatttccagtgtttcagcacccttagaatccatcacacgaagagcttcttgtgtgtaggcgattctctcgatggtaggttgtggtgtcttttcttgctccggaggagttgagcttacatcctgtatacttagaatttggccagatgctctgctctgaatgctgaagttaggcaatgtgagggcccaagactgtttcacgaccagtggcacaactctttcaagatgaatgtaagacgccaaatcaggcatgctcttaagatcttgagcaggacgtggtgatgggacatcaaacaaaggacctggatgagatggtgtaacacctgcaggttgctctccgattcccatgagatgcctcagcttctttccaggaatgcaggacagcatccgcaaacaaatcctggatgtaatatttgaagaagtgagaagataatagaaaaacagctatcacaaaacaagaaatatcagaaattcagaatgcctaccttgcatggtcccggacctccaggtctgggtaggacttgatagtgagtacaagtaggcatgagaggggaaagaagatgcgagagctgtgatggtgcttcatcatgacacgacaaatgccaacgaccttgctgccctgagaccatgttttcagttctgtctctggatcatgcttcttggcaagagaagccatctgcttggtgagcaactctattaggcggagctgaggaactgtctcattctctgcgatcttctcaaagagtgggtagtatgacgccagttggtagcctggttcaagcctcggaagcagattctcgtcaagcgtttgcagcaactgctcccctgcccaccgatgagtgttgcatgctagaagacggttgatgaaatcagcaattactgggactaagcctcgatgttctgatgtcatatcaaccaacatagcctgcacacagagtgacctagaaatttgagaattgctaaattttcaattcactgtctggaacataattagggttcttccaagttgatggatgcggctatcattaattttcctttcagtagatttctacctgtaaatggtggaagatagtagaattcaggagctcaccagctccggagcaacctgagccatcagtactgtgaggggcagcagcaaccaagaccacatgcagcgcccggaacgccacacaagtctcggtactccatcccgggagccacctgaaggctgaaacacaagccaggccatcatcgacaagcccaattgtctggtccacatctctgcctccttcaatcttgtcagcatcaacgccagcagcaacaagagctaggcaatctagcttcttggccttgactgcaagggggtcgaacacgccaggataaaaccatttcgcgaggccgggcaccgcatatctgaattttccagatccaagcagccaatgtaatgccagcaagcgcgctgtgagcgggcggtgtgcctcacaagcagccaaagctagacggcgtgccattttacgctcgtcttcggccccgaaagcatctggaaactggatgaacagcgtgagcagagagtgtagaagcatgaggctggacgaatgtgccatcccgccaaactgcaccttgacgtgcgctgcgatcgccggagcccacccgaccacagccgcggacacctctgcaaggatggccgccatctccatgcccgatgcaggcgtgaggacctgcggcctgtccatgatcagagcgagcactttccttatgtccctcaaattcacctcggaaggcggcggcacggggttggcaggatctggtgcgggtgcgcggagatgcgcgggcacaaagaagggggtgggcgggccggacaccgccaagatggaggtggtggaggggagcctgccgaggcggacgacgtggcgggcggcggaggcgaggaggaggaggtaggactgcgcggccggcgagcgctcggcggcggcgagagcgtagacgtggccgaggacgtcggcgaggaggcccgggagcgcggcgtcgagggcgcgcagggcgcgcaggcgagggcgcgggcggcgcggtcgggtgcgtggttggggcggttggcggaggcgagcagggcgttgacgagggcggagagggggtcggcgtggtcggtggagacgggaagggagagcgcggaggcgaaggcggatgtgacggtgaggaggaggtggtcccggagcgggtggtcggaggggaaggagaggaggcaggagagaaagagggggaggtgggtggggtaggncggnagcaggtggtcgtcgaggaaggagaggaggaggggcctgaggtgggaggggaggtcgcggcgcgggagggaggagagggcgaggtcgaggagggggaggtggagccatcggtggcggcgcggggtggggaaatcgtcgatgagctgctcccactcctgaggcgagagggaggcgggaggcggcggcggccggtccatcgctggcgccggcgaggggaggggaggagaggagtgatgcggtgtgtggtcgggtcgggtcgggtcgtgtggtgtgtccgggtgtcagtgtcagatcggatggtggggtagggggaaggagacgtacgtgttggtggttccgccgcctattgcagaattttttttatttataattttttttattaaaagttttaaaaaataattttccattttgaaaattgacggaagtagtcccctaccgccctctgggagggcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctccgctagggcgattttgtactgtggggggggccgcctgcaaatgggcggcgagggagggcatggaattttgcaggcggcccccttgccgccctgggggagggcgatttttgcctcccccctataaagcccagtccttcctctgtgaaatttcattatattcactaaaaatccaaaaaaaacgaaagagagagaggggagggcagcagaaggggagcgccgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacaatagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatat

SEQ ID NO: 11689 - DNA, 7832 bp, Oryza sativa
ttatagttggttgttgaaaggatttaaaatagaccaagaagtctacccaatgtcagtgtcagttgtagtgagtcgtgcaacagaaggttatttttggaaagtaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcagtgaagcattgggtagtttccttgcagagagagtttagggtggtcaagtcaacaaattatgtgtatgaagtgaggtgcatgaagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtatgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcttgatgttcggagtcggtggtgcatgcgtcacatgggtgcaaatttctacaagcaattcaagaacaagcatcttatagagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttaatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgtcgtagttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctctgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaaaatttcattcttaattgtaggcggaccttctgcaccctgacgctgatgattactcggtccgacgctcccttgaggcgtacctaatgtggttgttcgggtgggtgatgttcactagcacccacgggcacgctgtggacttccggctggtccactacgcacggtccattgcggatgcttagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccgggcttattggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtgacggacgcgtatcccacgcaccgtgaccgagactacttcgtgggggtacatcgaatttgtattagttcttacaattatttcatttatcttgcataatataggacaactactgaattttttatttccatcttgcataggctgatgccgcacaggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacgaaaacatcaccccgtcgtaacttgatgttccatcctcgcaggacctcgtttgccttcgagcgcccctagctttggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccggggtcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggactgactcacatactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctagatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaatcacgcccagagggcggtaggcgactacttccgtcaattttcaaaatggaaaattatttttgtaaaacttttaataaaaaaattataaataaaaaaaattcgcctattgcatcgggtctcatttttgtggactaggctgatgggcctattctcccaacggaaaataggaaataagttcatttcacgtactgtatttgaaccgtaatatcgaatataacctatctctcaacttgtaataccaaggtaaatattagtgtattacatctattttcaactgacatggcgtgagtcagcgtgtgacctacataggtccacacgtcagggacgcctctctctttcctctcttccttatctctctctcttccccctcaacacaattgcggtcacgatagagacgactgatggtgtcacccagcagcgcaagcggtggcgcctcattaagagaggtggaggttgagcacggctaggcatcaaattaatacaatacctaagtacctaacagagacaataaataaataattaattaccagtgtgtttcctgatcggaacaacataggaatgatacacaaattagcaagatgtagcatggacgggtaaagccctatgcaactatggtaggcgtgattcccatcgtcaaggtgagaggtggagacgaagctagcgagtaagccactcatgtcgacgattgagcccctgatgagacgattagctggatcttgaaggaacaatcatagatgcttgacgacaatgtgtccatggcaagggaaggcacttgcccactcaggcttggatataaaccgcgacgagcaaagcaaatcatccggatttacctgcgctgctcgcgctgctcatgtggcaggcaattaggcctgattcgacagagctgcccactcatttgccaccacagcctcctcatctgcctcaccgtccttgagttgctgttggagtgacaggccatcacggctagagtagaaggatgttgctcctcccttttgcagctaccgtggggtcagggattggggagctttcacaggaaacggggggcacctcgggctaaccatcgccgaataggagtcgtagaagctctgacaggagctctaggtgctgatggcgctccaacacctcatgtgcttagtcgtgtcttggatatttgttgagagaaaaatgattgagagagatggggagagaggaggggaggaaaatagaccactcgagttaaatttgacgagggattagatttacactcgatttaagttgtgagacgtcgtaaatgtgatactcaaactcgattcatcgaacttttttttccagaaaaatatacctacacacaaaaaattcgctcattttatcggaagaagaaaagagagagagagagagaaacagcgcgagacgcggatggaatggcaagggaggaaactggtggggtgggagtcgccacgacacgcggcgacgcacggctgtggtggccggtgacggtgagctgatcgactgcccctcccttccccttccccctccccctccgtcgcatcgcagctgcagctagctacacgaggagacctgctgctctgctcaatttcaacttgaattctgcttccgacgacgagacgagacgcaatcctcgctgcctccgccggatgtcggtggaccccgatgcttcccccctccgccggcactccgctgccgccgccctccctcgccgccgctagcacctcttcctgcttcctcccctccctcctccctat

SEQ ID NO: 11690 - DNA, 26963 bp, Oryza sativa
  unsure (1)..(26963): unsure at all n locations
caccaccttcgcttccggaaccttccgcggcgccgggggagaggaccccctcgtctccaagctccggacccagctgggcgtcatccacccgctcccggcgccgcccgtcaaccgctccgtcctcggccttttcgccctcttcttcttcgtcggcgccgccttcgacaagctctggaccctgcgcaagcgccgccgcgccgagcgcgaggtcaaggtcaacggcacgtggccgcaggtgcccacctccagcttctccctcttcctcgaggagaaggacctgcagcgcaaggagtccgtcgagtgggtcaacatggtgctcggcaagctctggaaggtctaccgccctggcatcgagaactggatcgtcggcttgctccagcccgtcatcgacaacctccacaagcccgattacgtcaaccgcgtcgagatcaggcagttctacctcggcgaggagcccctctccgttaggaacgtcgagcgccgcacctcacgccgggccaacgacctccagtacgtcctcacttcttctactactctcttctttcttttccatacccaattcggttgggagctaccgttgcagcaagaaacatggaaatattcttcacattgcttgtcccaaacgttgttctagctagtactactactagtgcttgagaagcacataacacattggtaatcggtatggtaaccccactaccattgcactgctcatgtgaggaaattggaaagcaaagcatgatgacattggtcttaggaatatttgtcgccatttgcctgtaattcacataccaaaatggagtattactcttttttgggtatctatcataggattagcaccaccatgaaacaaaatactaggatgactattccagcagttcacttcttattactacagtctatgggtgggcatgtatctgttaccgtataaatatgttcattctagtttctgatttctactttcttggtcattgttgatgccctgattttttttaaaaagcaaacggcaacactgctgtctacattgttattgtatctatatcatgttttagtgttggccagcaaaaggcagcgagtaactcatcctgtatttcaggtaccaaattggcctccgttatactggtggtgcacgcatggcattggccctctccttaaagtttagtgccgtacctgtcgttgtgccagtctgggttcgagatttcgatatcgatggggaattgtgggttaaactaaggcttataccgacagaaccttgggtgggagctgtatcttgggcatttgtatcgctcccaaagattaaatttgagctgtctctgttccggcttttcaatcttatgggtatgacttgcttgtccaatcttattatttcctatgcaacctgtacttaaatttcatgcctttgtaaggttgattttctcgtgattccaaaagaaagcatggttggcaccttttaactcatatgattttctggaaacaaacatgcagcaccaactgacaatatgccctgtgaatcatgtaacacagcattgcaaatagcccatttctgcacatatctagagtataccgcgttccaattggtacggttaatgttttaacagtatttgtaacacacttgtactatagtatatacttgccaattaccgcagtccattattactctagtaccccctttatatattgcatttctgatatttcgtgtcccaaagatccaggggttttctgactgatatcttggaattgtaagtttgtaaccatgaatgtcttcttacaaatgaattggaagaaatgggagaaaaaaaattacgatcgtaggactttagtttttcaagcctacaatttcttagtttatgtatgcacaatggtgtcaatctgtttaatgttctgaaactggatatgttgtgtatttgtgctttgtttcctattcgtttgttcatgttgggtagttgtcagccttttatttcatttattttctgtttccgttatataaatttgtatgttataagtttgagcctttgctaatggtatattggtattttcaattttttgcatggatatggtgcttgtcttcaccagcaattcctgttctgtcaatgtaagtactatcatctcaaacatctacgcagaatcatggttagatgctactacatagatattgctcaatgagcagggactactaatgcattttaaagttgctttcttagtttctttttgtaatggcctaacctaccttcccactgtcacctttaccctctctgccgccttcttctcttgctttcttgttcactctagttctaggtggttaaatattcttatccccatgtgcttagctggtgataaaacatatgctattacttgtttaagctatcaatattagtttttgcttcttacttagcctagactctttattaaatacatgttggtagatccatgaagattctgttgaattagtagcaaccatatttaacaatctatataaaatgcaggtgcctgcattgttattgtttgtatcatgttttcggaaaaattctgcaactgtatcctaattcaacaccttaaggcttagcttttcatttaatgctgctctttaatagacaaaccttgttcaccctttggccggtggttctaataagtcacctgtgactctacctcctctaggtttctcacgaaacttctaacagaagatttgccacgtctctttgtgcggcccaagaagattgtccttgattttcagcagggaagatctatgggacctgttgcaggagatgttgcaagtgacgtaatccaaaatgttgcaagtggcatacttcaagatgttgcaagtgatgtaattcaagatgggaataaggacttcgttggagaactatcagtgacattagttgatgccaggaagcttagctttgtcttattcggtaaaaaagaactctttggtttccaaatggaaatatttagcgtatgtttattagtttggaaattgcacccagcatcttgttagaagaatatcataaatatttagcttctattgagtttatctgctcagaaaaaacaaatcaaatcattaaataattttaccacttgggcaagctggagatgaaataaaaaattagttcgcctatccttacagacatctgtgtcactttgatagaatatttaggtataattttttttgtcacttgcagggaagactgatccatatgttgtcatgattcttggtgatcaagaaataaagagcaagaagaatagtcaaacaactgtaattgggcaaccaggcgaaccaatctggaatcaagtaaagctctgagacagttatactttaagctcatgggcattttgatggaacctttttcttgtatactatcatgctcataagcacttgacatcaaacaggactttcatatgctagttgcaaaccctcgcaaacagaagttgtgcattcaagtaaaggattcagttggtctaaccgatgtcactattggcactggagaggtagggtttcatcttttgcaaagtttgtttcaattgaaagttttccttagtatcctctctaagctgatgtatgtgatattacttggaaatttgtagtttagtgtactgttttacagcagtttgctaggtcaagcaaacatactatatcagtgatgagtgaagtgtattttgtttgtatttttgggtgtcctttgttgaagtggaacgtgtttctgagtatattctatttgccaggttgagttaggatcacttaaagacacagtacctacagacaaaattgtaactttatatggaggatggggcttacttgggaaacggtcaaaaggggaagtactccttcgcctcacatacaaagcatatgtcgaggacgaggaagatgaaggggtaaaaaatgagtttgctgcgggctatgtttcagacgaggatgtgctagattatgtccaagacagtacaagtaagcaaagtgacatggatggtaaagagagagagaccttcatggatctgctggccgcgctgcttgtcagcgaggaatttcaaggcattgtgtcgtcgtctgaacccggaagcttgagagatagtgagcaggctgctaaatccagagatggtgaaaatgctgcagcagctgctgatacagggactgtatccaatagctccacaggtaaccaactgttgaattcactatgctggttacctgcatagtattgttggttggcttgtgtttagatttccattactacatcaccttgattgattttctgattttgtttgtgattcagatactgctctagtgtggcttgctgccataacaagtgtgatggtgctggtctcatccaaccttggtggttcaggctatttcaacccttgaagagttgatgcatgaagaatctgatctgactggagtatttggacgatccatctgtctgaatctgatcatccgcagctagtagcagaggtcgttttgttttgattttttttaactttatttttgccgacaagtgtatattccattcccatgtatctaatgttgcagaggaatcaaagaatggcttggcttttggcggctgtctctcctccctttttctatttcatacgattgacatgatgtagcatatcctttttgtgcaaccatccacgcacatgatttaatttgtgtgaatgggaaatttggagttgcgttcatctctcctcttggaattggatcaaagattgcaccattcattcatcaatagatagcagattagcagaagacatgatttcgtttgttttttttcctaaacaaaattaagggagcaagtgcaggcatgctgaatttcgtttctttttgtaaaactgatcggttaccgacaaaattcaaagaaattccatcaaaacctatcgaattccatcgaatcatcgctcgactttggttatcagtctttttttgagaactggttatcacttatcagtctgtgcccgtcgagaagaaggtcccagatgaaacgggtttgggcacactgactgactggcgggccccacgtgtcagcaacgccaaaggtcaggagagaaatggcgggaatgaatggagccatttcccgcgcgttccacaacctcccaccttttggttttcccaatctcccgcgcgcttgctcttcctgggctttttagtctactcgatctaactccaaatcccattaaccccgccgccgccgccgccgccgccaccaccgcgagacgcgagaggagagtgaaagaaagattcagagagagagagagagtaagcatgatgtccttcagccagcccgacgccttctcgccgtcgcagttcacctcctcccagaatgccgccgccgactctaccaccccttccaaggtagtaatctccattccattctcatccgtgtgtgtcttggtttcgagaaacaagggggataaaatcatctttcttttcttttgattttgtagagccggggcgcatcgagcaccatgccgctcaccgtgaagcagatctctgaagcgcagcaatctggcatcaccggggagaagggcgctcccttcgtcgtcgacggcgtcgagacagccaacgtatgctgcaacacaacacggaaaatgccccccccctccctgctttaatttcctcttagcttgttgatttgggtgtttccttgttgctttttcaggttaggcttgtgggattggtcagtggcaagacggagcggaacaccgatgtgtccttcacgatcgacgatggcaccggccgcctcgatttcatcagatggtgagcccatttcgccgattcaatcgcttctgtatcttcctagtcaatactatttctgcttcaactgccatcactggttgtttactactacttgtagttcagcttgctcgttctagacttccaaacaattcaaggccgggaattcggaaaatgttttttcaatcctgaatgctaattactactagtataaacattctactacaaacggtgtcttttggtttctagaagcattggttgagcatcagcacatatctggtctgtcttttcgtattcaaggcaatgatataagtagtactcctacatctttagttctgaaattaggttaattactacaacatcctgttgttcttttgccaatggcttcagcagatttacatggttatttatctccatccattttacagggtcaatgatggtgctgattctgctgaaaccgctgctgttcagtacgtaccagtcatagctcccatttatgcttctatatatgcacttcatcatcttttatttttgaggattgttagcatctttctccttgaggatcatcaccttttctcataactctattttttttcctaattaaaggaatggaatgtatgtttctgtcattggtagcctcaaggggcttcaggagaggaagcgtgctactgctttcgctatcaggtacgtaacattcatatattctgctggtgcaaatatgcaataagacatgcaactaattttctcttattttgttcatttcaggcctgtaactgattataatgaggtcacactgcatttcattcagtgcgtgcgaatgcatttagagaacaccaaatcacaggtatgctgctgtgatgtacaattgttctatacaaatactctcgtgatagcaatctcgtgttcattagttagaaggttcatgagtttgaacaaaaaaagaactaatgcttaccttcaacactgtagattggtagccctgcaaaaacatattctgccatgggatcctcatcttccaatggcttcagtgaaatgaccactccgacctctgtgaaatccaacccggtaagttgtatttacagttattgcattgatcaaacaatcaaactcctgtgctgccgtgatttattccctcatccttacaggcaccagtgctcagtgtaacaaatggatcaaaaactgatttgaacacagaagtgctgaatgttttccgcgaaccagcaaacgtgtaagttgcacatccgtcttccttgtcatctaggaaaaagaaatgcttgtcctgttaaagacttaaagtcaattactcaggaatgaattccgaatgcatgtctctgtttcttttgcctttttttatctgcttagaaataccagctcccgtgaaaacctgatgctccatcaatatctacttttcctagattttccaattaaacacaagtagaattggctaggattgctagctaggagaaatggagagtatttgtctgttaatattgtcgtgttggctgaagaagcggcctaccgattgtattaagatttgaggatctggtgactgctgttttgctcatcttgtttgaccaacgaataaactgacagcgagagcgagcatggtgtgcacattgatgaaatcgtgaagcgcttcaggctaccggaggccaagatcaagtctgtatttcactccttcgctcacacacacacacgcaacagcgagacattaattcgacgaaaaattatggctgctggttgatgcttacctcgctctctgttaatttatgcagggtagctattgattacctcgctgacattgggcacatatactcaacaatcgacgagtctcactacaagtcagcgttcaatgaataaaggggattgaagcctcagttacttactagtatgtatcctctagcctcgaagctggctgcagctgaaactgaagaacaatcgagatgcttcatgtttgcttgtcatactaaccagtgtgcgtttgttttgctccatccagtgaaattacatgtaaccgtatctgtattacgagtagcacatatcgagtgacaaaacatataatatatgtatgtttgttgttttgcagcatcagcattatttggactgtaacatgcttgattgatctctttggatgcagttaatttcattgtgatattaactcacgcatcatcgatcgatcgtgtgttttttggtagctagatggtccaatcacaataatctgggaattaatgatttgatgatgagattcatatatgggattgaatggatggatggatcacattcacatggagctaactaacacatgcattgccatggttggatggtgagctggccgcacggggcaacaatacaaatgtgctgtgtactatgcttaggtagcactgatctatcatccgttggtgatctggaaataattaaagcagcgaattattaaggaaacaatatggacgagtccactagtgtaaagcggaaaaagacaaggttaatttagctggccaggcgacccacctacaaaatatcagggggatacttacacatgccatttgtttttagtgcccgaagtttaggctactaattgatcccaatagtatatctaggttctaaactaattaggcacatggtattaatagttgtgttatatatgctaacggatttttatgcacaatttaacataatgttagaaaaaaaagtttttggtataactcttagctactagtatgattttggaatatatcaatacaattgtatttgtattttgtgctacactaaatcttaaaagtagaaatgttggattaattgatgttgcaaattaattgatggtgcaaatcttagctcctgtttttcaagatccaattgcaatttttatgtagtgataaacaatgcgtctcacacagcaactgtcccctttcatccactctcccacttccctcctaataatataaaaaattctcttgcatttacccgaacaacccaaacactactccttccgttccaaaataagccaatgttgtactaggagggaacaaagggagtagttatttctctagtctcttcacccatcccaaatctcactccttctagcaaccccccccccccccctcttctcctctcgtaaaagaactctcaaccctccaagcatatagggcataataaatttattttggtaatatgtttagccagaaattggttctatctctctcagaaaaaaaataaattgctcttccacctctctatgtagaaaatttatcctggtaatttacttttgaaagttggtcatgtaggctctcctttccctccttatgaaaaaaattatcgttacccctctcaacattaaattattttgatcagattaatctttttcttaataataagtgaatttcattcaaataatgaaaatattaattcttttacagcagaaggagagagagagagagagagagggggagtggatgaggactgagggcacagaaaggagagggagtaggagacggaggggagcctagcgatcgatagaccaatgtttggttaaagaggagagttttttttttcacaccaggagaggaggggagggggaggagagcggagagagagagagagagagaggggggaggttattttgtgaggtagtcttagcgcactatttaacttaaatagcctacattttaagaattgagtttgatatataattcttcgcttctattttcattaaaaaattgtagtttttaatatagaccatgtgccttttttttaatataaacatgacatctcatattcaaactctgttaataatgtgtaggtgtagatatgcacatatacgtgtggttcacttctattaagtaggtaagaatatgatagtggcgacgattgggacattgatccatatcatatattatatggctctgttcggctgcacttaatttcactgttgtgcagccaacataaatagtattgtgttgtgtctgcagctgaagtagctgtatcggccagccgaacaggcccatagtagtaagtaggtaagatgtatgatcattcctacatgcatagccattcagatagacactaactaagctactagctagcaagcttagctaatgcaaacactgtagatgcttaatcactcaacagagatatgtaattagaataaaaccgattgatgtctatcaatacataataaattaatttttgagggctccacggtaatcgatcgatcgatatatcggtggatgcataaatatgatagtacacgcatgtctcgaatcctgcctgcctcagcctggttggttggtgatatacacacgtgaaaagtgtcaataagttaaagctatataggtacatgcagctcttgatagtactcttgatcgatccatccatcatcgatagatatcactaagccggctacccctcgatcaatccgaccggttggtacggttggtccatcgtttaatttgctttaatttgctccaccacttaacatgggtgttttttttataccntcgcgggcgcccacacatgcatgttcccagagaccccagtgacatatttcatgttttttctaaagttttatttgaaatttcatattggtgggcccacagggatttattccctatatccgcggtgattttttttttatgtccccggggtttaattagttggccccccccaattttattgtttggctcccggtggcaagctatttcctatatgcatattaattgaggggttcatcaccccccgatgtcggtatatatatacagctagcacgcaatttgccattaatttccaagatgaattatatatatatatatatatatatatatatatatatatatatatatatatatatatatatatatatatatatatatatatatatatatgttaccggctcgatcggcgatcagaattcagaaatcgatcacaacataattaatattctgtacgtaccatagatggaatagacgtcgtataaataatccagaaattaaaatctgatttatatatcatgattaattgatcatgtatattagtagtattttttttctaaaagaatatgtatgtacgtacggatcgatcaaaagtatatgggtccaattacgtctgtccaccatctctttcttcagtgcatcgatcgattgatcagcttcctctggctctatatataccacccctctttctcctcttcttcgcatcgtctctctctctctcacacacacacaaattaaattgcgagcaaaaaagaaagattgcggccatgctctccacaggctttcttgaactgtgaactcgtgtgtgcatgctcctcatatattgttctagatcccatgcatgatgcatatcgatcgatctgatctgaattaggtcatcgatgcgcatctggatccccatcttgttgatagttcaagaaagtccttggaaaacatggtgccctcgatcttaattatatcttacttatatatctacctagctatatctcctgcctgctctaattcttggatcgatcgcgatggagattaattgatctgtacatcgatccatgcatatcagatactgctcacccggccgccatctgcgtgcaattcgatctagcaggtaaaattactgcttggatttttattgaattattctttctgctaattggaatattctatctgcaataaaagatatcttgaaataattcgatcggccaggctaatttcagtactctttaatttgatcagatctgcaagtttatgcaccctttttaatgtatggttagtactcaatttttggataacaatcgatatgatagtactccatgcatgcatgcagatctccatatgctaatctgatcttatcatttgcacttggtattctattcatgagtcatattatatatgtatagctaactgttatatctactccattttttttttttgctttatggtcttgtacatatatactgcaatatagttcgtgcttcattgacccggtaggtctctcacatatatatataattttgaaattattccctgagtctaatttacctaatttccttggtttatatgttcctatttggttttcttctgaattcatctatgttttgatcttagatccttttttccagtagtagatagattatatgtgttgtgatcggttttcccaaaactgtttgtacgttcgctatataaagatcaaaaaaagtaagtggcgtttttttactgtttatactttataccatatatttttatttgaaagttgtacgcagcagtagttttcatatgaatggattatgcatggtgtgctagaccgctagtattattgttcccagttgcgttgtgaacaaatggtactgttgcattatatattatatttagataatggaaatggtttactttggcagtatattatatgtatatatatatatatatgcagagttagccatcaaattcagtactggtacaattcaaggcaagatatatatgtttcaccaaattaagaagaaaaggcaatctctgtacatcaatataactggtgaattaagttaaaggcttgggttttaattattagcccctttatatatataaaaagaagttaaagtctaccactacatacttacatagtattacctagtacatgagaaattaagaaactgaatgcatggtgaatcctaattaattctgataggcggccggtgatagcaagccttttttacagtagtattgtttgaactttgatctgtgagctgcattgcatggtggaccagtgtttgactgttcatctcttctcttttgcttgcatgcatgtagctgggaaatgaaagctaagaaagatagcgtgcacgagcgtgcagaatggcagcatatgtatgcattattcagtactgctagatgaacagaatctagaaaaagatgaactgaacagcagcagcagcagcagatcgaaggatggatggatggacggatggagcaagctaagctaagctttcgttttgtcgatccatccgtccatcggtgtcgacctagctagaaaggctgacctgtcgcgtcgtccatccaagatcgatccaaccagcaaccaggcatcagacaggctctttcttgtccagctgctgctgctgctagtacacatactacactgtctctgctgcatgcatgcatgctgctcacctcatctgattgagagttcagaattgttgagagcaagcaagaaattgagaaacggccaggacagattggattgatcttaattggcatatatgctgctcgatcgatactgtctgtcagttctcagttcgtcgatcgatcaagtctatatttggatatctgaatctctgcaaatgccaactcgaccactaagcaattcatcaatggacatgatcatagtaatgtcgatcgacgtgcagtgtcactcattgttgggagcacggtcaaaacctccagttcatatcatatcatatgaaatcgatctcaagctcaagcagtttcgatagatgcaaaattgaagatggaagtataaataactgctactgtatatacatatggagggcaggaaggcaggcaggagattgatgaagtgacgcgagcctgccttgaattgtgctagtttctctttctctctgcgcgtgtgcttgctgcccctagctagctagcgaagcgtgtgctttcactgtgcattgcatatgataggaggtagtactccactactccatggtgaactggtggttgcattgctaaccacagccatagagctactgagctagctgcgaataatttcattcatgtttgccgatcgatcgagctgcagcaatgatctttccctgcagcaatgatcacgttgcatgcttacttgtttctcttcttttaacttttttcccctctcctttctttcatccatagtttttacgttaatatgcagatgcaggcagcacaccttcttcttgctccaccggctaccagcacctaagtaattagtgtgttcatgcgcctctgattatatatgtacatatatatatactccaatatatgtggtagcatggatatatatacaattcatgtcttttgtatgtactaattaatgtgtattgtcatgtgcaataatggaaaatgatgatgtaaaagttgagacgactgaactataaataaaaatatatatgaaagatggcattattacatatgcaggccgtatttgagtgctactgatcaattacttcctgatagtgtggtgaatttcaagatatatattgtctccgaatcgatcgaagcatggtattatatattctactcgtgacgtgatatacttacttaatttgatttgtttaattacgccttatcacgcatgcagctcgatcgtaatcgaaccatgcatccatcaatatatactactccagtatatttaaaaaagtcaacggcttcaaacattttgggacggatggagtatatacagtggtgaggctagctgtagataaagctggcaacctgtactctttacatcctaaatagttaaagcgaatcaggaactgatcatatgcaagatttaacccgcacatccactattccgatctccatgccatctactacgaatgaattgccataaaaaagatttaccaatcttttctttccttttcacatatagtagacataattcagctcagctgccaaacaaagtattgaagttatttgtgtaaatgacctcacaaatttggtatagattgctattagctagtagtatacaatacacatgcgggtggcaatgtaatccatcttccttatctaaaatatgatacaaaaatgtgtaagcagcgacatagatcttcagggatcaatcagttgatatggagtagtagtagcttgctgctgctgggacattcagatattgatgaatgcaggttttgtcatggcagtgaggcagacagcagagagcaataaaaggcactagtaactacattcgtctcaggagtcaggatacatgaacttttaaggttaaacacggctattagttgagaggagaaatgttggagaatttaaatggtgaaagattatgattagttgagaagagagtacatgtgaaaaagttgttatattttaagataaattataaatgctaagttattattatattttgagtcgaagaaattctaggtgggcaagcaatatacttatgatgattaggcaggattgatctggattggatgtggggatcagagggagagcatgcaccagcaccacactctctgcagctttttaggtgcagggtggctttcattcagtcatcaggagtagcagcttctgccgggcttggaaaaggaattgtggaaaagatttgcacataaagtgaaagtgaaatgggatgtacattagggcatttacaatccaaaaatggtcttgtgagggagtatgtcacgtactaggttaagccatagtcaagaatactctcttcttaatacatagtagtagctttaatgagctccaaaataagcaaccgcgacgaagctaatgcttgcacaatataattgtttcgataatagttccgcacgcacaaaggctctgcattttatgccgtaatataattgtttggataataactctcgtgcctttttcaggacaagtacatgcccatgaggccactctgacatatctgttgtgttggcgtttcagttttttagtttgtcgggctgtggtttctgccagtctaattctaattcgacagcctcctgtcgttgcaagctaaaactacttgtactttaattttatttctcccaatcttaatgaaatttggtcgccgattccttcggccgacccggcaaaaaaaaaaaactctgacatatctgatgtagaatcgcgagaccattcgctatgtcaccgcccttagaggtgttattgttttttttttcctttaattttttccaagctcttttcttattatgtagtagtatatatactactactgtaatatggagtactattctgtggagctcattgctgcagatagaaagatagatctttcatgggtgctcattgctgcagtgacctgtgaattgtactagctaatactagtactgtactgagtgacagtgtgtgtgagtggggtgtgtcaaccgaaggaaggaaccgagccataaaggaaagcgaacaaacaactttagtttaggcggccttttggttttgtttgtttgtttgctgcaccgctgtctgcagtttgccctagacaaccaaacaaatgcttccccatccgatccatctacctatatgattgtgagtaccagtacatagtagttagtgatcatcatcatgatgatgatcatgcattattgtcattatcatcatcaccatcatcgtctttgtgtccaaaataaaaatatctgtcagcacatatactgagtacatgtgctgtattttcagaatttcagaccaacattctgagttctgactgctgcatatatgtccatatatgtagtattttggagacaaacaaacaaaatttactaccgcggcgctcatctatcaacatgtacaagagcccgtgctctgctgtgccttatcaattctcctccgaattgacatactaatattaccgccgctgatgctggttctgacatattgttatctgctaaattctctaatgatgttatacataataatgctgaattctataatgatgtatttcatcactcatgttaatcagatgtttgcggtccttttatttggcatccacaattgttccttcttcctcttgctttgctcagctcaattgtttttagccaaaaacccagaagttgatgttggcatcacatcgcacgcatggaaatgaagaataaaattcgagaactcaaaacaattcaaatgtgtagattgattttattatccacttaaatcgactgcagtataaaattaaaggggatagaatgatctttctctatgctagataatctccctcactctagttattcaacacgggttaatgtttttatatgtttgatgaatccaccaatccgatgaaaaggatttgattgtgccatctattcaaccgtatccagttaaatctaatctggcgcacgaacaattaggattactatcgaagtgaagatataacacgaaataactactgataaatttctattttgcagcagattcccagcataatctcatttatactggaaatataatgtaccgtaaaagtcttctaaaattcaggctgcaaggaaactagtatttgtatataacccatatctgaatccaacaaaagggccatcaatcccatccgtttcgttgggggtacaacaaccttgaaaaagcagacatggaacatcatgtgctacagctgaaaccatggaccagattacatgtctgaatccacttaacacaagtcaaacagacagacagacagctagttagttgttcaagccaaaaggaaaagtatcaagccattaactgattagcattagcagcctacctacatcgatcatgctattgctaccacattttgacatgcacaagattcctccccttcctccaaaatgcatgaacgattttagcccactcatcaccacaaaagatgatcagagagggagccggacgcagcaaatcaagtcatcacttgttgcagctagtgttttcttgggcgaccacgcccccttcgaggcttctccgccgcttctttcgacctgatccaccaatcacgcaacatacaatggtcagaacgtataaacttcacagctgttatgtttacagtggaatgaatgctcacccttctgaggaaggaggatccagaaagtttagaacttcattcagagcatggaaagccatcttcttgatctgtaaaacgcacaaatcaaattcaagtcagtcaccacatcaaacaccagaaatttcaactgacaccaagctaacctctagcttatcttctttagccctgtgggaagatggaagtcgtctaaattccttggtcagcctaacacactcaccaacattctcgggggaaacaaagtccagtgcaaccttgatgcaggactgcagagttcagttcaaaattagcttcattttttttcatttttcagcccccatatacctcatgcaaatatcaggaggaagggaaaatattagtatctccatttacagtaattcagtcacaccttcaaattcctgacttggtgaggacatccggcaggaatcaaaactgcttcgccaagcttttgttcaaaggtccaaggttcaacacctgcaacaggaaatccacatataaaaacaggcatggtcatgaaacaatgtgattgcagagaactcaagatctaatgctaacatgtttactaaccatattcttccttcagctttcttttatgctccgcagttaaatagaaagcttgatcatgaattggatgaataacctgcacagttaacataattgatgatactcaacatagctcttggtcagcaaaacacaggtaatatgtattgttatcagttgcaacagcatagagaggcagacatacctgtttcactggattgcagtggatgtgccgaaattctggcgcatgcttcctaaggaagtcttgtaatttctcagagtcctctcttcggaaaatatcccacaaagcaccaccactttcctggtgctctgatacccctgaacctgtcttcggaggacgacctttagctttcttttgacatctctgagctccaatacgtgcatcatcagaattattggtctcatggttatggtttggacactgagctacatcactatgtaccacagattcataggacaatgcttcatccctggcatcacctccagcatcatcaggtggtgaagcgtttatatccaaacctgcattgtgcaagcaataaactcaacaaaacttaaaagtgggctaaaagattcatttcataccaaaagtatattttctccaccaaccattagacttgtctttcaaggtatgaacattttctttgctgcatgaggcctttggtgcttcaccaacagctttgttccccaattcaactgggcatgctgatggcttgagttcactgcctgattctatcatcccatatatttccatgtcatcttgcattttcatctttttctgcgtgtttttaatctgaacagcatcataagtctcacagggcacttccgctgtgtgtgttaagatgtttacctgataaaaaagatacctttcacaattaatcactgccaagacaaacaaataaagcacaagaaacaacaagatagaaaacatgatctatttgaatgtctgcagatgaggtacgtatacagcaaccagcaagtcaattttattcgcttatcagaatgaaagaaatgagcacaattcatacaaaacaacaaaacatcattataataatagagacatactgcatcagacatgtcacagtgaagtttggttacagagtcacccctgcccaactcttcagaaaatccataggcaatgtaagtttttggcccaagatctggcttcaggacaccaccaggaagcttcactgcaagatttagcggaccatatcgtggatcagtatactccggaaatggcaatgcactgataaattcagcaccatggcgaggcaatcgctgatcaaatgagctagaagggggccagtcctttagcttaagcatctcaggccagtaggtcctgggatgagttctgccccttgtatatcccataaaaaacatgtgtatgttaatttccacctggaaaatcagatatgaatgtagtaagcgccagaaagttcaactgtagatgaagaaagataggtttctctcatttcaaacagaaacacataacaaacattatttaatagggaagctcaattcactaatggatcaacaaaattagttaaactggtcaattatttaatcattatgtgtattactttcttctggaaaggcaacacatgcacacattatttcattgtcgcatttgaaaataagcatcatctcatgtatttctgccaaaagataaaatcaagattatgccaggtatgtaaaaagagtatgaactgtggtaaagtacaataaaccaaacccgagaaaaagagtactatcacataaacacattagagatcctcacctcacaccagtcgaggcaatctactgccctcacagcaaactgctcatcttctgccttccctttggttcgttctcgtactgcccgccacataaccatcggctcccagctaagaccagaagttagcttaagagtgtctgaaacaacaactggttcgccctttgcccaatgcatctgaaagtgcaacaggtcagcgtcctggatatcagtggccaccggacagtataagtagttatcactcgagtcctccctatttgcagcctgacgtaatttcttgctgtcacttcttatcttgcctgagtgatcaaaacaagggcacagctcacttgttctacctagttcttttgcaaatgtttcactccagaagaccttctcagatctatcttctaattcagggagcaacttctctggaaacaagcatttcagatctagagatgaaaaactgcagtcttccttttcctttcgtgggcaaggtatgctaccattactgtttgctttccaaagtaacagagccttcttttggttttcgtcagaagccatgcctttgtttgactcactgttttgggtgtcgctgcgacacttcaaagagtccctttggttctcaccatctgacagaatcttaccaaaagcataatccttgtctctttcttcaggatccaaaatttccacctcttctcctccagggatctcacctttgcgaagctcctggcagcaggtcaagcacaagtcatagaaacagtgcttgcagcttctatgaaaatcaactatagaagtgctgcatctattgctgcagttgacaacaaaattggatcagatgctttctggtattatatcatagcataaagtgaacaaggaaagaacttaaccaatagacacgctcatctagatcacacacagcttgttccacctttatttgatcaactgaaacacctgtaaacaaaacaagatgagcattcatagccataccagcttccagtctgtgtgctagagaaccataccttgtatcttagcctctaattccttctctgccatctgctcctgtcgcagttctatcagccaaggacgcaacaagcgtaacacatgacaggcataacgaatctgattttctttagaaatttcctttcttggaggctgcttcacaatgaatggaatgaactattcagtaagaatactagaaagtgtcatttattaactttaaaaagaaatatgtcctgaagaaatggaaatgctgtaaagaaaagatgagatggaaatgcaaacctcttcgacacctctcattcgcaggcatgccttgcaattacaattcttgcgacaataagggcattttgcagcaaattcattttcaggcaaatcaggatacctgtccagttgaattatacaacacatgggatcaccttaaaaggttactagaggtatagtgcataaaaacatatgtaccaaggcaaacataagatgaaacaagaataataccataaaaaatgtaagcagaaaaaatgggtgttatgggactatgggtaagatgaaagcaaaatgtacatttaagcctataggaaaacagtaggctgggagtccaactagtagactagaagtttgaggaaacttggcacaccattgattaatgcatggcacacaaaagcgcttattgttgcaagtcttgcaccagaccactctccctttgtcatttctctggcattggtgacacattaaggcgttttcacctgtcaacattttcttccctttctacataattgaaacaacgaaaagttagcacacccatcaaaacagttatacaattttttttaaaaaaaaaacttatacaaagaaacgtgtagtttatgaccccattattttctgccgctcctgtgtctcctctcttacgcttcttttcagtcttcgaaaccttatcattgactaacatcttgccttttactgcatttgcgttatgctgtcgaggaaagaaagtcatgggttatttcggtatcaatatcaaagagctggggttatgtttcactttgtaaagaacacaaaagtgcaccttccaagcaagtacatgaaacctctgaaattttcatgctttgaatgacaataacatgcttaaattaagcatgtagttagttacatcgaatcataacaggtattcagacattatctaaaaagacaagaattcaagcaagcacttgcactgtcataaaaaatctatgcaaaaccagcttgcatagaatcttgaaacttcttctaaaaaaaaataatcttgaaactgaccaagttcaggagaaacataatggtgggtttatcattaagcaataaataaagcgactaaaattgacggtgaaactgcgatcttactagggagacttgataattaggcccccacaaaacaaaattaatttaaagaagagatttggcttggtcgatgaatcgcaggtagcttgagaaggtatcaggtactcgttcacaaggtagcaggtcgagtaggaaacgttcaaaagtaacgatgcaggcaaatatatagtgaactgcgtacatgtcacaaaccaaaccgttcccaaataacttgtaaaaggaacgttgagtagtttaccctgtgggttttgatgttctcttgatccactttcttttttctgggtcctctcttcttccctgcatcacgtcttttgggcttgttgagaggctcgagaagttgatcagttttctcgacatcctattggcaaaacagcaattggtcagtataactttataagttctccctcaaagagtaccaaaatccatactagatagatactccatccgtttcatattacaagtcgtttgacttttttcctagttaagtttgttcgagtttttgactaagtttatagaaaaatgtagagtactatttcaacacaaaataaacatattattaaaatatattcaatgtagatttagtgaaactaatttgacattttagatgttgttaaattgtactataaacttgatcaaacttaatcaagtttgactagggaaaaaagtgaaactaattatagtatgaaacggatggagtagataaaagcacaaacactgaaacagcaacggatagcattttggagaaagaaccgaaaaaccgtaactttctttgacgtaaataaatttaaagatatttgtagcaatcgggcgaaatgagatgagaaagcaatggtggaagaatctaggggaaaaaatcaagatgttttgggatataaagggatcggattcgaaggaataattccgtactagtatatcctataccagtactagtatttttttaatcagattcagattcgatacagaggatacacggttgctggaatggaatggaagatactcgagcggaaactgaacagacaaaacaaaatgtatattgattgattgaacacactgcgtctgcaatggctgcttgattagcaacaagaacaagctgtttgatcaacacatatgacaggacagagggggggagagagagagattccctacctcatcatcgtctggcgcgttgaaggcgttgggcggcggcttcctttccctgagcgccccgggcctcgtcgcaacaccgcgcccttcttcctccggcctcatcgccggcgggcggaaagcccggtcgccgttccggcgcctccccttggcgcccgatcccctctgcttaccactcttccgcttcgcctcctcgccggatccgtcgatcgccgccgcctccacctcctccgccgccatggcggtgcggcgatggtattgatattggggcaaaacgagagagagagagtggcggctgcggcgtaggctctcaagtgtcctccttttattacccgcgcttccaatattccaaccacagttacaaaaaggtcctccaagtttttcctttttttcgttttgctttcacaacatttgaatgcatgcccgtgctttacattgcatatccaattttccaaataatactaataccgtgcaaatgcaactggttacttatatataaatatgatggtcattaagcttcaagttttcactagtgttttccttaggaagctcttacgcacaaacacaagaagaaacgttcagggatctttcgactaactccgtgaggtggtgagcgtttttttttcttacgcacaaacacatagtatatgtacgatgttttgctaacgtatggattttcccgcgcaattttgagcgggacacaaggttttaaatgtatgaattgattgaatatacaataatagcttttgtttcgaaatatacgtagtccatattttgtatataactatatcagtcgatatctcgacggttacaatctaaatccaccgttattatttgaataggttacatttttaatatagagtatgatgattagataacagatagtaataaattttcccgcgtaaaattggtacgtgcttttttatattatattttaaggagtggattgcataatagagtactccgcgtctagaccatagccatcattctctcttttaacacctaaaaaaagcatttgttcaatgtacagttaattcaccttatttaaaatgtacagtcgtttaagcttgatcttttccctctaaaaaaatgtatatctcttgcttctgtttacgtgcattttgtattttttttacagtaacatcaatcatcaatatatatacacgtaatatggtacacacgcatagtgaaaatatttcatcttgttttgtctgattattaaaaatgctgtaaaccatggtgattatttatcacggaggggacatgtaaatgagtaactagcgaagatatactgtgtacacaatggaagcaagcaatagaaggagtttgtgatctatgtgttttgaatgtgtgattttatggctgggtttgtagagattggtcgaagcaacacctctctctctctcttatactatggccgagtttagttttaaactttttcttcaaacttctaacttttccattatgttaaaactttcttacacactaacttataatttttccgttccatcgttctaattccaatcaaactttcaattttggcgtgaactaaacacatccacgtacaaactttcaatttttccgtcacatcgttccaatttcaacaaaacttccaattttgatgtgaactaaacacaccctatgaatggaatcgggtgaagggaagggtgtgttttagttcaagctaaaattggaagtttgtttaaaattggaatgatgtgacggaaaagttggaagtttatgtgtgtagaaaagttttgatgtaatgaaaaagttggaagtttttttttttaaaaaatatggaactaaattcggccgaagtgtactcaatcatagaaacaagaaaatgtggggggaccttgtgtaaaaaaacaggtactagtagtatgtcatgtcctcctcgagacgcgcacaggcaggcaggcaaaacaggcggccgcaccccgttcacttccttctttctggctgctgcagccgtaccaacgcacacacgcaccgcacctcctccagcgcgcgggcaccggactagtaggaggagtagccttcgaattttgaaatttgaaccctcaaccatttggagggaagctggaaaggaaaggaatccatcccatccacgagtcaattcaaggtttgaccacactctttccgttcccctcccaaaggcgtattttccctcgatacgtctcctttcttccccaccaccaccagaccagagacagggggagagatggtgtggctgcagtacaccgccacccgctcccagcgcgccgccaccgcctgcttcttcctcaccggcgtcgccctcatcctcgccgccgcccgcctctcctacgccaacatcgagccccagcgcgccaaggccgccgaccgacgccgtgtcctcgaggacttcatccgccgcaagcgcaaccacgccctggacctggaggatccccctcctaaaccctagctccacctgcctcctccttcttccttcatcccaggttccccgtcagattcctcactctgctgctctaatctaatcttgtaccatgtggattggatgcaactccacctagacctagcaaggaataaatagcatagggatttctattttacttactcactcactgctgtatgcatcactcttttgcctaaattacatcaataatattaatatatcgattggtttattcattcagtggtgattattcctgcaattcacttcttacgtccatcaaacgtttgttactcttactaacttttattttcattaatttcttccgcgaatgccgtctctaattcttgcaatccaacctttcctactcacaattacaacagcatgcgaatgaatctcgatcaagggatcctaccactgttttctacttcatgtactattcattccattttttgttttccccctttaatttctttacctctccttcagccttgtcaattgcaattcaggtattgccaatctaatggacaaaattacccccaaggagtttgtcataaccacatctacttcttttaactccactaaacccattgggacacctctgggtttgctaccaatgctactcatcatgctgcctatatgtgatatctcatcactgctaatcaacaactgaactgacaagattatctgcctacatatgtcaagaattactgcaacttgataagaatatttttgtacaactaggaacccttatgcctgtataatctccacctatgctactgatttccctcactgctgtatgactcactacatttcctaaatgtcatcataatacattatttgattcatcggctgtttcccaattcacatgcatcgcacattttcgattgggctatcttcttttgttttcgtacttgatagaaccatgctcctgttttcagtcttacaatctgcgtatctctcctccacctgtcagtttattttgcaaatctcacaatctgcgtatccctcctccagctgtcagttttttttcaatgcaaccattttttccaaaggataggaaacaaataatcaagagaacctacttttgtcttctattctttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11691 - DNA, 623 bp, Oryza sativa
gtgcagcatgggtcaaacagttgagttgatgacgatcagtgaagtgaggatgatgagtcaagcgcagctgttgtgggtaggtacctgaacgtcctccacggcggcgcggaggtcggaagagtccttgacggccttgaggtggtcgacggtgccccagacgacctcgaggctgtcgacgatccgctcgagcgactcgaccaagcttccccaggtgggctgcacgcccttctcgaggtcggtgagctcgccctcctgcatgcaacaaggaatggtcgggtcagatcggaaattaaatttgcgggaaggaagctggtggatccagggcagggcaggggacgtacgaggcgggcgaggagcgtgcggacagcggggcggacgtggatgggctcgacgcggtcgaagggcgggaagtcgaagtcggcgaggagcgggttgtcgtcggtggccatggaggaggaggcgtaagccgcggaacaagtggcgggcgaggggcggcgggaggcggggcacaaggcgctaataggggaagaggccgggaggaggaggaaggccctagacctagacctagaggtatatgaggaggaggtagggtttgggaggcgagctcgagcgacaagtgggag

SEQ ID NO: 11692 - DNA, 21496 bp, Oryza sativa
cagttatgtttctaggagaaaagtgcttaatacgatgacatttccggtaagttgggttcgtcaatggcattttcttggattggagcgcttgtcgataatattttcttacaattttttaaagaagacaatatttatcaaaaaaaattgaattgttcttaaaatatgttcaaatttgatgtggttactgcatgattcccgttactttaccctgagacaatgtttggctaatgggaaatggaaatgatttcccacccatcaaaaaatatctttaaatcctaaccattcattctccctctttcatttaattataacccttcatttattttccaattataatcccacctccccattttccattatccaaacaaactgttctcaagatacaaccatgaacgctaatttagcacgcatgggagccgtcaggacaatataacagcatgtcagcatctctcaatttgcaatttgccaaagaagaagaatcttttattcattataactaacttgcaaatgaaaaggagaacaagggagagtagtgctagctaagctagtgcctagtagtagtggttaggagttgtggatctgttagagaattaatcatcgatgtacatcaattatattgttccgggcaaaaacctttctttctgatcttcgtcttgttgtcgttattcctgactggcttggattaattgtgcgattgctactcctcttatatgattggtcagtataattggttaggactcgtgattattccagctgctacaacgcagcatctcatttcatttcatgatgacgcggttgcaaaggcgcgacacatcagacgggcgaaccggtttgatcaaaaagtcttcagccccctcctccaggcaccgccggattctcgtcggcgaattctccgacgacattagcaccaccggaatctccttcagctccgccgactcctgccatgcacaatccaatccaatcttcagttgctactacaacatccagatacagagagaggagctgagtgactgtctgaaatgctaaccttgaccctcttgaggagatcgaaccctgtcatctccggcatgcagtaatccgtgatgatcatatgcacattccgatcctgcatcataacacaaactaattttacattcatttctagcaattcttcaaaactgactgacatccacaggcatagggatcaaagaacataccaggctgagaacctccagtgctctcttgccactatccaccgtcgtaactgcatgcacaacaacaaccaaacaaaattaaaggtgactgactgcttattgttcttgatatgtacttgattgtactaaccaaccagaccaaatgagcaatcaacgacttcattctacatgaaactcaattctacacagatgacagatgacacatatatatttgctagctagtagtcatatcgatcagttaatagaaataaaatgcgcgcaattgtacctcgatatttggagctgcgcaggagtctggagatgacagtacggtcgacgatgctgtcgtccacggcgaggacgtgcggctccggctccggcactgtcttcgtcgacatgaggcagagaatggagcagagcagagtagactctctcttttggtgttcttggcgatggacaagtcgcagcctggcctttatacagtggtagttggcaaaaaactgagtaccgaccgaccacagaatatacaatggaaaaaggaaagcatttccaacaaggagaatgagaagaggatgagaaatggaggaggatgagatctaagcaaatctgcagaggccgtggtgcagcgcttgccgaagcgcctaccccctaccataccatattgtaccatgccaggcgtagctgcctgcccaaatatccatacccataatttcctattcaggctcctcattatactagtatctgtttcacatggcacaatactgctcacccgccctcatcatctataaaaaaaagacattaattacagtcaacacaagtgtgtgtgagaaattagggggtttaaataagatgcccccatgccatccatttccttctcagctagatgagtcacaccttcatatggatttcttatagctagacaagatccagatcttgagtagcatattgattgattttgtcccctatctcaaggttttggcatttcatttggctgtattgctctttgcaacaaggttcaaacatgcaaattcaaggcagaaatgtgagggaagttcagcaacggaatccatccctgtccctgtaccttagggagccttcccaacagtagatgcactaaacacccacgctacaagaccaacaaattatcaaggaccaaaacaaatattttccagcaatatatgccctaaacacccacactacatgcacgaactatccacattacagcatttttgaaggaaacattacagcatgtccaaaatgtatagggaatcttgaggataaaattatttgtgcacggcaactactactccacagtcccacccccattctaaaaataataatggcggaagaatgcattcttcaaaaactaatcaaatttcaagaacccagagattctgatatatgatgtctgacctgaggctggagagttgagaagcccctttattttatttcctgaagtcagtttctctgtatctggactgccgttcagaagcctacatccagcatagcaacgtgattggtcgcagaagaagggttgctgctgctgctgatccatcttgggagtcgtggctttttctttatgaagcagcatttccttacttcatccttcataagcgttcaagtttaagctgttcaggtataatgagctgctgctcttgagtaaacatcaggggatcacagctcagaatcataaggtcaactcaataaaaatgaaattttcagctcatgcttttgagaaacgtaagaatcaaaggccggtaatgatgcaagaatttttcatctgactctgctgcaacgtaggaaaatgtacttatccttgcgcatttggtgaaaacaaaatggatcagatatttagattcagttcagctggagatacgaggtgctgtgagagcgagacatttgcctcttccacacacctaaaaggtctagtaatattcaagaaaaacaagagttgaaaatgttatatagttagctactgaagcaataatccacagcaaaattccgggacatgtatcatgtatgtggcacagtaccactcagagctccactctgaagccatgtattgctgatctgttttaaaaaacaaattaagattaaacaattagcataacaaaacacatcttttagcagccagatggcattgtggagcacacaaggcccctcatacaggctgcactaaagaagagttcacatcaggtattaaatttgacgtgtcaatctaaaaaaatataataggtcggcatacacttaaacacgcccctacttgtgcttgaggcaatctttgatgttggtgcccttttacaatatgaaagtcaaccatgttactatgaatttgaagcatccagcatgatatgccactatcctgagcaatgacagatggatcgcaactgtgtgtcaacaattgacaaaatgcatctaatgtttttaatgcaggagatcaggaaagtaacgagagaagcctcattgtcatctagaagagaaagtagttagtagggacaattctacactcacaaggcattatttggcacatatgatcaaaatatacccccattgcatacacaaaaaggaacgaacgttcaactgcaggatagagttttatccaagggaaacgtgataatatagtatagtatctcagataggtaaaaggatactgcttgtaccttctaggacaaactgggtgaaataggatatgagatgttcgtagtgccacatattccatttcttattggcctagaacagaattgatttaaaagcacaaatcacagcagaagttgtctatttgggctactaaatgtaatacctctccgatgggattgccacaccatggatggagaactaccagagtttatcataacttggctagtcaaggattgcatcatatctgttctatactgatagctgcaggataaaaataatataaataatgagaatctcaataattcgtcctccaacagaaaacagtacaaaatattgtagagaaataaagaagaataaagaatatgacaaaagtagattagcaggatatatgatataccaaatactcaagcagattctctctcatttgtactcattacttacagggaacattatgatgtttgtgtattctacctacaaaggatacagatatctacaacttgtacaaaaaagaggcacacatgagaaacacttcaaacctatcccacctaaaagatgccaaactatgtagcagactatacatgagctaatgttagcagcatatttaccttatgcatacaatacacacacacggctccaatttttcaggaatacgcaaaaggattgtgcacctttgtattaagagaataaaacacacacaggtccaatcgaaacaagaaaaaaaaactctagaacagcgtcttatgtttcaacaagtcctatattcttgatgacaaaattcaagaactccacataagcaacttaatccaatgatgaattcatatttttcatcgccagattatgctctccacaattatcataccacaccactctgtagaaaaaattccacatgttggactatttaccctcgccctctggctacacgaaacttgcaacagcaatccttgctcaattttttttgttgttgcagttttccagatagttgaaactttgaacacaaaacgaaaccagtcctgcggtaagctttcagatgttcttacgaggctgttcagtagctgactgttctaaaaagtatgcagccataccatttggtccttttttagtattaataacagctgatgagggtagaggagcattaagagaatcgataacatcgtcaacaagttcagtgtactgtgtgtcagttagctcagacatagtaccgctcccagtgccactactgattgtgaatacttgtttcctttgccgaagccctgctgctcgtgccacttcaaaatcattgcttactcccattgatgaatccctccaagaagcatcttgtgcatatagttttagagaaggcgttggtgcaagagaaggtgtaattccagctaccttcggagggtcaatgggactattctgttgccagaaatcatatcaaggcagtaagtacagttccgataccttgtaacaccagatttaaataagtcacagaactcaccttagtaaagaagatagaagttcaaagcaacatctgagggaatgtgactcacctcatggtcctcatccaagtcttctaaatcctctttcacatcgtccaatctactgtcttttgcttccttatccatccgatgccaatcaggtaattcagagcccttgggggaaactgaagagcaagtgccattggttagtaaagatacatattctattttcccaaattaagtgataatgtattaatgtgcaatcaaattaagccataatgtcagattattgaaataagaaatattgtgctatccccttggtctttttcccactgtgtagtactattactgctttcaatagaattattttaagttccattttagaaagttcacccaacagacactcacctttatttccaacatctatagacagttcttggacagcctctgtaatgttgagttcagaatgagaagaagaagagcatctggtattatcatggcttttttcagcttcagtgccattatccacaaagaggggcatccctgccaaacgaacagcaacttctggtccatcctgatactgtggctcagaaaatcctttgtcaaaattttcagtggctatggggcaattatcatttggagcatatggaagcgatcctggcttgttcagaaaactttcagtgtacttgacatcctccgtaattatggctgcctgctctgaattataggcaatttcatttaatgtttcgttttccctttcttcaccagcgggaatcatatcaaaactatgaacatcaaccattagaggatcagttgatccttttccagatgatcttacagcttcctctgtgcagttatatgaagcagacctatttgaagagatttcaggagtcaaagtctcctcaaaactaaaattttcgtcatctgtctcaactgattctccacgggctgcttcaggagtttctatcaaactacattcaggcccagatgacatggatcttgagtagtacggatgatccgttgaatattttgactcatctaaaagattgcaagcccctgagaaacttgagatgcttccatctcttgggtctgacggtgttttgttggtatcctgtagatctgcaaccatggattctccagcaacgtagcatgtagacttctcagcaatatcaaccttatttcgagaaatgggagtcattgtatgttcatcttgtagcttgaatgagcctttttgaagccctaagagatttctgttgatctgtgtgttatgaaaaacaaatgatgaattatttgaatcagcaatgttgccatcatctagagatattaaagtcccctcaatgctgaagataccatcatgaagcctatcagatgataatttctcttcaacttgaagaatgtctgaaatactagcatctggaatatcttgagaccccaaattggtaaaatgatctttagaattgtcatcctggagagccatgtaaagattctcaaaacataaagcggtttcttctccttgttgatttccttgctgaccgcttcctaaacatccagtcaaattgacatctgcagagaacaatgatgaagttgtcttgtatgggttattttcagccttggaattctgaactgtatgaacagatgaaaaagacggtaagtccaagtaatcatctgattttcccatgtcattgcctgtgtctggagttacgaaagcattaacaacattggatgaaacttcatgtagtaaaccatctattgattccccagcaacttcaagagtttctatcatgttggtctctggaataaattcaacagacctgttgtttccataattttctgtactattcacactttgaaacatcatggtgttcttatcatccaagttgaaattttgattgttccctggttcagccaatgcgccacctccggtagcatgcattatgttaacctctgaaacacatgaggatgacctggaatagagtgaatatttttcagaatttatgctctcttctggagatacaaaacttccctctacaccaagagtaagtccctgtattgtttcagatggaacttgtttgccatcatgaaacgatcgaatctcatgtctgtctgaaatacattgagaagatccagtgttattcgtccaattttcagctcttgtaacctcatctagaaagataggattatctaaaaaagcagaagtttttccatcttcagactcagaaaatctgccctgaacagaagagggtgcattgtcttctgcagcactggcacgtaaaaggtaagaactcgagctgcttgaataaaatacatcattattgatctcacctgaagataataaaatcccttcaaaattacaagttatttggtctagctgattagaaaatgcttcctgagttttctcctggccaccttgaatttttttcctcacgttggtgtctggaacaaaatgtgcagggttactatcatcacatgaagggttaacagcagcctttatagggttaaatggcccttcatcttgcgattcagacaaacttttcttgacagcttcatgagcttcagtaatggttgtctctactccattgcataaaaaaaatcggatgtagctaacgagtgttcagaaatatcaactacaggtggatccataaaatcttccttctccaaatcaaaaggtagactgttcggctcctttaagtgcaagtcatacgataattcctcctttgagacctcatcgctatctgtgagtagctctccagatgttgggttgttcaattcgggattaactgcaacaatcctaggaatttccatcatattggcatcttgacagcataaagggaaacctgaagttttcatgtactgttcagtggtactgactgcaagcggacccagcagagcttcctcctctgaacagatgaatacatcatttccttcctgcccgttaaatccacatggttctttttcccaggtatcctcatcacccttcatcgctaactctgcagaggatgaaaatctcacctcaggatcctcaaattcctcgcaatgcgactcttgaaatgctggaaggttcaatctaggactgacccctgtatcaatgtctgcaacagctgcaatgatgtttgcatcagtacagatgcaagcaagtgcattggtaacctcatcaggattaattatcacttcattgtcatcaatggcatgtgaagtagggaccttctctggagtgacagtatctgtttgcagcgctgtcaatttgtgtggctcaagcaatgagtcctccttgccaccctctggaggaacctgttcaaagttttctaatgcagatagcactggatcagatggatcctggctcacatcatttaagctaccataagcaacaatgtagtcagatggagaagcgggaggttcattaatagaaactggataggattccagtttttctggttgagatggtgagctttcctcactgactttgacaggcatttctctgaagacagtcattaaggatgacatcccatgttcagttaagcatgagtcacctctatcaaaagaactgtcatgagagttaactggacatatgagattctccttgcaggagctgaaattagtgttcacgatgtccaataatctatcaaaaactttgtcttcaccacctcctacaggcgattcgtgatgaatagttggaggttcagttaacttgacaaatataacaggtccagaatggttcctgtaatccagaggagagaaaacagtatcttcaataggatcatgggcaccaccttgctgatctaaatgtgtggaggcagctggtacttcttcatttccatctctcagaaggattccaggataccctatcaatggtgctgaactgccacaaatcggttttatgttgtttgattgacttatagaggaatcacttaattcaggaaactccttgccgcagatggaacctgcgacactagatgacattgtattctgtgtatcttcctcgatgctttcggtagcaatgcttgttgttctatatgttttctcacttgagaatctcctcttccgtaggccatccaagggcatcggctggaagtccttactatgaccccaagacatgtctgcttcaccatcaccccttgagctaatacttggctggcggcgtttcttaggtttagaagttctgttctctgaatgagttgctggcagaaaagtactatttgaatcagttgccggcaaagaattactggcatcatctacatcgccacagttctgcttctgcaccaacaaacaaagagcaataatgttgagcaaagcagaacaaaaatggccaaagaaaagaaggaaacaataaccaaatcacataaatgtaaagaactacatcatttgcaggttaagcttatatgcagagaattagaatgaaggaaacaaacagacctgtgcactgatcaggtcgttctggttaggcttccttggctcaccatcatttgcctgcttctgctcctgaatccttttaagccttctatggtccttgagatcaactgcaaagcaagatgagatgtaaccacttgagagatattctagcaatgcactgtgaggatacacaaagaattccacatatatttggtagcaagtgcggagctttaacagtatgaagacattggtgctcaagcttgccaaatgttagcaacagtctgaagagatagagtcacagagacaagaaaggtggcgaagaaggatgttacgcacgtcttctggtgaagcggatgaaagcggcatagatgagtgtagctagagcagggatgacaagaacaggcagagcttggatgggctgcctccagctcaaattgcgcctcctggccctccagaaagcataaacgaacaccaggacctggcgatcaatttaagcaagaaaagataagaggaaaaactgaagtttttcaattcagaagtaaccaaaatcacatgatacatcaattgagattaaaaaaaagaagaagaaaaaagactatccagccaacgttggaggcgacttgcgtgatcgatcatcagcatccgcgagtagcaaggaaaaataaatcgattggtggtgtggctagcgcgcgcataaaagcaaacacctggagcgcgcttccgtggaaacaagtgtggtgacgtatgggggcagggcagggtcacctcacctcgaggttgaaggagaggaaggcgagcttgtgggcgagcctccgagccgccgccgctcgcctgacaaggcgcgaacgcaccaccgtttcctcgttttgaccatcgtcgtcgtctccgggcccggcggggtggtgtgcggctccagtccggcgccaagcagcgcggaggcgggaccagaccccggagaagaatccgacggagggatcatcggcggccatccctttcctcctcttggctcttgctttctctctctctcttttctgcgcactaactagtctctcgctctcgtaggacatgcacgccacgccacgcactagcagaggcagaggcagaggcagaggcagaggagaggctttctcaactcattttttcgactcttttcctatagaaatcattcttgtgtgcagttagctaatggttctttaattttcctctaatccaaataaaatcatatattgtgattcagacaagattttgtactcgttgttggagagtttgtgcctgccgactcatactgcgccagccaactgaatgggcttattattattattattattattattattattattattattattattattattattattattattattattattattattattattgcgtttacgttcccccgacattcatttatttttaaaaacttaaaataaccaatactcgattaattatatattcacatcgtttaacgtatcttctctttcccattatctcgaacacaagtgctgagcctttcttaatttctcaccatacatactagtactatcagtgcaagcaccctaaaccggaacctagcctataaagttgacccgaagatactcatccctacagtgcaaatacctcttttgtgtgacttaattagatgagtgtagtgtgggaggaaaccgaccctatagtgggcgtgatctcgggctgatatcgggctcgtggacacgggtagtggggcgaaataatttccccacctaccctcgactcatcttctcctagccctcccctccatcgctttctcctcctcccggtcacccttcccgtcgctcgccgtcgcctcctccccgtccggcgccagttccgcttccgctcgctgcgccgcactgctcctcctcgcctcaccgcgcctcctctcgcgtcgtgtctcgcgcggcggcggctgctactgctccgacggtggcgagttgcggcaggcagcggcacaggcccctagattcgttggcggtcgtcaggaggcgaattgcctggagaccccggagcaagccaccgccgccgcgcctcctcgcccacagtgcacgcggcagctgcgaggaggagggggagtagatccgggttctttgcggcagcggcaggttctcggtggcgggaggcgtccccggttgccgccgcggcgtcggtcaccaccactggcctcgccgccgcccggatgattttgcttcttgacttttcttgatgatttttcttctctttcaatccccaagattttcttgtcttttcttggctcggtggtgggaggaagaatggttgtggcgggagaagaatttttgtgggcacaacggggatttctcccccctcgattggtgcgaggtcacgggcggggaagaatcgcaccccacagtgctgacgcctctcccagttttggccgcgcgtggactcgtgaacatgaggttttgcgtcgccatgctaggcgacgaggtgccttccttggtcgcggtcccgccctccacgtcgacccgaatccgagctagcgcaacgagatcacgcgccagctcggtgcactgtgagatgaatctgatcatctggcgggcaaaccagtgagtcagcttgtttgaggttacctcagctccaacagtcacaagtagtcgtacggtagctaggtaggcagcaggtaggcatttttttgcattggcgggcaagtcgtagcagcgtagcttgcgactgacaaggcagaattcctccttatcatctcgctggagttggacggcgatgagcaagagggcaaagcgcgtgggcacacggcggtggtcgtgctggatgcccatggtcccaggtaggccaagctgccaggggttaccagcacgcacccccatggcgttcaactcctcagagaacgtctccggccacacgtaccggaccaccgggggcgccgtggccgtgggcaggtcgaaggcgcagaggcagcgcaggcgtgggcagaggcccagctcggggacgaacacgccgcgcccatcaatggggagctcccagtcgccctccttgcgccaccccacccccacgggtgtcgaaggagtaggccggtgtcccgctccgacacccacacgtgctcgccggcgcccatccatccccgcaacgtgccgccccagagctcgcgcggcggcgcctgagactcgtcggcttggagggaggaggagctggaaggtaggggatctcctgcaggggcggttgccgatggcgtagactccggttcccagcgggatgaggaccgtgccgcctattatctcttccggaagctccgggccaggcgacaacacgtcggcggtggcgtcgcactcgaggtcgaggaggacagtgcgcttgcggttgctgaccccaacaatggtgttggaggcgacgacggcgaagttgaggtactcgagagcgagccgccgcaacgtgtccatctgcgccatggggcggggcaagggtctcaacactgtccactcgtcgtcgtgggtgaacatgtccttgatgttaatgttgaacaagaggtaggtggtgatgcaatccatcctcttctcttcttccaccaccaaaactagagttttcctcctccccttccatcttgtgcttgtgcgctgctgctgctcatccgcctccatctttttttttctttccgaagaagatactccctgccccgcctagcctgtatcgaggaaatcttattatacacaagtggagtatgtagtccgattccgtttcgacctcgctggctgcatcacaagtcgtttcgatcctacaactgtgtcgctgtttagagtcatataggactttcttggttaggtccgatactctggttaagttgatatttctctaattgtactctcgttttatatagttttgttatgttacatctatcaactaaatagatttttcatatttctgaactgggtgatgaacgtagagcagggtatctgcatgaatattaatttctggtttgtgcaaattaggcacgatcaatcactagaagatggcacggtacatagaaaatcaaagaggaagttaattgtaggagtaaaagaagtgatgcacgaatgcatgcatcaatcacatacgatcttttttgtttgaactaggagagcatggagctcccccatttccattaatagaaacgtagaggttacagagtagcatcaagtttcaggacatcaatcacatagtaagaattaagatagaaagattcagattgttcattcagtcatcgtctccgacatggaagctcaatctggagtggcttgctgtcttggtagctgctgcttccgcacaagattctgaatcagactcctgcaggggccaagttagtattagtaaatcaggagtaagaaagaaatatgaatcattcatgagcatgcatggatatgacattgagggaggaaaagcttatcttcattaagcaaagcaaattaatagtactagtaatccattaaagacggacctgggtattgtgggtgaggaggagcttttgcatgttgtggtggcttcccctcgagtggcccatcttggccttgttcctctctgctcgaagccgatccagcttctgctggtccttggcgtcaactgcaatcgacattaactaatttgacgatcgatcattggttattgatttatgcagtggctgcctccactccatgcgcaattaaggttgagaaagaaacaaattgacgatcgatggaggaactaaggacttactgaatttgtggaagcgggcaatggcggcgaagagcaaggcagcaaaggcgggcacggacaacagcacacccagcagtagctgcttcttcttcttcgttttattcgcagcagtcttgattctcgccgtccacaacccataaacgaataatccagctgcctcaagggcgaaggaggtgaaagcaatggtgcgccggatgacgcgggcggtggcgtggcgcctctggatgctggctttgacggcggcttcctcgtccgcgaggcgccgctgctcgtcggcgtcatcgccgagcttccaccacacgcccgagaaggaccccgtgcggggcagctgccgcgccatgatcgatcaggccggtgctacgtacgtactaccttcgatgttcgatcgatcgatcaatttcttcttctttcgatgtgaatgcgatgccctcccattgagaggcgactatctagcttgctagcggatcagtagcttttcatatttatcaaaacgcaaccccaagttgacgatcgatttcttttttcccgttttctctgtatataatgtaatatgtgtgtgtgactggcatacatctcatactgacaccagccaaaatcactagattaatatgatccatataatactcttatttgacagtaagaagaatgatcgtgccaggtcgattgcagtgcagattttgacgccgaccaactccaattaaatcagacaaactagtactccttcctaccactacatgcatgccgcagcatcatcatgcttgcgtttcgtgttactctctctagttgttagtgctgaccgttgacaaattgttggaaaagttcactgtagatccctcacggtaacggtcaagtttaaatcttatctctcaaccgtaaaaccaggtactggtttgatttggtccatattccacgtgaagttatgagcaaaacaaaaattaaaaaaatataggctcatatgtgaactacacaaaaagatttaaaaataaagggcctcatatgtcagtgtttcattaaggaaatagctatacatatgataaaattggtacgattttgttacgatcctgtcttgtatgcgtacgattagaccatgaaaacatgttggaagcatcgtacgttgatcgtaagagattttatcgtacgtatagcattggtcgtttcccaagtcctccatctcaccctctctctcccctctctgtctctcatcaaatgtcgccagcgacaaacctccatttttttatccccatatccctctcgacaacaaggtgataggcagcgggtagagcgagtgtgtgtggccggaggcgacccgtggagaagcgagcggacttcgacgagcgtgcagaggcgcaggtggctgcggaggagcgggcaacaacattcctctccagccaatggttggcctccttccccttctcgctccccagatgctaccggtggctaacaaaagaggagcaagacaacggtgacctcatctctgtctaagtggcttcctctccatcagcgtcaaactccctctctgtcagcattgagctcccttgtcggccgaccactgtcgccttcttgagctcactgatgcggcagcggcggatctcaagctcaagctcacgaaggagggacaccaaccacaccatcctcagcttgcctccccacaccccccgccacatccttggcatccgccttcccgcgcccgcccgctctagtgatcacgtccttgccctcatcttcgatgtcgttggccgtgtttgcctcgacctcgccggctgcgccatccttggcatctgcctccccgtgcctcgttgccaaagatcagaatagagagagaggtgctttgtgcatatggttttctttcttttatagtggggggagaccgagagagagaaaggggtagagatggttttctttcttttatatttttcatgtgattgatatgtgagtcatacactaactcaaccaggttggccatagtcaactcatcacgtcagttaaaaccagatacaatactaccctaagattttaggtactctgatatttgtaggttaagagacatactatatttgatattgcgatttaaggatgcgattcaaactcgatgacaaaatgtacctaaatttgacttattcataaattgttgggcgtggcagggcaggccctgttacaagatgggccgaccgaggaggcccgagggtttttcggtcaggacaaaaacactccactcacatcctcctcatcacaaatattttattttctgctttattttttcccctaatgaatacctgatcatccaatactttaaagacatgtactgttggatatacttgtgctttctatactcttttttatataatacctaatcccttcttcccataaaaaaccaatctagtgttggatgtgattctttttttggacggagggagtacatcgttaatatatgacactgattagttaaaaatgataaaaaaaaaacaatcggagagagtatataatttggttagtaaaagcaaactgtaatgattatagatttgtgtttctacaacaacttggaagataaacaagcacaggatgacacataaaccagtttagctccactccggaaaaaataaaaaggacaagtttacaacaatccaaaaaagatttacagacagatccagcccagagaatcttcatctctgaacctatctaagctaggagtatctcccaatgccccacccttccctgctaaaaacctacacaagtcccaaatcaaagacccctggtatttaaaaagtgttgcctgaagaatgagtcattctttgagccaagacaaattgagtggtaactacactttttttgctgctacggtacatgaagtaaagtaacaacaagccggccagccaggcgatgatcagctgctgatcaggatgagatcagctgctgatcgatcgatcaggtgagtcctcctagctctccctgatctcgcggcacccccatgcccatctgcacctgcacggcgtctgaccaccgcgctggtgaccggtcgctgctgttcgacgacgacattgcctccgcccttgcctccctcaccatccgtagcacctccggtgtggttggccgcctcgccgggtccgccaccacgcaggccgccgcaatgctgatcagcgcaccgagcttctcctccgtgccgccagcggacgcggactccccgccggactccgtctcttcctcacgcactgcccgcacccagctcgggatgtcatcgctgtgcatctccatcaggtcctggaacggcgccttcccggtgagcagctccaggaggagcacgccgaagctgtacacgtcggacgccggcgtgaaggcatgggcggtgcgagtttccggcgctcggtataggacggacgtggaggaggcgagatcggcgtgggaggggagcagcgtgggcaccagaccgtaatcggtgaggcacgattcgaagtcggggccgaggaggacgttggagggcttgaggttgccgtgcacgatgccagccggcggcgactggtgcaggtgcaccagcccggcggcgacatcctccgcgatcttcatgcacgacgtccagtgcaggggcttccccttgctcgacgtccggctgctggaccctattgtgcatcataaatttgaatttggttaaactttattccattaacacggcatggctttttacctacaaaatggattaaaatacatgctctacatttaaaaaggatgtacacagcacagataaggcttgcaaattgcaaatgcaccatgaaacaaactttcaacaatccaaacaaaataggaaaaaaaaaactttcaacaggcatagcccgcgcttgtctgtgactgtgtgtgtgagggcatggcgctatgcagcattgtccgattgcctagtctcttgttcatacgcagaacggcagaagtatactagtagcaattatttactgcagctcagattcagatcaggaccacatgctcacaagcacttacctgcttgtctacatctgcatactgttgtccttgtgagaaggggattttgatgagagcctgaaatagaggaaagaccaagccacagtggtgctgcggggtctactgcctcagatcaagccacccattacaactttacaagaacagggataggccctgttctgtcgtgcatgaaagcatggcctttgactgcctcaactaatctgggggctttaagtttgcttgtgaatgaatgagtgactgcatgcatgcccattatggtggatggaatatttcaatgcagagtgtagtgaccaattgaccattgacccactgctttaaccaaaccaatattaggccaggtttagatggcaaaaatttttgttttggggtgccacatcggatatatggatacacatttgaacatttgaagtattaaacgttgtctaataacaaaccaaattacagattccgccaagaaactgcgagacgaatttattaagcataattaatccatcattaccaaatgtttactgtagcaccacattgtcaaatcatggcgtaattaggcttaaaagatttgtctcacaatttacacgcaaactatgtaattggtttttttgtccacatttaatactccatacatgtgtccaaacattcgatgtgatgggtgaaaagtttttgttttgggaactaaaccgggcctcagtactgctaataccaagttggtaaaaagttcagcgcatggatagaatggcagcagtacagaggaatgcatttttacttgcaagaaatgaaaactagtgcagctcagtgacacatgaacggaaccagccatgttgatgcacagttggctctgactatctgttcctattatccagagcagttagtataattaacttttcatatgatatgctctatcatttaccaccagttttccgggtcctaaaattatgccctgttttcatgggagatgttcccaagaccctatgtggcacatattggaaggttattttcttccattgaaaacaaggagcaatttttagtcaatgggctttccattctgaaaggctgaaacagaatgaggttcttcacacccatatcctcccaccagtcaaatattatacgatgttaagacaagagaaatattcaagtgaatctggttgttctatggtgatatatccatgactagagtagtaattagcatgaagatggtttaatcttaagtgtttttcacttcacgattttcccatgatcccatcaaagtcttgaaatggttttactactagagaagagaaaagggatggcacacagttatattgcgttgtacataacatacggaagtactagctgctggtactctccaaattactcactcctcctatactacatacaggcggggcttgcatgaattaaaagtggagcagtagggatctccgtggcacatggctggcttggcattcttttctagcagcagcagcagcttgttgtaaataaaaggacgggcaaggcaggcagcacgcatgtacccaaactttatggtgaagcatgaggaggaggcgaggcgtggaattgcaacaaggcaacagccaagaaaaagcccgtcctttttactctgctagcgagggaggggaggggagtaattgcaatgcacgaaagaagcatgcatcctgactgaacaactgtaagtatttgggatgaagctagctagccaacaggaaacagaaaagatgacaaccatgaaaaacatatctgtcttgtttctttggttcgtcatggatccattgatctgtaattttttttgttttgtgatcctggccttggcaggcagcgattttgtctagtgtacatgaatgcagtgatccagtggctagtagtacttaggtaggtagatcccatttctcacttgttgtgtgcattgcattgtggagtacaaggagatagcagagctaattatggagtactaacatggatgaatgaatcgtaaaaaaaaaaagacaaataataatggtaggagtagtaattaaggtgggggagaagggaggaagaagaagaagaaggttaccgtggaggagggagaagaggctgccattggggtagtaatcgtagacgaggagtcgctcctccttggcctggaagtaggccctcagcgccaccacgtttgggtggcggaggcggcccagctcctccgctcgccgcccaagctccgccgcccccgccgccggctcccgcatgcgcttcaccgtgacgatgaacccggtctccatcaccgccttgtacgtgctgcccacctccccgcgccccagcgtctccgccgacgcccgcagcagctcctccaggctgtacatctccgccacgccgccgcagaacaccagcttcccgatcccctccctctcccacgagaactcacgaccccccctcctctccgatgccaccgacgccgacgccgacgccgacgcattgatctcctcccgaggctgagcctgcggctgctgctgctgctgctcttcttcctcctctggcattgctcccttatccacgtcgccggccacgcgcttgttcctcccgcgccgcgacgccatcaccgccgccgccaccaggattcccagtaccaccacacccgccaccgtcgcgccggccacgatgcccgcgttcttcgcgcggcggctcctgttggagcgtggcggggggagcggcgtgaatgcggccgcggccgccggcgcggtcggagcggcgcattggatgcgcagcggtgggccgcagaggtcggcattggcgaggaaggacgatgcgttgaatttggtggcgaggacggaggggatctcgccggagaggcggttggcggagacgttgagcagccggagcgtgggctgcggcagcggagggaggatcccgttgaggcggttgtcgtcaaggaggagcgaggtaacccgcgggagcgtggtaaggaaggtggggatttccccatgaaggaggttgaagaagaggacaaggacggtggcccggtgaagaagggcaagggtgggcggaatccggccctgaagccggttgccggagaggtagagcagcttaaggttaggaaggccgccgggaagggcgtcggggatggggccggtaagggcgttggacttgaggctgaggacgcgcagctcggagagcggggcg

SEQ ID NO: 11693 - DNA, 7292 bp, Oryza sativa
ggtgtcgcggcgccaggggaggcggtcggagccgtcgagggctgtcttgagggcgatcagcgcgtccgcgtcgaaggcggcgccaaggtgagagtgagacgaccacatgaagaagaggaggaagaggaagaagaggcatggcgatggcggggtgggcatggtggtggaatgaggagagctagggggcaccccgcgcgccccgtttgattaagtcctcactactgtactgtagtacttcactagctgctgctgctgctgctacagtttgtttctgcggcaatggacatgggcacatacataccacttccacttcttcttcttccctctctctctctctctctctctctctcgctctgataagagctaaacttaattaattgggaggggaaagcttaactaacaaagggaagcgggggacgggtgcgggtttaaatgctggagctcgcgttgcggtcgccatggccacgctgctctggagcacgtgaaggaactgagcaccgaggagaggagaagactagggaagaagggaaaagatgcaggtaactgggcctttaattgttagttgggcctgggcccttcccctggctgctctgtttactaaaagtcccacaacagaacacaggacatcgatttactaaccaacacacactgttatgtttattatgtgtctttactactgtactatctcctttttaattatattttctaaaaaaaattaacactataactatattacttataaaatagtacttcctccgtcccaaaatatagatacctagtacatgatgggatgtccagatttatatcactaggtaatatcccatcctatactagttagctacattttgaaattgcagaagtatctttttacgacaaacttactaacacgatgacttgtatgatttaacaatttaggccatttccaatccaagacattagacatagtttccataagctccacatcattaagaaactagtactagacactactcttccaatacaaacatcactattacatacttaaatttaatgctacttatctcatatgatgtcttggatgttgtgtacaaaccatgtctcatgcaaaatatggtttccttctattttctcatttattcacttgccatatcaattttcattctaggtggcaacttatttaatgttatggacaccatcctaatcattgggttaggaatggccttagagcaagtataatagtgagctataagcctactataaacttagggaggagagaggtagtgaaaaatcaagggtgttggctcttatgcaagagctagcttatcacaagatccaagacaaatacattaaatgcataattaagagatagagagaggagaagaaaatattgtagccaaccttatagctaatctattatatatattggctttaagatgggctaataataggaagtgagctctaccattatccttactcttagagcaagtgcaacaagaataaatgaatcagcttctacttaagggcatgttcactttatgccattttcaactttaccaaattttagcattaccaaaattttggtaacttcttatatagttactaaaatttgacagcaaactaaatgtagtcacttttttttaacaattttaccaaatttgataagtttgaaaatgacaacaaagtgaacagcccctaagtatgccaaaggaatgtagctcaactgtttcgacaacggggtttaagcgttagacttcgcatttatgctcaggtttacagctattttttaagtgatgatggacataccagccaacgtttctagagtgggtacttgtgcgtttgaatagcatttgtataggtaaaagttatatttaagttttttacttactagtacaatttagtaacaattttatttatattaagtaccatatttactccatccgttctataatattatttatttatataatattatttatttatattactatattatggaagagagggagtgctagtataatagtataatacggagtgactacagtggaatatactactactccatagtcaaagatatgcctgcatactcgtttcctcggggttctccaaagcctggcattaatttctgtgcttctgtcctcctgtgctccactccaggtctccagtactcccagtggagtattgaccgaccaccaccaccaccaccccatcccctcccctgcactcggtgctggagtaggagattcttctcgtgagtttattttcacctccgagcaaggttagccaatagtatgacaacgtatcctatgcacacactacctatgaatctatgatgcactcatgcactcagccaccgtagacccttcgattccaatccaacagatacaaatctaggtgcggcatttttgcagaaaaccgcccgcattattcacccaaatttacaggtaaacccctcgcttgctttcctcttctctagttcaaccttctccccagatcgatccccaattctctcgaggtaggactgggcgacggcagcatccccaatcgccccgttgatgcacgcgctgccttcttgttgaggtgcctgcatcatggccaccgacggttgcgtatccatccacacacagctgaatgttgagatggcctagctcaagcagggtcacggcccggctgacctccaagcagtgaccttgccgatggaggaggagaccagtgtccaatcgatgacaaaaacaagaagagaaattgatccagatcacaattcaattttcagcaatatttcactgtcaccagtgttttgcaatttctgtaagagagggaacagtctaacaatatcaatatattttacaccagatgctatattgacatctgaatccatgacaatagcacaaaacgactgttcgcagccagttaacacaaaacgccgcacctcaaattatgtataagacttgaatggagaaatcaaaacaaaatcttttgcattcagttaacagcaaagaagaaaaagagaaccataagccatcgattcatcctaattgatcatccttgacccaatcaaacatcgtgtgctaatgacctgaagagaaacaccctaaatgcgctgcatgccgtcagcgcgagccccgccgttgtgacgaccaccaccaccacgcctatatagctggcaaaaccaggccacgagcagagaacaaccatgtggctgcgagatacagcgcttggacagggcgccggacggccaccgcttgctcaccagcctcgataggaggacgcgcatgtaggcgagggcgattggagatgccaccgtcgcccagcacgaagaggattggggatcgatctggggagaagaatgaacaagagaggagaaaagcaagcgagggggttacctgtaaatttaggtgtaggatgcgggcggttttctgcaaaaatgctcacctaagatttgtatccgttggatagaaatcggagggtctatggaggctgagtgcatgagtgcatcataggtagcgtgtgcataggatatgttgcctaatagtatagccgattattagctccaatttatttatagttaatctaataaccaatcatataataattgtttactacactattagtatatggtcccacctgttatatacacattgcgtcttggagtctgtgctgcagctggctacaaatatgtagcccgttgttattctctctcatcttttatctcattaaaatattttcgtagctggctaataatttgctattgtacctgctctcagcccaccagctttcaaaagatttcatcctaatagtatcgtttggttatttacctgcagaagtattagcggaagtacaacaatcaacagactatagttggctctacgtccacgtaatgctaccttgtaatttttatccatattcactgcattagaaactatcacaaagagtacataaaaggggaagatacaaaattcattggctgccggatagatgaaagtcgtgcataggtatagtaagtgactgtttgacacacctcgagctccagctccacttcttctagagctagagcccagctagacagttttagcttcacctataaatggaagtgaagctctctcataaaatgaactaaatatgtaaagttaggtttaggtagcttcacaactttattttagacataatttttggagttaaatttaggagttctaccaacggatcccaagtaacaaatgattgctgattaatgtacaagctaggcttttgatgggatggattgtcttgtatggatatgtaggaaagggtgctcctagatgtgtgtgtttgggggtggtttaactctgaaagcttaatacttcctctgtttcacaatgtaagactttccagcattgcccatatacatgaatctagacacatgtatgtggacaatgctagaaagtcttacatcgtgaaacggaggaagtaagatttatcattgtggctgctaaaataaatcaattggtaaagatatactatgagcaaagtatcaaataaaataatctatgttagatttaaatttactactctctctatcataaaatataacattttttattgaatgggacacatcgtagtacaataaatttgaataggagtatatccagattcgttgtactaggatatgtctcatccagtacaaggctggtatattttgggacggagggagcactctactacaaccacacagctagtagtagtagtatgtatggtaacggtgcccgtcaccgtcagccaaaactcgactgcacagtaagcagcaggcagtccactgtgtgaaaatcggcccactaggcacatgtcggcccgtcatcgatgcacgaagaataggcccttcaggcccgtttactattatttttcacttctctctgccttccttgtcctcggctcttgctgacaaaacactggatctggaccaatacttctcttactttataagtttagattagatagtttcattagaatcctataattagaaaatctaataattctaaattgttaggcacgtgttatctatatatatacagttggaagtaagattattaaaagcagccagacaaactattctattaaagctgcgggtaaaccttttattcaaaaaaacatactacctccgtcccaaaataattgtatttctaggattcaaattttgtcccaaaataatagcaattctagagtactaattaccccatcaatcatctcttattcaaatttctctctattttaccctcaaccatcttcctagtattaaaagggagcattgatgccgaataagtggcaacaatttagtagtactccacagcacacaattattagtggagtagtattctacactgagcactggctccatttatggtgctatgccttgtacactgtgctatgtctatttaggtcgtgtttagttcacaaaagtagtttggttgaaattaaaatgatgtgacggaaaagttggaagcttgtgtgtgtaggaaagttttgatgggatggaaaagttggaagtttaaagaaaaattttgcaactaaacacggccttagctttgaaatgtagtgataactatttttataaatcaaattgagtattactacttgatacggagtacgtctcttgatataattattcaagttaatataattattcgagagaatatctattttggtcacttgggttccagtaaagagtgcattcttgatgatgcgtgattgatgaaatcgagcttatggcaattattcgagaacatagacgataaagttgatgggttaagaaatgctaatgaagaaagtttttacaaaattattgtaagagcttaaaaaacatgcctatgatatcacgtgattcataagtataaaaaattcaccgctttagttcatgttatatcaaacacacccttcgtatctagtaccgctctaatgcaagtgtgtgcgcgcatagcccgtgtagacacgtacgcacgtgcgcatttctcctttcaacccaagtttttggtttatgagctacatgcaactcatcaacctaacaccttactattttcttattaagattcagattttatctcagttccgattagcacacttttcaaactactaaacggtacgtttcgtgtgataactttataaacagaagttactttaaaatatcaaatatatacatttgtcaagtttataataattaaaacttaattaatcatgtgctagtggcttctcgttttacgtgcgcaaacttcatattcgttttcatcagttttaaacaccacatatagaatttttgtatgcataaaacttttatataaaaactttatacctgtagggaaactatatacatatacatatacatgaaatatatataaactttatacataaataatattaaagtgtaaatatttttacatagaaatatttaaatgaaaaaggtcagaaggcaaaaggagcatattttgggccgcaagcacgcatgcaactatttggatttagtaaaaaaaccacacgatgtgaggtgtaaaatggaatgttgacccgattcgaaaacaaattaggcaaaaatagaaaggcacgacgcgcattagcattttcaccgtatttgtcatttgtttcaaaggcaaaaaaataaatgctcaacatcaaatatggagattatatataaaaatgaaattataccctcaaatatgtcatggaaaaactaaaaggctagcgaaagttgtacccagacagctgctacataagctaaaccaaattcatagtatcatagtagatttttcaaaaataaaaagagaatatttttcctttcctttctttttttatgtttgaaagagggtgggcatagtaataccttttctttttgagaaaaccaaaataattttgatggcaacgatgggtattgggcgtgtttgcccccatataacacgatctcgatgactattttgattgaaagaatgagcttggaggatctatttgaacaaatggcctcaagtcgaaattagaaggagcactccttttatcccgattatagatcatgttttttttaaaaaaaaatctttatgtgtaaattttctagagtactttttttaaaaataactcttcaacttagtacaatagttaatacatttgttgatatatatataaaaaatcagataatccaccattcagttgaaaatggctaaagtctaaaatggcaattttatgtaaaagtagttgtttttatggaatgcattaataatgccacctgcaagttaaaattaaaataaaagaaacatagttagggacatttgagaaaaaacattgcatgtattaaagtaggagaatga

SEQ ID NO: 11694 - DNA, 5620 bp, Oryza sativa
  unsure (1)..(5620): unsure at all n locations
aataagcaggtaacctgttgatgacgcctaaacagttggtgcttggtgcctggtaaagaggaggaagaagaagaagaaagaagaggaaggggacaccacaccacaggtagcactcaaggagaggagaggagaggcgaggcataaggaggcagaaggaggaagaggcggcagcagcatcggcgggaggctggctccggcgcgagcacaagctggctaccccacgcttcttccaccacctcagcacctccgcggggcttgcagccgcgggggtctccgtctcctacccaccgcccctgccccccactccgcccagtgcggcgcccacggcgcccgacatgggcgccggcggcgccgccaagcagatcgtcgactcgctcctcgcccgcttcctcccgctcgcccgccgccgcatcgagaccgcgcaggcacaggtaactcctctcctctctcctctcgcctcgcctcgcccggaattccatcaccagattggggcctgcctcttccctccctcacggataaacaacgggatcgggacggactcacctccttccttcctagggttcaccccccttccagatcgcccttccggttccggctccacactctgatttgttttatttctttccttcaccctcttcatctcactggagccccaattcactcctcgaattggatcgattgcaggtgcaccacctcttccaaccgcttaggcctagggatttcccccataccctatgttcaaagtacaattgctctatgctgccgcttctatcagtgctccaaatcattgccatcccaccattgttattactgctacttccttctctatgaaactgcctcctcatgcgtgtccatttgaatttgatttgcttgtgctgcgacatgcccacattgttgaaaaatgctcaaaatcgtactccacctttgatggtctcgttactttcacatgtgtgctccacctataatactgggtcatgtttccaagagcacgatgatgtttctctcaatactacttagctcaactgcatggaggaacctttctacctagacattctcttgttttcttgaggcattattattttacctgccagatgaacaacttcaaaattgattactagcttatatcatcagggcaaatgttattactattacagaaaatacatctgacactaaatttctttatttttgaaaatgcataggatgggcaatacctccgtccatctgatccaagctatgagcaagtattggattcacttgccatggttgctaggcacacacctttgcctcttttggaagctcttcttcggtggagggaaaggtatgcttattcaccttgactttgaaagctctagccctatcccttaatgcttccccgaaatcattattgaacaatgcaaatatgcaatgagttctctgcactcccttatttattactgaactactgttcttcactgtcgcacagtgaatcaccaaaaggcgcacatgacgcatcaacgttccaaaagaaggtttgtcgttgattgcccttgccctctccttttcaagaaccacttcattttcgattgtaactaactattaagcagcatcagacaggcattcttgcacatataatttctctattatttcatagttgcaaatagttgccagcagggtatttgatccctgatctctcaaaacttttactcccatagtattttcatttgcgtactctcgtctaaaaatcctcatgtctgttttctgaccccttatccagcttgctgtcgagtgcatattctgttcagcctgcattcgttttgctgagtattgcccacaagagggaataacaggttgttataatattatattttgacttatttgcacggctactttctgatgggttggctaactagctgttttattttatctagagaaactttggattggcctggaaaattttgtatttgattggctaattaatgcagacaggtgaggcattactgccttttttttacttaggttttctcacatgataaataaaacacatccacgcctgtggtgcatcttaaatttgtttatctttggctttgcatatcatcaaaacagcacatcatgtgcaataaatatttgctttcttgtttctttcagcttgtgccaaattttgcgaaccttgtcattatgttagattttgtttcttgattgccaggaaaaaaagactttatattctttagaagttgagtttcttaccaacttctttactttctgcagggttgttagccaagtagagtatccctcgttggttgatttgcgaggtctcctcttagatcttgttgcccaacttttgggagctttatctcgtatcaggtatgctctatatttacatggaacatggataaggggtgtgtgcgaaggagggaggccatgtaaaaactgtcgcaatattatgtggcctttttttttcttgacaaggaaactgcaggggaggcccctgcagtttaattatatataatatattgaaggaaaggtttaaataaaagacatatgtgacctctttgtccatgttacttcaaattagggagggaaggaggccatgtaaaagctgctgcactgttatatgacctctttgtctatgttacttaaaattctgatgattcatacaggtttagttctgtgacggaaaggtttttcatggagcttaatagtcggcgtaatgatgcgcctctttctagaagtgattcactcagcattattaatgggatgcgctaccttaaattgggggtacgatacaaagatcgctttattattttaattttctgtgccagttcatagtgagttgacaagtatttaaagtgcatggcaatgacaatctgatttatcttggcatgctgtcttacaaaattccaaatgttctatcaggtagtatggtaccactaccatgcttcagttacaagtccactttcactggccaaaacatgctctgatattagcactttgatgaatctgaatcatccaaagtttttacttgtgtaccactgtacatagaatcccaaaagtaccttttgatttgcagaattttaattttgttaagaaaaacatatctacatacacaagaagtaacttaactgatactctattcactccatcatctttgaaccaatgtacataacaatgccattcagtttgaattgtagttattacatacttaagaatttactttttcaggtgaagacagagggtggactgaatgcctcggtttctttcattgcaaaagcaaatcctctaaatcgtcctcccaacaaaagaaagagtgaactgcaacatgctttgtgcaacatgctctcaagtatactggccccgcttgctgagggaggcaaacatcattggcctcctctgggtgtagaacctgcattgtcactttggtatgatgctgttgctcgaataagaggcgcgctcatgtattggatggataagcagagcaaacatattgcagtaagtcgaggatttgaaatttaatgttatacattttttggcatttgtacaaaatattgtatgccttgattattttttttgttattgaataactagcacatactttatttacttctttatttgttagcgagcatgagatattaatgatgctggactgggaattcggaaattgatctgtcaaattgagattctaatggaattttctgattttatgctttgtagttgaataaggcaataaacttcactttctatcttatcatcttggtgactgtattatttccttttttagacatcattaattactgatgccttgtgcaattttaatatttagtgctgaatcttcatcacaggttggatttccacttgtaactcttctactttgccttggtgattcccatacgttcaacactcacttttctcaacatatggagatcttgtataagtatctcaaggtgattttttgtgcgcacatttgatcatatcaaaggcctatcatatttcaccacctaatattcttttaaatgctgtactcattgtactgattgtaaaccatgatcctgatttctgaaacttatattcttcctttgtgctgcatgaagcctaatgatgcttaattgcttattacgcaggacaagaatcaccgatcaatggcattagattgtcttcacaggctagtgaaattttacttaaatgtttatgcagattaccagcctagaaatcacgtgtgggactgtttagatagtgtgacctctcaattgctgaccgttttgaagaagggcttgctgacacaagatgtccagcatgataaacttgttgagttttgtgtgaccttagctgagagcaactgggattttgcaatgaatcatatgatcctcgagttgttaaaaccagatagtttaagtgaagcaaaggttgttggtcttagggctttgcttgagatagttgtgtctccatctaacaaacaaattggattggatgtcttccaaggtaacacggttttatgaactgttccattctgtttaatcttaaatattttctgaaaatattgtaatcagtatttttactctttaatttcagaatatggtattgggcattatattccaaaagtaaagtcggcgattgagtcgattttacgatcttgtaacaaggcatatagcttagcccttcttacatcatcgaaagctactataggtatgctgctacttctcattgtacaaggaaatattcaaattattttctattacttttgtcaatttattttcattcatctttggaaactatcgatacttaaaattgtgtcacgtgatgcaaatactcattcaactttctattttcccctttatttcattatttctaacattggtattttcagataatgtaacaaaggataaatctcagggatcactcttcagatctgtgctgaaatgtataccatacttaatagaagaggtgggacgtaatgataaaatgaccgagattatacctcagcatggtataagtattgaccctggtgttcgtgaagaagcagtgcaagtgttgaacaggattgtacgatgcttgccgaatcgtcgctttgctgtattgaaaggaatggccaactttatcctaaaacttcctgatgagttccctcttttgattcaaacatcactgggacgattagtagagctcatgcgcttgtggagagtatgcctatctgaggaacttttggcaaaagacatgcaaaatgttaagcgttctagtctaggaggcgatgcactacagaggtctccttttcatagatccagggatgtatctgaattccgtgcctcggaaatggatgcagttggtcttgtctttctcagctctgctgatgttcaaataaggcttactgctttggagttattgcgatgtgttcgagcgctaaaaaatgaactcagggattactcggcaaatgaatggggtgacagcaaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11695 - DNA, 335 bp, Oryza sativa
ttggtttccccatctcccgcgcgcttgctcttcttgggctttttagtctactcgatctaactccaaatcccatcaaccccgccgccgccgccgccgccgccaccaccgcgagacgcgagaggagagtgaaagaaagattcagagagagagagagagtaagcatgatgtccttcagccagcccgacgccttctcgccgtcgcagttcacctcctcccagaatgccgccgccgactctaccaccccttccaaggtagtaatctccattccattctcatccgtgtgtgtcttggtttcgagaaacaagggggataaaatcatctttcttttcttttga

SEQ ID NO: 11696 - DNA, 474 bp, Oryza sativa
gactaagcaataaagtaccgcgtattttaccttctgcttctggctgtctcgcaataccttctacagcttgtgctgcagcagtaccttgaccaacttcaggcccaatagaagcaagacctacggccaatccagcagcaataacggaagcagcacaattagtggattcatgatgagttcctcgtgtcaaaaaaaagaaatggttaaggatacaatcaaccaagaaattcatatttctaagctctattggacagaagtaactaaaaagtacaaattgaaacgataatctgaattctccgaactgcttcgagatctcctttttagtttctaatcattagaggtttgtgtactcattattctatttctctttctttccaaccaactgatctttcattccatccttctttctttcctcttcgatatccttgagtttctattttttcccctatcatctaattcataataaaaggtgaaata

SEQ ID NO: 11697 - DNA, 736 bp, Oryza sativa
ggaatgaacaagttctagaggtgcaaaatccctcgcctcagatgccttgtgaggctcgcgaagttgtttcgattgaccttacattatggcacttagaacctttgactaaagtgaattttggaattaaactcatgttagccaagcgtgtcatacaaccgaaattcacatgacagagtcgcgaatgccacacattggactcatcattcttgctaatatggatcacaacattattattattacacacgtcatccaaagaaaagcggaacaagcctccgctgtcatagccttttccaataaaagtttcatatttagataccacacatttattggattcaaacacaagtctaaaaccttctctacacagtagagaaccgctaactagattcttctttattgaagagacatgttgcacgttctttagctgcacggtctttcccgaagtaaacttcagatcgaccgtaccaacaccgtgaacaggcacaagtgacccatttcccattaacaaggagaaacctttccctacctcataagaagaaaacagggaaatatcagcacatacatgaatattagcaccagattcaacccaccaatcaggtgaatgaaaaacagagagaactgtaggtaataatttaccgtaccccgatgtttctctgccctcactaatgaccatggtggcagactttctgttttgggctcaagacagtccttggccaatgcccagacttgccacacacaa

SEQ ID NO: 11698 - DNA, 1494 bp, Oryza sativa
aaaacttttcaactacaaagttgtaggtcgcgtcgagggctacaattttgatataaagtttgtcttcattagagttcacatgaaaaagttatgaattattttttgatataaagtttttagactgtcctgtttagggaccggggtgacacaactgaacaacttggaggacctaaacgagtgatctgcgagtttagggaccgggatgacacagtcgaacaagtttaaggacctgaacggttgatttgcgagtttagggaccgggatgacacatcggtacaagtttagggaccggtgatggactttactctatataaaaaatggaagctactaaaatgtacgcgtgtcacttacttaagttgtattctaaacggtacttaattaggctgtgttagccaaaacgagttgggaacccactcaccacttttttcacgcgcacgtttttcaaactgttaaacggtgtatttttttaaaaaaaatctatatgaaagctgtttaaaaaaattcatactgatccatttttaaaaaataaattagctaatacttaattaatcacgtgttaatgggccactccgtttttcgtgcgggagggattacttcacatcccatactaccgaacacacccttagatacggtagcttacttgttcttcgtaaacacatttcccaaaccactgttgacgtaaaacacgaggcctgggagatttgcttaactccagtgcaggtccaaagcttgcctttgggtgtgttagcgtgccagttgatttgatcctgcaatcaacaagaaatagaaataaagaaatcgcggttaattctataaataatagccgatcggctaagtgccgatgacatatcatttatctttgagccgatgtcatatgtgaatcgttcggcgactataaatagataataaagaactaaacctactcgattggctgtagatattaccaatatatagttcttatatcgatatatatttaaatcaagtgattgggatagatcggtcgccatgccgagacagtataaatcacctggatcgaaatatatattaataacaggactatatatgtttatagcatagccgatcatatagatctagcatgtatcggctaatactccgatactactctatatcaggatattaaaacaagtataatatatcaaataaaagcttaatatacttaaatataataagatctttgacataaagggcggatttaacatgtcattgaagcatatagagcgaatatagttaaatcaaataagataggctgaaactccgatactaccctaatcggcaaccagaaggcaggctagagattgatattctaagcacgacttaatagatcaaactcaactgatgcagcattaagtatgaaaagaagaacaatatctagacaatcaagccgctggaagtttcatagagtggtagatttcttatataatctaaatcaacatcaaaatctaacctaatcggctgccctctactaacagatgt

SEQ ID NO: 11699 - DNA, 1326 bp, Oryza sativa
  unsure (1)..(1326): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagaggcaaggttgttttgcaaatcttttgtttgaagtccattttgaaaccactaagtgatttatttctttctaagtttgggccgaaaagtgacttgcgtctcgattcgactttaagagatgtttttcaacaactcaatttgtaatgtaccgacctcccgggtcagatcattacttctcggctcacagagccatttcacttgattaagcggctcctagagccttattcatgttctcgaactcccagagtccagctgcccaacaacacaacgatccgcttccactcgggaagccaagtctatgatgcccgcagacatcctgaatcacacagattcgtttcttgaccactcaggtcatccatctgccacataggctgattctagtaacgattcccaatccacaacaatttttcacaaagcacaggcaaacaaatctacgctacaggaaacacctcgcatccgcccatgaccgtgggcacggctgttcgaacagtttaataacctctgcagagggggtacactttacccacacggcattactaacccggatcacccagcccgttcagaacggccacgtatggagaccttgaggctttcatgacaaggcaattcgaaagccgacacaggtttaccatatgccaacgagaggggtcccagaccaacacccggttaggtcccagaccatactatgccaggaagcccgagggttctccccgataccaccccgttgaatccacatgtctcttggcatcatggctcccctgattagctaccggggtcggcttgacccggtcttggccgagctgcccctttctctcgggccgcgccctagccgcccgagggaagtctgtttcccctccctctttcttttcttttcaaaagggtttaattaaatcctttttcctttagaacaaaaatccaataatcttagaaattcaatatcttctcaaccgtatgtccgtttgactccgttcaacttccaaaactcctcaaatctcgatatctatttaatggcacgtttagaggtcaataatagggctttatttttgccgtttgttgagctgt

SEQ ID NO: 11700 - DNA, 2790 bp, Oryza sativa
ctggctgagtaattagctaatcaggggagccatgatgccaagagacatgtggattcaacggggtggtgccggggagaaccctcgggcttcctggcacagtatggtctgggacctaacctgatgtcggtataggacccctctcgttggcatatggtgaacctgtgtcggctttcgaaatgccttgtcatgaaagtctcaaggtctccagacgttgccgttctacacgggctgggtgatccgggttagtaatatcgtgtgggtaaagtgtatcccctctgcagaggttattaaactgttcgaacagccgtgcccactgtcatgggcagatgtgaggtgattcctagcgtagttttgtttgactactgctggtgaaattactgttgtggaatgggttcgatgtttgaaaaatctgcggctgatgggatcagccaggcccgggtggccgtttgaaagctgttggacgggtgccaaccttgaatcaattcaaaaactgatacattgcacatactccgaccggacgagacacactgtctcatccgtgtcgtttgagaagcactcacttagttgtttcaaaaaggagtttaaataaaaccaattgcaaaaacaacagcctttcttttgaagcctgcattaaacacttaattcccatggcttgctgagtactcctgtactcacccttgctctatgtaaataatcccccccaagttgctgaagaggatgatgtggatcctgctgatgaggagttcttccaggagcaagtcggctacgatgagttttagggtttcggcctagttcccaagtcgcgcctgtgatgaatggtccaagtcttggcttccgctttcccttttgtaatgcagttgtgacctcgggatctgtccacagcccaacttgactgtactcctactctataataaagagacctctgttgctatgatattctgtcttcctgtgataccagcactgtttcctgagactggtatcgattaacaggttaatttggagcgtcacaggctagttccgttcggggctagttcggggcgtgacaaatcaactggcacgctagtacacccaaaggcgagctttggacctgcactggagttaagcaaatctcccaggcctcgtgttttctgtcactacatagtaagcaactattgtataaattaaccattagattggctatagataaattggagctagtagtgggctatactattaagctttctcagatattataagccaactataaatacatattgaggagataaaagaagagagagagtagcagcgggctacagatctgtaaccagctgcagtacggaatctaaaacacaacatgtgtataatagggaccatatattaatagtgtagtatatgtgatatgtttatagataactatcgtataaattgattattaaagtgatcgtaaatgatttaaagcaattagttaattagttagctacaccactagtacattaaacttgctctaatactagtagtagtgcaactaggactgtagtaggagtatgtaatcatgatgttgtacttgctatcctgattaggagttgtgactgacgcattcataggacgagacagtatgattaaacggaacaatgactgttcacttctaatgacacattaattcgaccaaaagggtgtgcatgctctcacctggagtggtagtagtacagcgaagagggatcctgattttttatacggtgggtatcgcccaactggtgaccaacagtacatatttctggtgtactctacacaaagaaattgcacagttttttttctgagtatatatatatatatatatatatatatagagagagagagagagagagatgagtgtgaggtgggtgtggggtgggtggctgcaggctatctgcgtggggtgtcagagtctgcctgtctccctctcactgctgctgccatctgcaacctgcaccgttgcagtcaataataataataaacaataacattcaagtggggcctctcgctactgcgcatggtggcaccgtggcagcatccacccgcagggctcctctgacaccgaccagcattgcccattaactatagaaacccatagtgccttctactgctacatgcaccaactaccattcgacgcccgaaagattttactactaccctagaaatactgttcttgcggtaatattcagaagaaagcccccaaaaaataataatataacttatctgaaaactaaattgtgctcaaaattatttgaaatgtataaaaataaaccacaaacatcagcgctaagcctggtaatgtcaaagtccaaaaacaccatatattttgacaccaccatgttgtcgttgcgtcctaaacgagttgttcaccgagactaggccagaagtttaagatatcaacgaggctgtggtggcgctacgttttatcctccgtcaccattttgtgctaggtgagttgtccgcaatattagctaggaatttcgaagcttgacgagaccacaccaacactgtatttgatagagctcgatgagggatagcaatggcaagctctaggtgtatcgtccttgcaaggttcctttgcactaaccacttatcaggtggatgagtagttctatgctaagatcatggtttattttttatatcaatgtctgatgtggttcatcgttgaaactaaatttttccacaaagatcgaaccgtcaaaaatttggatagaagaacaagctatacgccatgcaaagggccttattgtttggcttttttcatagtaagccaaaacggcttattagagaataaaaata

SEQ ID NO: 11701 - DNA, 12576 bp, Oryza sativa
gtttttttttcttagttgaataggctatccgatgggagccaaagtttcccggtgacagtctagactatagagacgacgaccaaagcgcttacgactacagtaaatacggcatcaagcggcggtggccagttgctcgcgtcgtcgccggggagaggggagacgcgaggaacctgtggagtttttgcgggtgagattcctacggctgcgcgcgcccacgaggggggcgcacagcagattctgcagcgcactctctgctctgcctctgcatcttgactgaatgacctatcttctgtacccgggacataaattatcggagttaaatatccggaaactattcaaacaggccatcgttcgcacgcctacgtttttcttttaagaaaaaaaaaatatgtcctctgcttcgctcacacgcacgtactactacgtgggctgcttggttgcaagcatccttttatgacaaatctgtactgtgcggtagggttattttccattcttcctactcctacggtttgttcttgacattttttttcacaaagaaaaggacggaaggagtataaagcatgtcgcttgtccaagcaaaagaacagtagccagtggcaaacaaagccctgtttaattcaccccaaacttcccccaactcctaactttctatcacatcacatcacatttaaaactttcctacacacacgtaaactcccaactttttttccaaactaccaactttccccaaacttctccccaatttcagaaactaaatacaaccatagtaccactggacaaacgagtcctgagaatgaaagtgattgactaaaaactattatggccgagtttagtttcaaagttttcttcaaacttccaactttttcatcacatcaaaacttttctacacacaaactttcaacttttccgtcacattgttacaatttcaactaaggctgtgtttagttcacaccaaaattagaagtttggttgaaatatgaacaatgtgatggaaaagttggaagttcgtgtgtaggaaagttttgatatgatggaaaagtcaaaagtttgaacaattattttcgaactaaacacggagtaaacttccaattttatcatgaactaaacacaccctatgtgtaaatgtctcactgttaatgagaagtgaaagatctataaatttctatccggcctagaaacagttgaagtaataacatcactaccttaactaaagatgttgggtttttttttaaaaaaaaacacattataaacgtacacccacctgtaaacatatacactcactttgcatattcggttatattccgacaatataaatggcaaaacttgaaaggtgccatgcatagggaaaaaaactgtcatgctaaacaggaaaatacatacttggtgtcaactacttcgtgggttattatattttgacgaacgcattagtgttaattcacactataatatatttgttgaaatacttttcactaaaaacaccctaatcgctgaagcggtaaaaaaagattagatcttatttggactatagggctcgtataatatgtttgatatgtcattttaaagtttaattaattagataattaccttctagtttacaaatgtctagaacttcaataacatatctggttcatatgatgtcacaataaaatgccagtccgagtgattttctttctaaccgtcgtctaagccgtacatacgtaaaatactccatttgtttctaaatatttgacaccgttgactttttagcacatatttgaccgtttgtctttttcaaaaacttttgtgaaatatgtaaaactatatgtatacatataagtatatttaacaataaatcaaatgatagaaaaagaattaataattacttaaattttttaaataatactaatggttaaacgtatttaaaaaaatcgatggcgtcaaatatttagaaacggagggagtatatataagttagactcatgataatccaactctatacgttaatattgcaattttaaaaggtaaaatatactttttatgcaggactaattgactgtattgaaagatagttgatgcatttacgtagtagtacagtaacgttttatagaattcacattcgtttaattaaaacccaccgtttattaattagaaaatgtattaataaatggccgaaacctgatatttttggcaggcaggagcgcatttcgcagtattaccctcgggttttcttctggatccggaaacagcctccggctcgcaagtcttaaatgcgcacggacgtcgcttcccaccctcaccccacccttccccgcccattacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagagatgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcacgtacgttacacacatcctcctccacgtacgtacgtacgcgttgttgccgatgctaacaaagtccatattgtgattggtgttttctttggaatgcagtggggtggggttgctttggcatggggtttgggcggaaggcggaggacccggagccagggcgatgccggcgtacggacggcaagaagtggcggtgctccaaggaggcgtacccggactccaagtactgcgagaagcacatgcaccgtggcaagaaccgttcaagaaagcctgtggaaatgtccttggccacgccgccgccgccgtcctccttcgccacctgcgccgcgtcgaacacctccgccggcgttgcccccaccaccaccaccacctcctccccggcgccctcctacagccgcccggcgccgcacgacgcggcgccgtaccaggcgctctacggcgggccatacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatggtgcgtagagtactaaccttcgtctccactgatcagaaccgtttcttgattcttatggcgagccgtgctgacgatgatccaacttgcttcctgtttggtcttgtgcaatctgcagatgattaatctcttgaagaagccaagaagtgatcaacacgcggaagaaatcaacagcttctttcacggcgtgcgagctgcatgctgatgctccaggatcgatcgatcgatcattgcatctccaaactaatcacgcttcgatctttcaggacttcatcaatgacaggccgaaacctcctacgagttctctgatgatattcttatttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagacaagcgtgttcgcttttgtgaacgccctttttcttctttccgattcctctgcctgtgatagtactcgctccgaaaaaaaaaaaaaaagcaaaccgtggattcttgggtcaacgtgtccgttttatattgtccgttttatatgaaatttttttataattaaaatttctattgttgttagatgataaaacatgattaatatgtgacttattttttttatatattttttttaaataagacggacggtcgacacggttttttttttttttaagaaggagggagtaagtcacatctctggattctgctgaaaagctcactagcgccatcctgcttcagagaatactttatgctttctgacaagtcggtgtaggagtagtagtattgctaggtgtactccactcccctccttaagtacattaccagtgcaacgtaaaacagctttgctcctgagcaacggaaatgcttaataccgtactcttgcacttcgtcagttggttgagtacactgtgcaagtaccaaattggtcttcttaagtgttactactaggttgatcacttgttgaaccgtttaggctgtcgatcattagcattcagggttatcactgcaaagtcccaaacaaaaagattctcccagggtctattctcccctgaaccgttttcccattgaccggccaatgctgcaagaagctggatgcagagctaggagtagctgcagtgcccccactcctgcaccttcctgcagacactcagagagagggagagatggaggactgtgatgactgaccagcacccctgctttggtctccatggattcaatgccaactgcactgcaattgctgccggccccctgagacaatgtcaggcgctgtcagctctcgcgtccatgcgattgaatgatccattgctggcgtttggaccgtcgcctctcctcccctgcctcgcacacagtctgcagcgcatgcatgcatccatcatgtacagtgcagcattggacacaagcctctcctccttgcagctgcagccttcaaagcctgcacttgctgtctgccgcgagacggtgtctgccggccagcaccgtgacagtctccggctcaagtaccggtagctgtgccactgacgcgcgggggccacctgacttcgtccaaagcgtccacagcactactactggcactgcaccacagggattgccttccctgacacaagcctccacatggagtaattgttactgaagaaattcccagaaattacatgtcccgcgttacagctttcggttcatccaacagcagaaattaacctgagagagtgtttgggaattagtactaaactttagtttctcttctagagacttatgttttttagaaagaggctactcccagacaccccctcagttttcgtagtactggcacctgcctatatgtgctggttttcgacgcgtactctactaatctggagtttactccaaaacgaggaaaaactcagctgtcactgtatcatcttcatcaccgaatccagcggagcacgtactgtatgacgtatctgttctgacagcgaagttgaacaaatccacggcgcccagtattcccacgacagagcccacatgagcccgtctccagcacgtacgcgtacaataaaaaggctgtactactactctgtatacacatctgcggctctgcacccatctcgtcagcaaaacgaaacgcatgcatagagaggagaacgttcaaaaccattcattcatcaaccggaggatcagctgcacaagcaagccacagtgcagcatgcggtgaatcgcacgtggagaggctcaggtgaccccacgacttgcacggttttggctcgcaatatcgcgacgagacgaggccgtgacggcatgttattctgctcacactgtctttcgcctcccccactaccacgaccactcgcgtgttaagcccgcatgtgcttgcacctgatcccgtggcacgtactccctcggtcaaaaaaaaaaaaaagagaaagacaaacccagaccgtccgtcttatttaaaaaaattataaaaagaattaaaaagacaagtcacacataagatattaatcatgttttatcatctaacaacaataaaaatacgaattataaaaaattttatataagacggatagtcaaagttggatacggaaaactaggatttgtcttttttttaggtggagggagtaatggagattttttttcccgttttggacgggttgttcagtcagtcatggctgggagaaaaggctgtggagatgagatttttagcagcggtgcacacatgcgtgcacgggcaacctagacagttgggattttactactgacaggaagaggttgaattaaactagtgtcgtcattcgcggcaactctgagttaggacagactgattgcccagattattcggtttttagtgtatcggcgagggcatctgacgccctcgggatatgaggccctgcaacgtggtggtcgcgggcgccggagttctctcccggttagtttacggagcaggaggaggtcggcgactacttctactacgctctcgttcagtttcagattcttaccgctgtatcgtggcgtttagtttaaaatccctcgcgcgtttggggtgaagggatccgatgtgttttttgcagggatgtggcctggttttccgtgtgtaggggagggagatgtcacggcgcgcgacagcatttctcgtgacagccgcttaactaaacgcctcaatctgagagctggtcgtcagggatcagcatctgtcaggaggccgcaaccagtggttcagctgcaagtgttaagaacagtaaatgatcagctggtggtggtagtagtgctgctgctgctacttgcagtccctgcagtgtcagctgaacgtcaggggacccttcaattcgctggaattgtactgcggtgacatcatacaaaccctggaccaaacgaaacaaaactaggaccttgatcacttgatgcggctcggcttggttggctactggatttaacccactctttgctttcgtccaccctcgatggccggtttccagttgagtaaacaatgtacagcttgtgttgttcacaccaaaattagaagtttggttgaaattggaacgatgtgatggaaaagttagaagtttgtgtgtgtagaaaagttttggcatgtttagttcacactaaacttcccccaaactctcaactttctatcacatcacatccaaaactttcctacttacataatcttctaactttttttccaaactaccaactttctccaaacttctccccaatttcagaaactaaacacagcctttgatgtaatgggaatgttgaaagttcgaagaattattttggaactaaacacggccacagtttcttcatagatttgttgttactactccaggagtactatcttttataccggtcaacgcacagcttacagcaaaatgcaatcccccccccctgctagtgaacagtgtctcatatcccatccaatgacccaaaacctgcacctgattgaactactcaatgaggctgtatttagtttctgaaattaggaaaaagtttagggaaagttggtagtttggaaaaaaaaaatagaagtttatgtgagtaggaaagttttggatgtgacgtgatgtgatgaaaagttggaagtttgggggaaatttgatgtgaactaaacatggccgcacaatgatagaagtgcaatgtgcaaaatggtaagcaatcagccaatcaccacaatactggaccgcgttatcactcatcggtgtcaaccgctgcggcaacgtgggccgaggcttcgaattcgccgcgccgcgtgacggcccatcagaatacgagatgggccggcccacccgcagcgaactcatccctgcccaggccagcccatccactctgggatattgtggccgtccgatgcgatcatgccaaatctatccaacggctggtgtatctgaagcgtgtcgatgtcttcctccgaaaggagcagcctccacatcaaccgcctctctcattaattagcggaccatttctaattcacccctcgcatcttttcgaattttcgagagctcaaagcctcgaaccattcccttcttcctcgtcccaatccaagttccaaccatccagggcgggggttttcccgttaatccgcgcctctccgtgtcggattgaattgaagcggagagggggaggaggaggtggaggtggaggtggaggagggcggcgggtggcgatggcgagggcgaggctgacgccgagcggcgtggcggcggcgctggcgggggacacgaacctgaagccggtgctgcagatcgtcgagctgcggggcgtccaggtcaacggcgcgggcgtcacgcgcggggagaggttccgggcggtggtctccgacggcaccgccgcgtcctccgcgctcttcgccgcgcagctcagcgaccacgcccgatccggcgccctccgacgcggcagcattgtgcagctcagcgagtacgtcatcaacgaagtcggccccagaaggttttgttgcctcctcctccactttcccccccattcccctgcctctgatcgatgtgtgattgcgtgcgatttttggcccgtttcgttttagggttcatgcttgcccctggttttatgtgtgtcagtctgcgtgtggtttagattcccgctttcagctagtttgcaatttaaattaatacttagtacttgccattctgttggtaaattgtcgatgagcttcatgtttcctactagatactagtagaggtgcatcaaaatttttctgacaatggttttgtttatgacatcatttgatcggtgcttgttaaccatttgtccaattgattttaattctgatttgaattattattgtcagaaagaggcctcggtattgcagtactaatcagtggtaactaaggctgtcctgtgacacaaattggtgtttgtcgatactcagtagttaattggctggcattagtattaacgattacaaaatagtgtgatatatgtgcttgggtagcctttggtgttcgccatttctggcaggtagcatgtcaaacgatgaaggtaatatggtcagtttgactactacacactttacagtgttgtctgatttagttcactaatttagttgtgtgcctttttttctctagccaacaaatcgccatgtttgggtgcatcgatttggccaatgtagttagatattgatcagcattaatgctgcaactgtctggtgctgtgaacagtttgggtctaagtactaagtattttttatcttttagctgtagccattcagttcaacacaacaccgtactaaatgcatttcttttgtatctggttcataagtaattggaagcatagttgtgtccattcaaatcatgttggcaaggcgacaaatgcaaaagtgaagataagtttctgaccaaaaggtgttgtaattaaacatagtattcatgtagcagtgtgaatcatcatattctgagccttttgcattcttattttcaactgatctactggttgatagagcagaatcaagaattgttttttgttggttgagctgacttgttgcaatacctgtaggattattgtcattctgaacctggaagttcttgtttcggagtgtgagataattgggaatcctacagcgctttcagaaactggatctcctatcccaaatccgacaagagtagagcaatttaacggagcacctcaatatggtttgatggcagggaactcatcaaatacaaccacaaagcctagtgacaatgttccattgttccaaaattcgatggcaggaaactcctctaactttgccactaggcccagtgacaaagttccggtcttccaaccaacagtccagccatcttatcgccctgcacctaattacaaaaaccatggagcaatcatgaaaaatgaagcccctgctagaataatccccatatctgctttaaatccttatcaaggccgctgggctatcaaggctagagttactgccaagggagatatccgccgataccataatgctaaaggtgatgggaaagtattctcttttgacttgcttgattctgatgggggagagatacgggtgacatgcttcaatgctcttcttgatcgattctatgaagttgtggaagttggtaaggtctatgtggtatcaagaggaaacttgagacctgcacagaagaactataaccatcttaacaatgagtgggagattttattggagaatggatcaactgtggatctttgtcctgatgagaacagttccattcccacccagcggtttgacttcagaccgatcaatgaaattgaggatgcccagaacaatgctatccttgacatcataggtgttgttacatcggtcaatccttgcaccacaatacagaggaaaaatggcatggaaactcagaaaagaactatgaacctgaaggatatgtctggtcgaagtgttgaggtaaccatgtggggtgacttttgcaacagagaaggctcacagcttcaaggaatggttgaacgtgggatctttcctgtgctggctgtcaaagcaggaaaagtgagtgatttcagtggcaagtctgtcggcacaatttcttcaactcagctcttcatcaaccctgattctgctgaagctcatagtctcaggcaatggtttgatagtggaggaagagatgcttctactcagtccatatccagagatatcacgcctggagcatcaaggaatgagatccgaaagacagtagcacagatcaaggatgaaggtcttggaatgggggacaaacctgactggattacggtgaaagccaccgttatattcttcaagaatgagtccttcttctacacagcttgccctaacatgattggcgacaggcagtgcaataagaaggtgacaaagagtactaatggcaattggacctgtgacaaatgcgatagggagtttgaagagtgcgactacaggtatctcctgcagtttcagattcaagatcactcgggaacagcttgggtgacagcattccaggaggctgggcaggagttgcttggctgctcggcaacagagctcaacgcacttaaggagcgcgaggaccctcggtttgcagacaccatgctcaattgcttgtttcaggaatatctgctcaggctgaaggtcaaagaagaatcatacggcgatgagcgcaaagtgaagaacaccgcggtcaaagtggagaaggttgatccttcgggtgaaagtaaatttctgctggatttgatctccaagtcctcggcgctacattagcagactgtgctactctatcagctgctcgctcgtgcgtggtgaggtgagcgaggtgaggtgttgcagtgcccatagccctcgccctcctgctcgatttttgtgccggtactttaatattaacgccacttaatagtttatatccagattagtgctttaatagtttatatccagattagtgctgatatttccatttttgtgccggtactttaatattaacgccacttaatgtatcagcttttatacctttttctcgatcaaatgattgccttctagctgcagtgcaatttctcccttagttttggtttgtacatgcctgcaaagccttactctgtcgcgactaagaaatctcttgtgctcttccatgcaatcgaacatctgttttacattcgcaaggctattaggacttgggttagatgcaaacaagcggatccagagaagaagttaatatccgtgcaaacgaaaaaggagcatttattctttcaataacaaggtgtttaaggtgactatgtcaatctcaaggtacgttagtcaaatctctcggagaacataggaagtgttcgtgtgtagaaaaaggagcaaacaatacatacgtcgactctttcttttgcacgagaacgcgagtcgcgatcacaactttgctatacaagtgtggtattcacagacgtccaaaagcgtacatcaatctcagtggtttccccctctatttgcatgcaacacgtggatcacaagaaacccgaaactttcccctgtacaaccgtagtgctctgccctgaaaacttgatcggcactctcacgtcgccagcttgagactgcatctcagccagtttttttactcgtagcagaatcgacactggtatcggtatggcagaaggattgctcttccgtggacaaacaccctgttcagtggcaaagagaaagttgggtaaataaatcaagatgcaaagcaaaggggaaaaaatgccagaacgtgagaaagtaggtcgaacagaacagcctgttcatcatacatcgttttcagtggaaagttgtgtctggctggc

SEQ ID NO: 11702 - DNA, 3673 bp, Oryza sativa
cacagcattaagccattgaggtactatgtgtttcaaatatatttctagtcagtacttcattctgaagttggattttcactatattgtccaacatgaagaaacatcatactagtggaacttctatggctttgcttacatggttcttccgttcaccttccttttccaaattcactacatctgcagcaggggcctcagtacattccacagaaggctcaggatcctgatgcaataaaaaaaggattcaggtagctacattgagataattataccaaatctaatagcgtatgacacatgaaaatatggttttgtcctaaattattctgaattggtatatggtgcaatatggtacatcagatcaaatggaatattggcacaatgatgaggaaactatcaaataaagactacaatggcaaaatcagttaacaaaaagttcagagatttcccacatttaatttatgaaatatagcacacggtgtttgtaggaagtaccatgggcaaagagtgaaattgtgaaaaagaaaattaataatctgcttgattgaaaatgggcatgagtctttagttagttggcttccaagaacattttcccttagataagtttcttaggtcagatgcattctgagcaggaagcaatttacaggccaaaatgcgttaacataatgctttatggaaatccatattattttgataaatagagaaggtacttgcaatctcatatcaaaagaagaaattctaaaaaggagcagaaaaaggaagcatctaacataaaaagaggacatccctaaaatagttccaaaaatggagtaaccaaatatattgttggtcctgtatacttgtatagtaatcgaatatttgcgcaaatgtcacaatgataataaatggtagtcaaattgtccagagctggaagattatataatgcataggtagacaattaccaaaaatggaatgaagttactcctagggcgcccccttctcatccttgaaacataaggcacatgcacactacaccctccaagagtatcttctctagtaggataggctgtgctcaacgaatcaacctcatgcaaaggcgctatccgtggtctcaataacacctcatcatatacatgcctttttccaggtgaagaaagtctcccagtggattcatgagtgtcaatatctgagagctcctcaatgtatctttttgttggctttctaattctcttagtagttccttgttcggcaaaaatagttacttgtggttcatcattatctgttggtactcttttgagtctcttggacgatctctgttgctcctcactatgataggaaagacttgatggtaaatctctctcatgtccaggattcattacttggtccctaaccaaattagcctcaagttccatctttggtattgcttcaaccactggtatttcttgtttggcacccatggcaataactttataatccctaacaacacaacctgaacttggaacatcacatgaattgatcaaccccattgcaatccgtcttttgagccatagcttgtccttgacagtagtttgacgcccaaatgtggctctaaatgcttcctgaagttctctcattgtaagatcatccaagcagacttctccctttaaaatggaaaaatcaggaactgaactagtaaccccagaaacagattgtcctgcagatgcctcatttacaggtttcgagcaggcatcagccttttctttatcagaagaaaggtcatttaatactgttgattttgtagtctcagtcgaagcattgtcctgttgggcaatgatatttgccccttgttctgtatttagtttatccagctgctggtcatgaacagctgaacaatttgaaggaagaactatcgaatcattcaatgtacataacctgtcttcctgtgaaatgatatgcatctatttagtgttacatcaacttgaatatgtagattgaaagaagatgtatacaggtgcatgtttagtggatggttttaagggaagtgctcaaataaaaatagattgccctgggattgtatttcacacagatcaatctcttattaccacatctttcaatgatctacagtcagtcagatatgtctcaccgcatatcctgtgttcacttaaagaactcagcatcttctcattacattgaagctcatcccatagttttgatccatccatccatctctatgtcagttcttgatgacgataaaaatatgttcctaactagtactaaacaaagttgttacatacaaaagtggaatttgttgagaccgcatacaattgaactttgaactgctaattagacaaaaaagaactaatccatatttttaccatgccagaattagcttgaaaaaaatgaccacagaggtacctaagaacaaactaaacctattatctaatagaattaacatactatctggtcataaaatgcttatactcaatcgaagatacttcacttcgattagtgagggtattgaatgaaacagaaaataggtttagtgaatcatgttcatgatgcacaatggataagcaatatacctcataggtttagtgaatcatgttcatgatgcacaatggataagcaatatacctctaagccagcatctaacttttgtgtctgtacatctgcagtgtctaatttggaaggcccctctgtgaaaatatagtaataagtcaacatctcaagtaatcaaaccaatcgaatcaattcattaatcatgctagcttgcaaactacaatttatcctcacatggcatgatattcagttatcgatctaaggaagtatgatcacccaaacagaaatgacaataaagtagaaattgagatagaataatatttctgagggcaccttcaaactcaggcttcttcactatgcaatcattagtaaaatattcctccacatgtgttacatcgtcaatagaaggcagatcatcatcaaccttctcatcatgaaggaaagtttcaaactgtaagacctcatcctccgtagcaggaataagtgttccatcaccttcaacctgaacattttattttaaagaaaatgtgtttctcaaagaactgactaaacaattggaaccaattatgtatattagtgtatagccaatagaccctatgatgagaacttacccgaactaactggtaaacaacaggatcagaattgtcattcttatcaaagtcattatcatcacttctgttgtccagagcatcttgtggaccacccacctccatagatcagtacaagcttcatccaatacccttactaatcgaagtctaccaaggtgaaattctacagtcagctaataagtttaggattaagattaagtcaattaagtaattcagcaatcctggagagtagagagaacaaatataaagaacatttgcaaggatttatgactaaacaaaaggattcaggtaattgttggacagactattgcgatatgatccacgctatctttaggcaccactctttttcccctattacaaaatgagcaaatccatgtgtggtgggaatgacaaaagcgatcacacaccatagtgagatcctcaaaatcccaccaaaaactactgaactggcagacaggggcggatccaacttgggacatgggggaacaaacaaactgtttcttgtattaaggttaaggctctgaaatcaatagaagaagcttcttccagatcta

SEQ ID NO: 11703 - DNA, 17192 bp, Oryza sativa
tgcacttaaagtttgagatggataatcttgtgctacttcataatatgatatttcgagatttttgttcaattttgaacactttttgttaccatggataattgcgtgagttaatttaaaaaattatacagtgataatggagtctaactagagggcgatggtatattatactccctccgtcctaaattataggcgtcctccttttaagaaaaatcaagctcagtaacttttaactaacaatcatactaaatatatatacgctaagtattatacatgttacttcctccgtttcacaatgtaagtcattctatcattgcccacattcatatagatattaatgaatctaggcacatatatatgtctagattcattaacatcaatatgaatgtgggaaatgctagaatgacttacattgtaaaacggatgaagtatatcactagatttatattttaaagtagtttcatgtgatgctaattttatattcgttggcaacaaaatatagagtaaattaatggttagagtatgtcagtaaagaccatgtaagaaaaatacatgccttataatttgagacggatggaatagaagttaagcaaaatacgatatcatattatataacgagtcaaaatcagtgacacaatgaattctctttgaaaaataatatagtcgaatcgttttttttattttagtcataatagaacttttttttacctaaacatgattgggggactttgagagaagataggaagaggggataatgtcactagccaaaacacatggggggaggggaagttgcttacatccatggtatgttttgataatatactattattattaattttgttcttcactgtaatacgatgtaaaactaaaaaattaacatatattactatttcattattcacttttcttcttattttctcgatcttttttattttcaatgacaatattgctagaggtccgcggagccgataaccatgtgggggtatttcaatgaagctaattttgcatagtagatattgctaactattatctataaacttagtcaaatttgtttaagcttgacagtcaaagtgactcataatatgaaatagaggggtagttgcatgcctatgcattacaatatgatctatagataaaaatatgatttagtttatttctaatccatttttatgagatgttggctttttttatttctttaaagaagttatttagggtatagttttttgaaaagtgaggtcaattttttaagggagaaggagcattaatacttagatggattcttttttatttctttaaaagttttttaaggagaagagaatttttttttgaaagatataggaatatgtttttaaaataattaatatctccctcactgtcgctcacccccttgtcgtcttaggtactcctctaggctttaacttttcgatttcgaagtaaaaaaatcgctcttcactggtttaccaaatccgatcaaaaacgataaaaaccaacgatttttagtcaacgccgtacggaaaactagctaataccgaccggttttcataaattcagacctaacagtttcacaaaagtcaactggttttcatgaaattccatcggttttatgaaccgtgccaccctccgctgccttctctccctcccaccttcctcagtacactcctcctccacagaccacagctagtcgtcgtgccagcctgctcgtacattggagccgaatctagttcgagaaagaaccaccatgatgactatcaggaggaaaataaacatggcgggcgctaacaggtatggtggtaagagcaggtacaatagctgtctataaaccagctataaaacatattttaaagagttaaaagaaaagagagaagagcagctggctacagatctgtagctagctgcagcacgaacttcaaaacgtaatatttgtatgacattgtgggaccatatattaataatacaataaacaattattgtataaattgactattatattggttatagatgatttatagctagtagtgagctatactattgaacttgctctaagcccatcgtcgacaagagctcgttaggctgcatccaagagacaatgtcgcaacgtgggagcagagcagagaaagacatgcggagctctcgtcgcgggctcatgctcaaagggagagtacacttctcgtcggagcttctcgtccacccacggaacaggccggcatcagggacccggagtcccggacacacgcgggcgggaagtttaggcccatctcgattttactagctgcgtggccagcgtgggagcgtgcggcgttgccaaccgccaaccatggcacgcgcgcacgggacgaggcgcgtcggctgccgggagagcgccaccgcgccaggcgcccgtgacgtgcatgcgacggcgtggccgccccgtgcgggacgtttcaaacaaaaacataggcagattggtcgtgcgacgacgtgcgataaaaagtggaggaagcctagactagacgagacaagctgcgtgcgtgtgcgcgtagtggccaatgtgggggcggctgcggcgcagttgatcattagccgcggcgcaatgtcgcggtggattcgctttcctttcgtcgtccggtggaccgcgcgcccatatgcgatgcgccgctgcgcgaaagggaggatcgcgaagagacgtgcggaggacgcgcgcgaagactatcagtgtgggcctgactcgtgaactcttttgggaacgtttttgctgcagcgagtcgatgtacgtgcacgtctggatcaccatattctagtgtaccgaccagtgttcaacacatcaatcattttattttagataatagaataaacatcccggcatttacttatcagagctacatccaattattacaaagtatcactttaacaaaatgtgtagtttaaatgaaattaaacacacccaacaaaataaaaaaccaaaccaagataagaagaacacatttattaaagtctgtttatgaatttccatccatagcttaaaaagagttgcataaccgtcgtcttaagcatcaatcatggtgggtggtgtttcatcgccaatttactttgtagggttcaggtttataagttagttttttatacaagcttttgcgtcggcactggcctgcaccatcatgaaccgtagttagaaaaagagcacgattcgaatatcttacaaggaaagaaattgttcattgtatccagcagagaaacgatgcaccacccccgcgcctttctttgctccgggaaagagctcgctttgccgctcgacggaaagcttctctgttttatgaactaactaacgacacgtacgttaatctagcatccctagcatccggctaaacgggctaaagtaaatggaaatcagtgaacggagcacatgcatgccatacggaagggccctaatagtcacaaaaatttccgatcgtccaaataccgttttcataccgagcgtcattttttttatataagaggtaccgtttacaaccgttaccaagtattgcaaattctaatttctttctgcatcatactgatatcaacgccgagtaatttaaatgataaatatgatcaatcaccgattgattgagcgtcggtttcgaagagatgctatcgattctcgttgttttcactcactacatcttttttttcgcgaactcatcactcactacatcgatagactgttttactgttaacgcttcaatttccactgcgggagaaagaaaatgtacaaattgtcgacgggcagtgtctttgcatgactcgagtttcgctttaccagcacgccgtcaccgcgcgccgcgcagagccctcaccgtccgttcctccccaacaaactccaccgctggggaagagacgagcaactaaaaaaaaaaaaggcgaaaactcgagtgcgcgcagtgtcatccgcccccgtttccacctgtgcgcgcgcgcggcgtttttcaacccccacggacacctccgcacgaacgcaccaaccaaaccaaaaagcccctgcgaatctgtgatcctctctccctcgccgcgatcgcgttcgtcccacggccgcgcgcgcgtcgcgggggcgtcactatgtctccgcaccacagcggccgtctcgcgccgccgcgccgcaaccgggagaacccgtccttctccgccgcgctgctcgacgccatctaccactccctcgacgccgatggcagcttgccggcgtcccccgccgacgccgaggggtcaccggtgcccggacgccgccgccgtccttcgcagtgcaacaacctgtcgccgtctgcttcttccgtgcggtcgccgcggctgcagaagacgccgcggccgtgtcgcgtgcggcctgacccacagccttcgcttctcttgccgccgccgcagccgccgccgccgatgccggagtcaacaggagacgtcgcggagaagaagaggggcagaaggaagaacaagaatggtgccaagtcggcgccattcgcgtgccttctgaatgctctgctttgcaacaggaggtcagccaggtcggccgagccgacgacgccgcgggctctggcggtggcgccggcggcagtggcagtcaccgccgctgagccggcgtccgcgaggtcgatcctgtcgtcgcgcgcttcccggcgacagcccgcggcgacgggtgggatcctgactccggcgaggcgggcagtgcggttctcgccggtggcggtcgtggtggacgacggcgagcacgggtgccgggacgccggggtggcgaggctgcgcggcgcggagagggaggtggccgcggcgcaggagtcggcggcggaggcggagaggagggtggaagagctgctgcgcgcgctcggcgtggcggaggagagcgagagggccaaggagagcagcgagtccagctccgacctgttcgagctcgagagcttgccggcgttcgacgacgccgagctgccgcggccgcgagctgccgccggactcgtgctggcacgtccgcgacctcgcgtttgttgagagttgcacacaagaattaatacctcttcttcgacgtgtaagctcaatgcagctatgcagcgtgcttacgcttgtctggatgctgaatggctgatgaatgtttggaaatggcactgcattgtcgagtgaaaaacaagtacaggcatagcattttgcatggggctatcacatggcgctttgttgttttccctgccacagaaaagagtgtaataaatttcaccatggtgcccaggtttctccagccggcccggcagatttgttactctgatgtctttctgcccgttgtttccatacaagcaagtaatttttttaaaaaaagagatttggaacgagagacctccaaacattttttttaagaaaaaaaaatgagtgtattagggattgaacacaatatttcagggttgaagccatacacccattaccattgcactaccaagtacatctccatacaagtaattgattgtgttacttccattgtttatctacaattctacaaacgtagggctgttttggtttgacgtcatacttatcttactagatatttggtaactttaagtagtagttgtttggattgctttcaatctttaccaaatcaatacaattaatactactattctactatactaaaactgggtactgccaaatcatacccaaaatttgacactactaataaattagtgggatggtagagaaccaaacaaatccgtactaccgtaagtttgtcttacaaaacaatttcaaactcccttgtcgtgttaactttttcaaacgttttgaggtcaagaatgctgtcaaagaaactctttcgttctagaacacaatttatatttatgaaataaagggggaaaaaggaaaaagaagaacatatccatgcatctcagagtagttcaggaagaacatgacctgcgcaggacgctgcttgttgggcaaaaacatttgggctagttggcctagctctgtatcgcacatatggcccatcggctcacatgacgaaacgggccggaaattccactctcctggactcctgcgcttggagccggcccaaaccaaaccaaatcccaatcttgcaaaagtttttaccgctatcattctatcaagggctgttctgcaaaatttgctaccatcagttcgtcggaccgggagcgacttctaccattggatgtagcatcaacggtgggcgagagcccgcgccgctcgccggaggtctcctcgcctcgccgcctccttctccggcgtgtgcccctcctccgctcctcgtccccaaagccaatgccgcctcgatctcctcgccgacctcctccacagtacagctgggccgccgccgccgccgcctcctccccgcgctgcctccctctcgcggtctcgttccaatattggcctccctctcaggtctccgcggccgtctcctcctcaaccccaccatggagcgtcacgaggaggtgggttggagcctggacaccgtacctggctacctgtttgctgctgtaaactgccaacttgttcttgttgatctctgcactaagacctaatcttcttttgtatcaggagttgcctcctaatgtcccataaaaattcctcgtgtgtctctttcctggttttgggcgcttcggatcaatccactttgggctagaagaagcttatggtaaggtgcattttccctgctaacaatctgattctggaggagaaacaacattagtgcttttcgattctcacagattttttgttaactgttctgaactcttgatgataaattggcacgtactgtttggatgtagaaaaggacatgttttgcatttcaacttgttgtatgagaacaagccttttgtcttgcaatctgatgaaacactgtcattctgttatcaagttccattagattttattttgttgttgttgttgtgagatgttgagtatgcttctgaaagcgtcagtggagagatcctgacttcatgagaagggcaataagtgggttgagcagtgcgaatggaaattttaggaacaaattaattgatgtttttgaagagaataatgtttcaactgattcacagcgatcatctttgtctataaaacagaactctttcaacttcagctccttaattacatatagcaaacgaaaatgacaaaaactcggttatattatgtccatgtacttatttgtttggctgtgggtttgtgcttttgcagcttgctatctagtgaatgagtaagttgagctgagagctaggggtttgaacaagctattgaatctgtcattcttcagaaacaagttcatttaatccggtatgctggataactgcacatcaagcttgaatcatggtgtcttatcagttccggtttggttgaactaaatctgggacaggtgatacttttggagcattggtctcacttctgctcaccttgaatttgctgtactttttgtcctcgtaatgaaacctgataagttatatgacatgttggttagctgttattccagctgcacttgtttcaggtttttttagcaatatgtctccggcatatgaccattgctgggttgtgagctggttactttcttgtatgggctaatgttctttggagtttggatttgacacacgtccagaaaaacttcaaataacctttgaggtaatagtttttttactacatttttgctggtagtgtcttgcttgttatattctttgagtggtttcaattggagcagcatatggtgttatcagttttacattatcaattaaccatgctaactttatcaataagatgaaaagaatccatcagtgttattcttagtattacttccctaagaagtatagcattcactgctttggatctgctgtgatttgttgaactttttggaaacaagaaattaaggagtatctagaccttgtattcataggtgctgtcacgccccgaactagccccgaacagaaccagcccgtgacgctccaaattaacctgttaaccgataccagtcctaggaaatagtgctggtatcacaggaaaactgaataccatagcaacaaaggtctctttattatagagtaggattacagtcatgttgggctgcggacagatcccaagctcacaactgcattacaaaagaggaaagcggaagccaagacttggaccattcatcacaggcgcgacttgggaactagatcgaaatcctaaaactcatcatagccgacttgctcctggaagaactcctcgtcagcgggatccatctcatcttcttcagcaactgggggggattatttatatagagcaatagtgagtacaggagtactcagcaagtcatgggaattatgtgtttaatgaaggcttcaaaggaaaggctgttgtttttacaattgattttagttaaactccttttttttaaaaaaacaactaagtgagtgcttctcaaacgacacggatgagacaatgcatctcgtccggtcggagtatgtgcattgtatcagtctttgattgattcaagattggcacccggccacaactttcaaacggccacccgggcctagctgatcccgtcaaccacagatgttccaaacatcgaacccaaatcaacaatagcaatttcacaaagtagtagtcaaacaaaactacgctaaggaatcaccttacatccgctcatgaccgtgggcacggctgttcgaacagtttaataacctctgcagagggggcacactttacccacacgacattactaacacggatcacccagcctgtgcagaacagccacgtctggtgtccttgaggctttcatgacaaggcatttcgagagccgacacaggtttaccatatgccaacgagaggggtcccagaccaacaacaggttaggtcccagaccatactatgccaggaagcccaggggtcctccccaacaccaccctggcaaatccacttgtctcccggcatcaaggctcccctgattagctaattactcagccaggggtgtcccattccacccatgtggtcgtacttgttatatgttcggatgaaattccaaaggaataggtccttaagtgcaagagcgggaaaccgtgctcccgagacgagacgggcactgtgacgagaggccgacggcacgagagtgatctctccggcctcgggccggggaagaggaagaagatgagtgcccggagtccccttcacgcgtccttcgcatgcacctgctctcctggtgctttggcgacgaatggcggaggtgcaagcagggcagagcgacgatggtgtggcaggcgctgacggcggcggcgactggccggtcggccagcacggcgcgcgcgcgcgggaagcaacgggtggcgcggcgatttgagcggcgtcggcgggagcggcatcgagagggagcgagagcagagagagagagagggggaaagaaagagagagagcgagctctcttgctcagcgcccgagcggcgcacgtgcctcgcacgtgcgggcaaggatggaggggagaggagagatgggctgagaggaaatggccggggagaagagatcggcccacgaactcgagggaggcaaaatagactttttcgagaagatttgattcgggacagattgaggttagggtttggattcgacgatggattggggatttgagatctggaatggcacggacactggacaacaaacaaagaaacatttttcgcatttatgatttttaagagatagttttcccactaggtgccacgacggaacgggcgctagagaccaatccccctaacaagaatctcgaccccgagattcagcacctaagggagcagctccggaaactcggcgcggagatgatcttctcgttcccaggttgccttatctttagaatggttgctccattggaccttgtagaacttgatggtctttcttcgagtctgacgctttgcctcttgaagaaccttgatcggtctttccttgtaggtcaggttgttttctagctcgatgttgcccaggggaacttgttcttctggaactcgaagacatttcttcaactgggatacatggaacacgttgtgcacatctgcgagaccttcaggtagctcaagctgataagccacttcgccacgtctggctgttatgtggtagggaccaatgtagcggggtgctaacttgccggacatcccaaacctcttcataccgtggaggggtgatacccgtaggtacacatgatctcctttttcgaactcaagatcacgcctccgattgtcagcataattcttctgacggttctgagctgtctttaaacgttctcggatcagcttaacttgttcttctgctgccttgagtatgcaggaccgaacaccagcgcttcgccaacctcattccagcacaagggagtgcggcactttcttccgaacattgcctcattcggcgacatctgaatgctggcctgataactgttgttgtatgagaactcggcatacggcaggcaacgatcccatgtgccttcaaaatctagggcacaagcacgaagcatgtcctctaagatctgatttactctttccgtctaaccatcggtctgcggatggtaagccgtgctgaagttcaaattggtcccgagagcctcatgcaactgcttccagaaccttgaggtgaactgagtacctcggtctgacacgatctttttcggacagccaaatcgacataccacgtgggtcatgtagagctctgccagtttctttccatcaaaggtagttttcacaggcacgaagtgagccgattttgtgaattggtccacaattacctagatggagtcatacccgctaggggttcttggtaaaccggtgatgaagtccatcccaatttcttcccacttgcattcggaaattggtaggggttgcagcagaccagctggtctctggtgctctgctttaactctttggcaaatgtcatagagagccacatattccgcgacatctcgcttcattccagcccaccagaaatatcccttaatgtcctggtacatctttgtacttcctagatgaatggagtaggcagactcatgggcttcttttaaaatgatatcttttaattctttcttggctggtacgcagatgcgagatccgcaccacactgtgccttggtcatctatggagaaaccggtgtatttcttctcgtgtattctttctattaactcttttatacctttatcatctttctgagcttcccggatttgcgattccaatgtaggttgcactgtcaggctagcagggatggccgactgtaccactatcagccttaacttttctaattctctgcacagacgatcttggtctggccatactttaactgcattgcagtaggtcttgcgactcagtgcatcagcgaccacattggctttaccgggatggtaatggatcccaagatcataatccttgattagttccaaccaccttctttgcctcatatttagctctgtctgagtgaagatgtatttaagactcttgtgatcggtatacacttcacacttgtacccgatcaagtagtgccgccagatcttaagggcatggatcacggctgctaattcaagatcatgggtgggatagttgacttcatgaggtctaagctgcctagacgcataggccacgaccttacgatcttgcattaagatatcccaagccttgccttgacgcatcacagaagatttcaaagtcttttcgtatatctggcagggtgagaactggggcagtggtcaatcttttcttcatttcttgaaaactgtcttcacaggctgctgaccattcaaacttcttttctttctttagcaactcggtcataggtctggctaacttagagaaaccttcgatgaatcttcgataatatccagctaggccaaggaaactgcggatttctgacacattcttgggggaattccaagcaagtacagcttcaaccttcctgggatctacttcgacaccgttagaggagatcacgtgccaagaaatgctactcggtccaaccagaatttgcacttcgagaaattggccaacaattgatgttctcttagcttttccattatcagcctcaggtgttcagcatgttcttccgcattcctcgagtatatcaagatgtcatcaatgaataccacgacaaacttgtccaagtactccatgaagatcttgtttatcaggttcatgaagaaggccggagcattggtgagtccgaaggacatcaccgtgaactcatacagaccataccgcattgaaaaagcggtttttgggatattctcagatctgattttaagctgatggtaacctgacctgaggtcaatcttttagaaaactttcgctccttcaatttcatcgaacagatcgtcaatccgaggcaacgagtacttgttttttatagttacttcattcagggctctatagtcaattaccattctctcagagccatcctttttcttaaccagaagcactggggctccccaaggggatgagctaggtcgcacataacctttactctccaattcttcgatctgctttttgacttctgctaactcattaactgccattcggtagggtctttttgcaattggtgcggtgcctagtgccagttctatggcgaactcaatctctcggtctggtggcatacccgttaactcttctggaaatacgtcgggatatccacagactatgggcacttattccaagggaatggcttgcaaactggttaggatagaccgacttgcggtaagggtgttaggggtaaagcgaacttgctttcctccaggtccttgcaaggtgatggacctttcggcacaatctatctgtcctttgtgcttagccaaccaatccatccctaggatgatgtccaaactttgcgagtctaggattattggtttggctaggaaatcaattccctcaattctaatgttaacttcggggcatattttagttgcccctatatcccttccaggggaatgcactatcattggaacttgcaatttttgggttttccaaccatttctttttacaaaagcttgcgatatgaaagtatgggaagctcctgaatcaaataggacgattgcgggtacggagttgatagagaacatacccatcacaacatctggagcatcctgagcggtttcagcttgaatgtggttcacccggcctcgaccgaagttgttggaaacatgagatccctgtccactagcctgagaactaggacgagacggagctggtgcgggagtaggagtcctggcggtgctgccattagaacgtcctgagttggagttggcaggatcctgtgggcattgcctggcatagtgtctcatctggttgcatcagaaacactgaacagacgccattcctgatggtgccttgaaggaggacacactattcggtgcagtattactgctaggggcacgctgctgcggctgaggcgccaggcggttagtctgaggacgaggtgcatagcttggctggcggttagcatgagtgactgactggtgatattgcatgggttgtccaaagcgagggcgaggtgcacctcgggaggaattcccctgatgattagacttgcgtttcttgtattcctcggtagcttcttttctagcatcttcaaacagaagagacttgttgatcatgtcatggaaagtggggaaattatgagcaagcaactgaagtctcatcccaactgcaattccctttaagaacttcctgatcttcttcttatcggtgtccacttcctcaggggcataccgagccaacttgttgaactgactcaggtactaattgacactattattgccttgcttaagcctgttaaattcctccttcttcatatcaatggtgctttcaggcacgtgagttgcacgaaaagccgtagcaaactcatcccaagcaatgttagtggggtcaggatgagcattgcagtagttttcccaccaatcagcggcaggtcctcttagctggtgagaggcgtagagtgtcttctcgaaaggagtacattgtaccaagttgagcttcctttcaacatccttcagccaatcatcagcctcaacaggcacgacggtctgagagaactcgagcggacgagacctcagaaagtccgtcagcttggatctgttgttacccatgtggggatggccatttccatgtgcattatgctgaaagccggctatggctgtggctaatccctgcaagatctgtggctgtggctatgccatcaagtgctgcatgttgttttcaacatggggtggggaaggcatgcatcctccaacagggtcgcgattaacagtgtggtgagagcggtgagaaccatgggactgctcaacctcggcatcgcgggatgctgtgtggtgcgaacggttagtgtggtgagactgctcatcagccgactcgtgatctgcctctggctcaactctgccttcttcaaaaccaaaacggttcggtgcacgggtagcgcggcgaggacggctagccatctaaactccctgaaaaagggcggggtgagaatcggacaagcacttaatgaagacaaggagcaaaataaataacagctcagatagcacacactaggcataaactggttttctcaaatcataaagacacctgatacaacggatgtggacaagtcacagagctacgccgagcttgactgtacgcacaccacctaggagaaccagactaccaaacaacacccacatcaaacacacggacgcactacctcgccacgactccgaaagagttggcggcggaacaaaagggcctaacacacggacaactgctgaagactgcctcctctactcctcgcctgcctggctgcctcctgtggtcagttcctcagtcgaagaaacgtagatcggcgcacgcgaagggaccggcggaacctgtcgagggccggcaacagcacgggccgctggcggagggggagttgggtagtcgaagcggaacactgtggaagagccaacaacacgcttccgcgcagtgcggatgaagcgtgggccacggcaggaggaagcaactagagtgtgtccgggggtgtagaaggggctaactgggtgtgggtagggagagtacactggtgagtacggcgcacgcgagccgggggagtgcgggccactgggagtgcgagcagagccgcgggagctgtgggaagacaggtggctggcgtggcagaggcggccaaagtcccaagaggtagtgtcaactgaggtgacaccgtcctcggccaggcgggtctcgagtgcagcgtagcggcgtgcaagggagtggtaagcctcaaggagaaggtcgtgctgggtggcctgagccttagaaagctcaaccatgcgagtcagcacaggctgagactcgttgtacgggcaagggtacctggtgtcagtgcggccagaaggaaggcgtgggagctgccggaaggcagagcccccgaggcggtggctgtagtcgtgggccaagcgacgaagtgcagtccaggagaggtcctggtacgcgatctggagagtgggcctggccatagtgaagtggtgtgggcgaaggccagccccgtgtatacctccacaagggtaaaggtataccgaaagctcacaacgagggggaacacggtccacggagtaccccgtgtactcgggacacgagaagccaaggaagcgggcgaggtcacgaagctgagcgacgtggtgaccctcaccaaaaccatgggaactgaagctggcgttcactgccatctacaattttgaaagagggagaaaagatcagtaaccattttagcaacaaactactgaaaataaagaaagcaaaaagaaggcttagcttttcacaagtagtttttgaacttaatatccttagggtcgtcctaaacgtcgggtttcgtccaagggccaagcctgtgctctgataccatcttttatcacgccccgaactagccccgaacggaactagcccgtgacgctccaaattaacctgttaaccgataccagtcccaggaaatagtgctggtatcacaggaaaactgaataccacagcaacagaggtctctttattatagagtaggattacagtcatgatgggctgcagacagaccccgagctcacaactgcattacaaaataggaaagcggaagccaagacttggaccattcatcacaggcgcgacttgggaactagatcgaaaccctaaaactcatcatagccgacttgctcctggaagaactcctcgtcagcgggatccatctcatcttcttcagcaactagggggggttatttatatagagcaagggtgagtacaggagtactcagcaagtcatgggaattatgtgtttaatgaaggcttcaaaggaaaggttgttgtttttacaattgattttagttaaactcctttttttaaaacaactaagtgagtgcttctcaaacgacacggatgagacagtgcatcttgtccggtcggagtggatgagacagtgcatctcgttcggtctgagtatgtgcattgtatcagtctttgattgattcaagattggcacccgaccacaactttcaaacggccacccgggcctagctgatcccgtcagccacagatgttccaaacatcgaacccaaacccacaacagcaatttcacaaagtagtagtcaaacaaaactacgctaaggaatcaccttacatccacccatgaccgtgggcacggctgttcgaacagtttaataacctctgcagagggggcacactttacccacacgacattactaacccggatcacccagcccgtgcagaacagccacgtctggtgtccttgaggctttcatgacaaggcatttcgagagccgacacaggtttaccatatgccgacgagaggggtcccagaccaacaacaggttaggtcccagaccatactgtgccaggaagcccaggggtcctccccgacaccaccctggcaaatccacttgtctctcggcatcaaggctcccctgattagctaattactcagccaggggtgtcccatttcacccatgtggtcgtacttgttatatgttcggatgaaattccaaaggaataggtccttaagtgcaagagcgggaaaccgtgctcccggcacgtcccccggtctgcgatttttggaaattcatttagttcgtaagcaccgacccaggtgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 11704 - DNA, 6241 bp, Oryza sativa
ccatacaagtctccgtctgtttatgaaaagtggggtaagtccccacaaaaaagagagaaatggtgcatgtggtatctccttaagatataaaaggaggaccttgcccactgagatgagggagtagactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccatgagtccccggccgaaccggcaaaggggggcctgcgcggtctcccggtgaggagccccacgctccgtcatctggcgcgccaggtaggggtccaggcctcgggacccgaggggagtgctcccaactcccttagattgattgcttggatcgccgagatccaagcatatctcacagataagactctacccgaggaccgcgaagggagtgaacgcgtccatcgcatctccaaacgctacgtgctggtagaagggaccctctatcggcgcgtggctaatggaatcctcctgaagtgcattcctcgggaacaaggtgttgtgcttcttgccgatatccatgaaggcgaatgcggagcccactccgcctcgcgcaccttggttggtaaagcttttcgccagggtttctattggccgacagctcttaatgacgcggtcgacctggtccggcgatgtagagcgtgtcaattccacgccaagcaaatccatcagccggcccaggccctgcagaccataccactttcgtggccatttgctgtatggggactcgatatcctgggaccgtttaggcgggccccgggcgggtttgagtatctgtatgtcgcgatcgacaggttcactaagtggcccgaggcttatccggtcgtcaagatcgataagcactccgcacttaaatttattaagggcatcacggcccggtttggagtgcctaaccgtattattacggataatggcacccaattcactagtgaactcttcggcgactactgcgaagacatgggcatcaagctctgcttcgcctcacctgcccaccccaaaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgatggcactgagctgcctaacccgtggaacatcgaacaccttcgtcgcttctacccctgagggggggggtcgggtgtcaggtttcgggctcgggccaaccccgcacccccctcgggcgtgcagggttggccgggggctacaacatatgcatattcttttttctcttacatctgtatttcaataaaagcagtttcaatttcctaaaggctgtatctgtgctgttttttccttttgaagaatcttgacttgaaataggtcactcgtgctcaatcctgccctcgggggctcgggtcggctaaaatcgccgaacggggcccagaaccgagccgtgccccgaggcgtggtgaactccggggggggggggggggaatcggcaaaaacccacaatcgggtcacccataaccctcggtcaccacgttcccggcctggccagtctcgacatgtggatctcctcaggcactagccccgacccgcgccttttgaggactagaacttgggcacgagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccaagccatcgaagctgtcgacgatatggtcggcggcatcccggacctgcgcgcgcgcgcggtcctcggtcccaggagggaactcatccagcgccatccatggggagaaattggggtccctggcctggtaactcgccaggacgagctccaccgctccttgggcgaggtccctcgaggatgacttaattgtcttctcgagctcctcggggagccgttggagagccccggccatcttcgagaggcgctggacgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgtgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggctgactgccagctgttgcgccgcggcctcggccccctcgagagctcgctcccgctcggtgagcacgtcctcgcggaggcggagcgtgaactcttcttcggcgcaggcagcctcgtgcgccgccagcgttgcttcccggatggtgacagcggcctcgcggtccgccagatccctctccacgacgcaggcgcgctcttccagcgccatggcgcgcgcctcaagggcctcttcacgctgccgggacgccgcttcggtctccgccgcccgctgttctcgggcagcggcagcgtcaagcaccccctgggcggcgtcgagcttcttccttagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgccaatggaagtgccggactcggggatgtcccccggacccggttggtcctgagcgtcgcccgagggagtgggcccaagcgacgcgcccgcggcctcgtcgcgagctgcctcggaagtcgccatcgcctcgtcctggcgaaatccgacttcctcccgagcggcttccccggcctggcgggcccgggcggcctcctcccgagcagtttcctcggcctggcgagcccgggcggcctcctgggcggcctcctcggcttcccgtaggcgatccgcggcctctcgccggtcagattcccgcctgagggcctctgcggccgccggatcctcggccttagactggccggacttggaatggcgggagggatgcgacgggatctcgctgaaacaaaagaaaaaaccagaagacgaacaagatgggtgagtgaaaactcgtgtcgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccgccctgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctacgccgtcgtgaccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcctcgtcggcgaggggagtgtagaaccagtcgctcttccagtcgtcccacttcttgcggagggtgcaggggatgtagcggttcagcaccggcccccgtggctggaagtagcagccaccgactccgatggcggcgacaccgactgcacggtgaagaaccaccggaacagccgaagagatgggcgcaccccaatgaacatctcgcacaaatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggtgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcacattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagacaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgattgccctggcataacgccgggggctactgtcggtgacatgggatcaggagtatcatgactagaggtttgaggcagacacaatcgcacacgtggcctggtacccccgagggacgtcgggcccaagggtgatgcgttcgccctcctcttagtccccccgagggggtt

SEQ ID NO: 11705 - DNA, 11135 bp, Oryza sativa
ctcacctaaccacatttattgcggttgggctgagcgtgtcacgccgtatgtaacgcagtgcagtgcactcgtttatccggtctatgaccagtcacagaccggtcagatcgcgggttaggtggcgacaggcgatctgacgcacacctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtaggttgctaagctgacacgtggtggacaagaatgaccgacgtgactggtctgataccggtcatgtcgtcagcagacaaccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgagggagtagactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaccaggtgtcgggtttttccaagtcttttgtaaaacccaagttttaccgatcgttggatattttaaatttgaggggaggacttcgacatgcgtgtccaaaggcccgtacatcgaagtacagcagtcgacaaatgaggtttaagtgttcaattattcaaggagggtaattgcagcaattaggattagggccggtaggctatctcgcaagccgcggccaaatttcttgtgttaatcctatccatgcattatttgcggaaaagaaatacttagatttaaattataggtgcaagatgatcaaaggtgacttgccttgctcgagatcttgagcttgatcctcgaaatccgcgcactccgggtcttcgggcttcgaagctacacgcgaacgagacgactcaacaaacggcggaattaaagccctattattgacctctaagcgtgccattagatagatctcgagatttgaggatttttggaagttgaacggagtcaaacggatgtacggttgagaagatattgaatttctaagattattggatttttggtctaaagaaaaaaggatttaattaaacccctttttggaaaagaaaagagggagggagggagattgaactttcctcgggcggctagggcgcggcttgagagaaatgggcaactcggccgcgctaaatgggccggccggcccgagagagcatggcccattagggcgcgcgggaggaaaggggagagagagccggtggtccgggctcacctcgcgtggtcccgagtgggacccgcttgtcggcggctcggctcaccaagagcgaggtgcatgcggcgcgacactagggttggggggtgggtgcggtgcacgcgtgtggctcgcggtggacgcggcgcgcgggtggcccacgcgcagcctcttggctctccgtgggccgcgcgcacgcgagcagggacggaaggattggctgaccggggtcagcttgacccggtccggccgagctagctctgacgtggcgccttcgtggctgccacgcgggctggcgggaggaagacaaaggcgctggctgctaatggacggcgggcggcggcggtttctccgggacaccgtgcgacgacgagggcgacggggtgtacaccggaatgacaaggggaaaagagagggagcgagccaacggctcggattcacctgagggggttcgacggcggcggattgtggcggcggcaaccggtggcgagaaagggggatatcggcgacggcgtgacgggagatcgattcggattggacggaacatcgccgaggaagtccggcgacgggcggctactaccgagcgcggcggtgacggcggcgagcctactgcgagcggcggcaacggtcagggcggcgcaggctagctacggggagactacacaagctactgctcgagtctgaggggaggaggaagagcgaggagggagaacgggaaggtgttctaccgagacgagacgggcgctgtgacgagaggccgacggcacgagagtgatctctccggcctcgggccggggaagaggaagaagacgagcgcccggagtccccttcacgcgtccttcgcacacaccggctctcccggtgctttggcgacaaacggcggaggtgcaagcagggcggagcgacgatggcgcggcaggcgcgggctcaggcgcggtaggtgctgatggcggcggcgactagccggtcggccaccacggcgcgcgcgcgggaagcaacgggtggcacggcgatttgagcggcgtcggcgggagcggcatcgagagggagcgagagcagagagaggggggaaagaaagagagagagcgagctctctcttgctcagggctcgagcggcgcacgtgcctcgcacgtgcgggcaaggatggaggggagaggagagatgggctgagaggaaatggccggggagaagagatcggcccacgaactcgagggaggcaaaatagactttttcgagaagatttgattcgggacagattgaggttagggtttggattcgacgatggattggggatttgagatctggaatggcacggacactggacaacaaacaaagaaacaattttcgcatttaggatttttaagagatagttttcccactaggcgccacgacgggacggacgctacaggtgcaaagttgtaaactcagattctctgctgagaagaatcttgacacttcaatagtactaccatacctagttaagctttgttgcctgatgggtgttactttattcgttgctgcttagtatccccctattgtttgacatttctacggttcttgcttttctgtagagtctgtactaataccactccatttgttgggcttgttctgttcttttgtgagacaaacctgtactagcactactattatatctgctgagctactgaatcactgatgtactttgcaaacatctcttagatcaagggagcttaggtagacataattaagctgtatcatgagacctaacagtctaacaaagcaacgaaaacctttagtagaaatagcaactagtgctggggagaataattctactttggggaagcccagcacgcatggaaccctggaagtggatagtatgatactccagcatgcagtttcccttttcttgccttccgtgttggtccaggaatcgcccaatttggcgttttatattgaaccatttggtctctcttttccattacgaggagagggatcaagttgtgcccaatgggcagcgaagaatgatcatgtaaagactcttctctggtttctaacttcctatggcttcttggttaactctcctcttgctgtaagcatgcagtgagcctgacgcttcaaaagatgcttaaatcttgggcacactagtagtaggctattggtgatttggaatgtacaagattcttgttatggggtgatctacaactataatggtgtgagtacttgtgcctacgtttgacccttcctagtttgtggtcgcaggaatgcaagttgaagaacctgaaaaatgcatgcagtacggaacaatcgaaatgctggctgctttatttccaggaattgagacttgtggagtcggaaagcaggtgttcatgattttacgtacaatttttaagtagtttctgttctcttatgctggtaacttggttggggtccgattgtattttgcagtggcagtcgtacatgtactcaattgttatgttcaacccatcatgcataatactagtagtatatgcaactattcaaacccccatttaaatacagggaacattttctgatttttgtaggaaccgaaccttttcaaaatagtttttaaaattctttctaggagaattaacatttcctgtgttttgataatggcagcagcctacctaaactttagtcctgttttcatcacagtcagccaccatgcaatgatagacataaaactataccttaaatcagtcaactataccttaaacttaggaagagaagttgccaagcctgtgggagcctcagtgcgtgtccagagaataatttctttcactttctttaactaattttgctactactcctgccatagatagcaaccccggacgtgcacccaaccaacctacacttaccagccgcattggatgccgttgctccccacacacaccgaaccaacggtgagcatgtgacctcagggtgggccataccctgacgctgccaactggaagattttggccaaaaaccgtgtttcctccattgttaattaccctgaggtgacatggcaaccataagtttttgctatgggtacatggaccaatctgcgtcttattgttttggttttattctgggaaaggtcaggctggttttttaagggctggaatgacaacgataatgatatccataggagtatgataagtaggcgtgagataagatatgacgttttaagtttccatcaactatatattatcttgtagatttgtcgagatgatagtgaacggaaggtttttctttttttctagtgctgttatcatttgttgtcataaccatgttcacatgttatgtcagtaaagtgtattataaatactatagtttaggagaaaagtaaacttaactataaaaagatattttttatagtcactcctacagtcatgcatatcaagttgcgccattattcgtttgtctgatactttcttcggaacaaaacaatcatttgttacagcacaacaccaaaccaccctcggtcatgataatgctagctctttatcgacagcacctctagaacagcaatatgtatttgatcgatagatcgagattctatgtacgaattggtccccctccttaattaaaaccaaccaaaaaaatcagctcatacaagattaacctatgggaaatttgctattggtaaaaccaaattatatttctcctttttctcagttttctctcctatatggtccccaccttgcagttatataatcggtgctccagatgtaggcatacaaaattgcaataaagaatggttttgtaggcgtcgcttggaacaaggaggaggattaaagaacatcccccagttggaatgatgcagtcgaggggggcagcagcggaagcgacggcggggaggagccgaggaggctgcaggcgcagcgagcagcagcagcttcttcgctcggcggaggcaccgagggaggaggcgcgtggtagccatgcttctcccctcatcgtcttcttattcctacgcctccaaaggtcataatccaaacctttctcttctcccttcctagacgatgtagcagtagctatacccctgatcttgtgcaagtgctgagaccactgggtaatcttggtttcttggagcatatgtttgtttgctgatcttgtgcaagtgctgagaccactgggtaatcttggtttcttggagcatatgtttgtttgagtgcgtgttcttgatctccaatctcctgggtagtttgtcatgcttgacttttcgtagtcaaagaacgattcttttataggattgtaatggagcatattcttgatgccgaggcttattacgcttagtgtttgtggatttgactggatgcatgtcgttttggcacaaagattgattgagtatggagattgttgactagtcgtgtgtggcttgtaaggctactattggatgtctttggggctctagggaggatctctcaagtctcagtgtcagactcgatggcagcagttgttgtcatgcatgttcttgggaatttagatcatatatcatcatcatataagcttgtgtttatcacttgatgtgggaacatttctagtgctgcctttctctcgaccatatttgaggacgagtgatgtgttgatgactgatgaagtgatgatatactcggactatagaaattcagtccacctattctgtgtgttcctatagataatttcctgctggttaatactctttatatttgttgtatctttaggttgtgttgtatggatttatttggtatattttgcttcggttgtattttcccagtgctattcatatacagtacatgacagtcttgcttttttttttctgaaggaagtttttggtttgttgatctttgtctacaaaacatagctaaatatgggacaaaggaactgtatttttccgacttttaagaattaaaatgacagatcaatgaaatcttgtgtgttttagctctgccaattagctaaacttgggtcatatctgaggcttactcgaggaaaacaccaagatagacattatgaacttggcagttggcacattgaacaaacagttcattttgtggcacgtgcatttattatctagcatattagatgagtttattagtttcaattaagacatcaattagaaagattggaggaatattatttctttggcaagcatcttcttcaatgttagcataagtacaacctctagttacaaagaaacaatgctgccctcaaacatttttgtgttagaccattcattttaactattctttttttgaaaccgatcattttaactattctctccgtcccaaaatttagcgactagtcctaggttgctatattttgggatggagggagtagaattttcttgacctttttgagagtccaaagcactcactaaactcagaatgtaccacattcaagccctggtgaagcacatgtgcaaatttccacactgaaacatgcacaaatatgtatccatgtgtgcttcttaaattggacaacatcaacacttgtagtacctagcagtcgggccatttcagaaagtagaaaattttattttgttttgtttgcctaaacgtagtaaataagaagcttgttgataaacgcaagattcatgtcctgtcctggctgattcactaaacagatagtagtatcttcaagaagcaactaaatatgtattcctgaaaaactaggtagaagggacaagatattgacataaatttgtggaggtaaatttaaaacattgcttgctacgcatgagtgatacctgcttataagcataagcaataatttgaattgaaaacttaattttcgagttgattttggtatattttcatcatactagtttattttacagcatttgcctttatatcactaagaacacatatataaaagttttacccataaattattttttaatcactaataaaccgtttcacttataataagtataagcgaaacgacgaggctgctaaattctacacaagtactgaatctaaactttctgaggatgttattctcttttgttgtttatctggtttggataatgccaggatacttcctgtgtttcctcatgattccttttgtaatttatcaacctacactacattttcctgctgtcaccaggtgactccttcaggagaactgttgatggtcctatgaggtcaacgttgacttttgataataatcattctgtagtgccaagtcaaaacattgattacggccagccaatggtaagatatgctaatggagccaacattagatctggcaaagtcagctcatcctattctttataagtaaccgtgcatctgattattttctgtatatttcacaggcttgcatttcatacccatacaacgattctggttcaggagtttgggcatcctacagttcacgctcggtggtatgttcttctaacaagttctctctcaattctctcaaggtcttcaaacttttgcagaggaagctaacaaactagtagtaacattttttttatcaacatatgtaattataagggtataattcatgcatccaggtcctgcttaggagatcccattatttatctatgatcagtccagcctgatttgatttagtctagaggcttaaaatatgtcacttttcccatttgtcgtaaagaaactgcctggttttgcataaaaatggattgagtcatcaacgtaacctcaacagggtagtatgtctgaagctctttatatagcacaaaaagattacctttgagcattattttaggttttgccaacctcacctgtaaatggtgtaggttgatgcattaaattaaactagtgagaagacataactaatgtctatttgagtaatgcagtcacatgcagttcataattcttaagaactagtactagatatacgtgagtttattcactagatcaatattattcagggagaacatgtagtagttatgcaaaccatgtgcacacacatctcttggggcatccagcttatttttatctatattttcatgggtcttgcctaatcagttgtacttaaaacagttccatcctcaaattgtgggaggaggcacatcgccaagagttcccttgccctccctggagatagcagatgatgggcccatatatgtcaatcccaaacaatatcatggaattcttcgcagaagacaactgcgtgctaagttagaggcccagaataagctcgtcaaaacccgaaaggttcttgccactgccaactgatccattgatgtttttaccttccattgccatctccttgtgcatcttgcattaaccttttaatattgttaaccactctgcttggcttaatattgtaaacaatctccatgtgcagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctgcttccaccttcactgtaacttctgcggcacagaaagacgacgccttcttcgaccgccatggccaccatctcagtagcttctccggccattttggccaggcaagcgcacaaggtggcgtcggcagcatgcataacgggtcacagcagagggttcctgctatgagatgagatgaagagcagcttgcaaatcatcatcatatatggtgtggtctggtccctccttaggcaattcatccttggcttaagtttcatggcttgtttaggacttcagagacgcttcatagtgctgtgcttttgcagcccataagtctgggcttaattgtgatgtgtaatatccatgtattggtgtgatgaagttgtccctgtttgaataaactctttgtctgttggttatacaatgtgttgcaaaactttacagtagtgttgtgcaatgtgcattaggacaaggtctgaaatgcccctcatttttgtgaatcacaaagggtaggatggaaaccggaaaattgtgtcaaaattaacatattggaaatctaggacatgtatatgttgtactaggtggtgttccaactaatttcagcttactatactgtatgatggagggagtagttatttgggacaaatttaaattctaagggcttactcggatcacaggattgtaaaaatataggaatagggaaatcatagtaatatgataggaatgtatgtgtaaaatagatgattgaaaaacacgggaattttatagatatgattggtaaacatgtgttatgtgttcggatagacattggaaaaacataggaaaataaaaaaataaggtaggagtgaatgcaaattttcttttgtttctctattgattccacaggaaaggaattttttcctccgatttttctttgggtcaattcgtgtgaaccgaacaacaggaaacaaaatatttcctacctacagtatttctttgaaaatcctataaaaatccctcgatccgaagaggctccaaaaaaagagctataatttgagacaggaaagtacgtttggtgtattccacaagaccacaactggcttgctgcctgcatgcgcatgaagaaaatatcgctgtctaattgcaagttattcggtgtcaatcctagaaataaaggcgattaaattccatgaatgaaaaatcacacgagttaaacccattccaaaaatcaataagcacagcacacacgctataaaagaaaaccaacattatgtaaaatcgtcaaaaaaaaattccggtaaaaaaaaacattatgtaaaatgaaacattcctctttttcttgattcatcattctcggtaaaatcagagatgaagaacagccacgtattagcgctgctcctcgcctctgtccttctggtgtcaatgtcatcctcaggtaacaatgtaacataggaacactcctctctatctcgctgcagtttgcattttgcaatgaatgttaggaaacgataggcgaacaaacgataaaaaacaatagatcaatcacaaaagacacgagatttaacgtggaaaaccctcccaaaacaggagagaaaaaaccacgggcaatccacgtgataacccacgtgagatcgtgggcattggctccgttcagatcaagactcatgatggcatgacacgcacgctaaaagatgtgagacacataccagggatagcgagaaatctcatctctctcagcacacttgatgcagaaggatacaaatactctggttcaggtggagttgtaaaggtatcgaaaggttctcttgtttacatgattggtgatatgaattctgcaaacttatatgtccttagaggaagtacattacatggttctgttaccgctgctgctgttactaaagatgaacctagtaagactaacctgtggcacatgcgtcttggacatatgagtgaacttggtatggcagaattgatgaagaggaacttgctggatggctgcactcagggtaacatgaagttctgtgagcactgtgtttttggtaagcataagagggtaaaattcaatacc

SEQ ID NO: 11706 - DNA, 4557 bp, Oryza sativa
atcagagcatgcagaatatatatatatatatatatacaacgaagaactagtataattaattaagttgttttcgggggagcatatatgtttctgttcccgagaagactcgatcaggttgtcatcgccgtaaccaatcacgtcttatcccttaatgccagcatgtacgtacggaaaacatagtaggatcagagtagttgctactccagctagctcatgtaaattctctcccggccgggcacgttcgagacaagatagtacacccaccccacagttcatacccaattcaaactcgcatctgtcgagctatagcttagctagctacctgcttcacaactcaggagttcaacatcatcatcgttagctcccttgaatgaatccccgtgacccggagaacgtgtcgtcgtccgaccgtttcagcgtcgatcgatccaacgacaaaagacgctgcggccggcggtggagccagcgcgctagctagctgcacgtactggagttacgtacgtacgcgcgcggcactgcaccgcggtcgacgacgtcgtacccgctccatccgtgcatgcacgagttgcgccccctccccccctactacccctgctccggctggtaggggacacccctcacatcaacccgcgcgccgcagcaaatccatccatccatccatgcaaatgttaggttcaccggccggctcgtttcgctacagatgcgcggattgcgccaccaccgcgagcgcctgatcgctctcgcgtgtcccgcgagatgttgggcttgtggctctcgcgtgagatgccggtgcgagccgtggagtacgtgggatttgcgtgtgagacgccgtaaattcacccgacccaccagcagtccaggcgtccagcacgttggatagggtgggggatgctttgcttattaagggaagaacatatgagcagtagtactgggcgggcgcgcttgctaattaattggtttttgcgcttgctcgtgctcgcatgtggccgcgaactaccgtgaattaatgtgtttggaatttcgacgtgatcgtcgcgagtcgttattcaaaatggagtactgcgtactagtaccagtgtgtaactgtagtgtgttcggttaggttcctgtacgtggaaccagctccagcaactggtgacctaagcttttctctagtttctttgtacttgttgctatttgcacggctgcctgcagttatactaccaagcactttaggtacggtacgtgcattgtagatgtcacttgtttgttactgcttcgtggagaagtgataccgatttcccaggagttaaaacttagcaaatcttgtacaaaaaagtgctctcgtttgaaaagaaaaaggtccatcaaaatagcatatactagatgccatatatacgattttctatcaatcagaaagatattagaaaaacgtaaaactatgtacagttacaggctacaacaatctgaatgtctatgtaaaaaaaggtgaaacaacctttctaatctactttcacaggtcacaacgaatacgaaataaccattgctcggacagggagtacagtacatcagcatccccattcaccggtctcgaaagctatctctacgcaatttatgagaacgacagcgcgcacagatcaaagtttgtacaccccgtccttgatttcagtacacaaaggcccggaattcaattcctttgccggaatccgtaggtggtaggaaaagccgtgcatggccgggaccccggcttgtagtactcgtacacagtagtcgtactctacatcagtagtagatcaggccgtttgctgaacatgcccatgacgcccattcaatgatacactggctgtagaggagtagctttttttttttctatctcaaacgacatgcacagcactctgagcatcatttaaacgtggtcccaaatgtaagcgctaccctctgcatgcatgcccgattcattcgtcacttgcttcatctgtttcattgcatcatgcatggcacacaaaaggcaacgacacatgcataacaagcacaaaaagacgcaaacgaagagaggatagggtccaagtgctttgcactagggtcttctatataattttagaaccgaatgtaggagaaagattttcatcatctaactatctaagggatatctcctcatttttttcatattatttatatagttaaaaaaataaaacaagatatatcaatatgagatatatcactctacatgtcaaactcaaattttacaagttgtaaaaaaacttatattaaagtttgaggcgcattttattattaaagttttattttggatcaatcttaaaccaatctctttttactttggactgaataattttgtcctttttttttgattcaccaactcttcaatataaaaacaaagcctatcaaagatatgaccagtgtatagatggggaagtttattggtgtgctagagccgatttacttgaggtttgtgtgtatggaacaagttgtttgtggtggtccaaactgtgataaaattatttggtttaaagtgaaactttagtagtaaaataatctcagttcagttttaagtttttgaattaaaactaaagacatgtccattgtactgcggataacacatgaaaaaatagttcataatttccaatgacaggttttatataataagagttttgaatatatactatctatgaccattataaggcaacccacctaatcagtggatatgtcccacgaaaaaatagttcacagtttccaacccacgatcgagtgagcaatggattttttttttgcgggagagagtgggaagtggatttggttgaataggtggggctagaagagtatttttcatattttgttagtcaattatctgttttctttacctcacttaatttgggaccaccgaacggacatccaatctaggggtaaatggattattcagttcagaaaagtgagggcaaatcgcaaagtctgaaaagtaagggtaaaatcacaattgcactaaaaaaacatgagtaagaacacaattgtctcttccttaattagaggagatataatagcatactacaagtcagctataaacacatatccagaagaaaaaaaatagagagatatgactagcgggctacagatttgtagtcacctgcagcacagactctatgacgcaatgtgtgtatgacaggtggtaccaactattaatagcgtagttatttatatgtaactattgtatgaattggctattaaattgattatagatgatttgaaactggtagttggctatactattaaactttaaaattgctcttaatctcaaatgaaatttatgacgcgcgaagttgcactccgttctttattcagtgtctgccttgtacatgttcctgctccatgtttgtaggatctgaaaatcaaactgcctgattaaattctgcatctgacgttgtaagatgggaaatgtttacacacagttaaaatacagacaacgtacatggatgctatatatgctacgacacaccaattcaccactatgcatgcaagcaacagcatcgtcccttgtccctagcttatctggaaaaattaattcaataagaacttcgtagcccgagtcccgatcgatcgactactatcgcacagcgcacaatatttgccagtgccggcatgagagcgacaccttagctaatgcatatgcaagcttcctcttccgagaacatggccctggtccaacaataatgtgaaagtactgcatctgttgatgcatggttaggtgcttgatgtggcttgtgtcttggcgtaatcctgagtttagttgccttcattaacgccaaaaaatctactcgatcgatctcactgattggataccatccccctgcatgatgcacggacagtcggcggaggtcactgctgttgagatggttctagcccaaccacaccacccatggggacaacatctcatatcgatctaatcagatcattaccacttcgtcattggtcacacccacacacatatattcccctgtagccgacgttgatatgacagtctaggaacatacaaaccctgatcctttcatcaccagtactaaccagctggtgtaccctctctcgtcacgttcccacttttcccaaagatgggagagaattgagaaaagagagaaaagaaaggaaaagaacaactagcttgatctgtcaatcagatggatctatcaaaccttttttcttaaagagagcacgaatttaggacgcaaaccatgtatatttcagtcttgtctttcttggatctgcagctcgcagccgtcgccgtcgtcgcgtttgcatgatcgagccgtggtacgcggtgccgcgcatgtgtggcgcttcgcgggcctctcggactacaccgcgcgcgccgccgggggcgtacgtcgtcgtcgtcgatggcgagtaaacgtcagagagagatacggaaaacgaacgcacgctgctctcgtcggtttcaccgtctcgttggctcgtcgtgaggcatacgttgcgttgttgttttttattttccccggcttgaaagcacagcgcttgcagagggggaggcgagctagggagtcgatgggccgg

SEQ ID NO: 11707 - DNA, 5848 bp, Oryza sativa
caaaaggtgaggaataatgagagatcgctgtcccgggaaggcaaatcacatcaggattgcagcagctgagggcaaccagaatggagcctttcagggcttaagctcaaagtttttttccttctttctcagatatatgcatgcatgtgtgcctgtttgtggcaaagcctgtgtcgggtctgtgctgttcacaccactggctggctgaatcttcaggagaaaaaaaaataaaaaaggtgcacatcttgtgttacttttatctcgcaacaacttgatgataattctgctctgatttgattcgggcctaactcgccagacacgctggcccacctgtcagtgatctagcacgtggtttgcagctgcaacgcgtaggacacaataacacaaatccctctctctgactgcccccaaacatgccattagagcacctcgctggaattcagagctagtaggatatggttgttggtgatgcctgtcagcgatcgagcttaattagtccaacgctggcacaccactgcttcctgaatggagcagcgaagtactccaagaagcatcacgagggagtagggacggccggggttttggcaactgggcatgcaccccagtttcccgggcgcgacaggcaacggctgtacgcacagcgaagcctgctgctgcaaggccgatctagctactcactacacaactgaccgtggccaatggatccatcgttaatgccgaattagatgtcggttctttgtcctgccgtggacgattgcaccgtacgttccctgtgcttctgctgtttttaacctttgccgagttgtaaaaaaaatccgtggtttgtacacgtgtcgtgaactgcaactgagaaagaacacaaacaaaggcccaagccaatgaagcaaggcccacttgatgcaagcccagattagcccacatcctgaagcccaatcataaccactgcctaaaaaaagctcaaacctatccgtatcagtatcatgattcatgagtacttctctaagaaaaatcagtatcatgagtatggtattgattgtcaatatttttggggccataactcaagaaacataactgaacttttgcaccatcattatatcatgctaagaaaagaatttgctgatacaccatcatcgtcacatcgatcgctgccatgtccatggaagcaaatgagtacacatatcatttctacatcacaaatatagcccagctagttctttgatccagtcgcggttggtgccgaggcagacggacagtactcgcagtcacaaccaactggaccgaagcaggtgccggtgcccttgtacatcctggagcagtccgcgttgcatttggcggcgctgcatgccttgcccggattcaggataactgaactacagttcggggttaaggcagatatgtctgcagatctcgccaccatcactgcagatacaagcgatagatttcttgcttaggagttgcgtgatctatgtttgcgaaatcaacggcgagagaaggtgcttaattacctgatgatagagacatgagggcaatggcgaccagcagcaactgaacagtcctcatcctttgtttggtgttggtgtcgaaagctagaattggaagactgatgagtgattttttcgcgaacgcactgatgagtgatgagatgagatgcgttgttgatctatatggcaaatgccatgattttatagtggatccatggggatgctctatttttagaatcacttccaagaaagacaacagattaatatggattacattacaatcaataggcttatatatgaattataatgcttctaaatacaaatcatctatttttggtagctttgatggctgtgattatatactactaattcccaacaatggatagggttatccggttcatatatgtgtcttgcattaatttttgcccatacctaaacgaggctagtaccggagagactacatgcaagaaccttcaaaaggcctaacttgtcataggcataggatggcagaatacaattcagaccatgccttgtccagagtcgggccaagctggttaactcatgctggagtcgtccggctttggaatcttgagaaagatgtcggtcctgtttggactttggagctggttaactatggataatcgtgggagctataattttagaagaaactgtagctgttaaaagctacagggaatgccactgcttctgctgaaagaaagtggcaagagtgaagtatcctaatttcccaccggttgcttgagcattcgtcactggaaaatgccatgcgccaattcactattcccttcattccaaaatataagttataaccacccttaatccaaagaccaagaaataattattatcatcttgtagtttggaacattctaataaatataatgcatgcatctaatagaattatataaggatttaaaatagtaataatttaatagagaaaatgtcataattaattgcatgcttgcatgcatgacttatattatagaacatctaagaaaagtggttgtgccttatattatggaatggagggagtatagtttctaatgtgctaaaaagacaactcaaaccattatttttatataaccttgagccaccttagcaggatttaaggttaaacaaatttttttgcttaatcaaaagtgtgcaccttcacaaaatatattttgcaatatatactgcagagcaagataccgcaatacgaggatcacaaatggattaattccatgctactgcttgatctctgctttgccacctacgatctcaaatctcaaattacgtttttgtacatctccatgcgcctgagctcagattcaacccaactcttcttgaagcccccctcaattctcaccaaagttgcgtggaggctctcgggcatggtggcgagctgctcatcggtgaagcgatcgaggaaccggtatcggtccggcatctcggtaatctgcctgactcgcaaaaagggctgcggcacgaggggcatcctgtcgccatagcccctcgccgccacagcggcctcatggcgctggcgcaccacggcgccgtcgctcgtcactgtggcctccaccttgagtcgcttgttcgcgcacgccgcctcgccctcgccgtcgctcgtcactgtatcctcccccttggggcgcttgttcacgctcacgcacgcctcctcctcctcctcgaggaggcttatccacggatctggggtcatccacgccatcgctctctattggaacttggaaggcgaaacctattagtaccagatttaattgcgaaagcaatctgtagatttgggtgaaaggggaacggaggacacggacatataaagtccggcccaacccaacctctatcgggtcggattctgtctcgcaggctgagctcggaacagcggccatcaatgattaggccggccgcaggccgatgataattttgacagccctaacctaatatcctttatgcacggccatgctgactgttcatgtgcttgactaattttgacagccttcctcgggagaattaattctgcttcactctacgtaattttaatttgagcaaaggtagcatgatgtaccaaattttacactagatttttagtacctcgtggtatctcctcaaaaaccatagaattgctcttttaatttaggttacatagttacatcattgataaaataggaattaagattgcaacgaagatgcggcataccgatgtggcattttcattggttttttttattaaaaaacacagtacaaacataaggctggattggatcggtatatctaaggttgacaaagtcaccatgaatgcatcgtctaccactgaaaaataattagatataaatgcgagcattgaattggatcggtatattttgagattgacgaagtctacataaacgtctcgtctaccactgataaaataattagccataaatgcaagggtaaattgattctatcacaagcaacctaatcagttgaactaagttcacttcgcacattttcgttgaatctagagactaatattgagctatatgataaattttgaagatttttttataatataaaatgttaggaactaaattgaggaccatattaactaaattcactctaaaagaaaatctgcaaaaacaaagcaactgaactctctcgtggccaacgctgtaatgaagcacatgagaccccccccccccccacacaccaaaaaaaaaacagagagaggttcacacagcgttctatttagcgctgctgaaaataggacaatcccatataaatagtctctttatttaatcatcaacatctctccaggcatcacaaaatttaacaatcgcacgcgtcacactgtatgtaaaatttaagcctgatcgacgcgtgagtgatgatcggcccctgtgcacacagtactgcacatcgtcgtcgatcgaccaccgatcgatcggccggccggccgggttattagttgctcgccggcgccggggaagcgcaggtgtagacgcacttgcactgcgtgccgatgcactggcccacgccgcctttgtactgccgcgggcaattggtcgcgcactcgccgctgtcgcacgacggggcgcccgggttcaacaccgccgagcaggtgtcctggaagtacttgggccccgctatcttggccgccatcacgcctgccatttcgttcaatttttttgaattttgaagcgatttcgttcaaggttcaaaccaagctgatcacaagccagagagagagagagagagagagagagagagagagagagagagagagagagagagtagtagctccgagtgttgtgtactacctgatgaagatgatgcgacgaggaccatggccagttggaggagcagtgctgcgtggaaggccttcatctctgactctgacgccattggcttttttttttccttgtgacttctgctactgctaccggtgctcagctgcagctttgtttcttttaggtgtaccgaatgggaagtgtggcgtttatagtgttgttgttcgtattatttttggaatcacttactacagtaagttgtatggatatggataacgggaacgggtttaatttcaggagtaattggcattgatactgctatattcgtttgtgctgatctttaggattatatagtggccttgtattaagggttgtaccaaattggtacctaatcgatagtaccaattaaaggtgatatttcggtgcattttaatttgtcaattttcacgagaaaaaaaaagcgcatatgctccgtatggcatggaaaatgtttagatgggtcatagtcaatccaaagcatatgttaaagatgttatagcccataatgcaagtagccagaacccaacagtcatagagaggtaatttctagccttaccaaataacgaagtgagattagggcgagaggtcaatcttgtactacgtactgattggaacgaggggaccgcaacaccaagctcaagccatgagctcctagacacgctgccccaacccgcaccctcatctcgcagctgcgccatgctccggggtgttgcgtcctttcttgtagaagagtcatgtctccttgcataaggacacaaggcgttgcttgtttggcctgattcctacaaggagtgccggggtacgtgacacgatggagcattggccatggactaattcaccaaatggataataataaaggaattgctacacttcagtcaacaaaaaacctacctctaaatcttgcaaattttagttcactggatgtgtttcgcaattcgtgctccagctgcttcttctccaactccgacgaactcctcttcttttccggtgccggcgacaacccaaactccggcgaagaattagggtcctggggtggggtggggtgggaagggtggg

SEQ ID NO: 11708 - DNA, 3160 bp, Oryza sativa
gaggggaagcacgagggggaggaggctggccgaggggcctcgccggcgccgttgacgccctctggccagccggcgaggcgggcagcggcgcggtagggcggtggcggctgggaatcgcgtgcgagagacaggagtagcggtggcggcgcgatctggatgggggaggaggagaggagttagggttaaggggtctgcacgaatcttgaagcatatccaatgatctaaaatttgaaagataggaggtgggattttctgtcaacatatgtgtagatgcactcttataaaagacaataaacatcacctgatctatgattccttcaaaaaaaaaacttacttgaatgtaacagtcgacacttgacaccactctcataaacttgcttcattgagcagttggctcaaatgacgttctgacgttgataggcatgtgattgtttcattctcaattaagttgaatcaaataggccctttttccctttttgagtcaaacattcttagaaaaaccttccgcatgctttaatatcttgttggctaagtcgagcttctaatgagacatgcatacaattgtattactttgtttttttaatataagacatagttgtcattcacatgctccatggctcttggattgtcacggagtcgtcctagagctcgggtgagaaggagtgggtaactcacccaccacggtggcgacgagtttcccctgacagcggtggaggtgacctcggacgataaaactccagcagaggacctaggttttatagttttagggttagaagttggtgccatggtggagcagggtaggggttttggagggtggctttagagggatggatggggtggtggaaacatcttagtgggtgcagagacaggtaggtgacttgggtgctgcttgagccgtgaggatggaaggtgacggttggcggaggggatggatttagtggcgctagccgtcggagatgagaaaggaccgggacattgctggaatgggagaaaaaaaatcaaacaagagaggggtagaagggaggagttgaattgcatgcttggaaggggcatgccagagccattggcggcttccggtgccgacaaggctgagcggtggcgcactgggatgggtagtcagcagcgcagggtggggatgtagtgaaatcgtattgtgaaatcccttctttttcgtgcacgagaaattccgaatcattgaataagttgttatttttcttggttggtgtgattgtgtcatcttttcatgtacctttgtttatttctgtcgtgtttgagtttcaagccaaaaactttgtaataagtggatttagctttagttgaagcaaaggtcaagtttaatattaattattaaaaaaaggtatgttactatgaaaatataattattgtagccaatacttaggaggtcaaatggccttccacttgaggggtgaaacgactagctttcccatgcaaaccgatgtataccatgagaacgggaaccctttctttcatttatttgttcatcaaacgcctctccgagcataacaatactgacaacgcgcgggtcaccctgtactaaaacacaggagtaaatatattaatcctgattcaacactctgtaagtaagtacggacacgcgccgccgtgctttcccatcgtcgaccaaccggttagtttctcgccgtcgccggtggcggcggcggcggcaggaaggcgcaggagtagtcgcacttgcacttgttgccgacgcactggccaatgccgcccctgtactgccgctggcagttcgccacgcacaagccgctgtcgcacgtcgggtattcccggttgatcacctccgtgcaggtttccagctgcgccgtcacgccacctgccatttcgttcaacccaaccatgcagctgatcacaagctagcctcgatcaccaaaaaaaaccagagatggatacaagctagcgccaagtattgcgtacctggtggtgatgatgatgaagcgacgaggacgatggccaggatgagcagtgctgcgtggatggccttcatctctgacgctgttgatttttttttttcacttgtgctgatcgatgctactgctaacggtgctagctttgtttggtggttatagtgttgtttgcagttttatttttggaatcacttactcaaataggatatggatagcaggaattaatcgcggtgtaatcccaggagtaattagcattgatatggtatattcgtttgcgctgatctttttaaagggttgtatagtagtatcaactaatggtgatgtatcggtgcttatcgtcaattttcacaaggaatggaaagcgcatgtaccgcgtgacatggagaacgtttggaatataaatcatcgaagagataagtagtaggagtaaaggctgcgctcgttctgcctgtcaaccgaaatttgcggtggcagtcaaaaacaagataagtcactcatgtatgattaatccgatattaattgttataaactttaaaaataaatttgttttttataaaaacttttatataaagacttttgcacgaaatacactatttcgtggttgttaacgaccaaatttggtaatatcaacatcggaggtgaagatgggatcgagatcggctacgactagaatcggctaaatctgaatcagactgggttaggtgatatagccgattccagcaatatgactcgtatccaacattgggtttgagttgatatgcttcaagatgattgctgcacgtgcatagagtcctgaaaaggcaattgtatctattaattaggatgttttatgtaatttccttagagatatgcttagggcaaaagtctgccgcaaagacttatggtatcttagagtttgttagagataatagtcgtgtccgatatggacatatcttgtaattctcgggtataaatagaccctgagccctatgtaaaaaagacacacacgttcaatacaatttcggcgcatcgccatctttttgctttagttttatttcgacgagttcttgctttcgggttgagctgcatcggtttcgatcttcaacaagaggtaaaacttgttatgacggcttgtgttctcgggattagtgcttccatctttatgatactctaatcttgtttacgtaattcgtcgagttatcatatatcatacataatctctggcaatatcgctatctaac

SEQ ID NO: 11709 - DNA, 3135 bp, Oryza sativa
gacccagatgatattcaaatccaaatttagggaccgaggtggcacaactgaacaagttggaggacctaaacgagtgatctataagtttagggatcgggatgacatagtcgaataagtttgaggacatgaacggtcgatttacgagtttagggaccaggatgacacagcggtacaagtttagggaccggtgatggactttactcttttatatatattgccccccaacactactgcacgcacagaccggagtcctaagggaatgacagtccaaccgaaaaccaccttatcccattggacggctcaggccaaaccgccatagcatatggatccggatcgtttacagtctgttcgtgtgaagggcagtgaattaatgccatgaacagtgatgctttactataactatagggtcgaaaatactgtagcgcatgacttgatccttccgttctcgatcggacggtttacagtatccctaatacgcagtactactcatcctctgcgttagtacccctctaatgcagaagatatatgaattccatagcatggcccaggtgcctgtgcaggttcattgctgcgtggaaagattggtaagattaaacacgaacaacttaaattaaaaacagtccatctgaatggagcggtaactctttgaaagaaagaaatgattcttattcatcaatcattatatatatatacaggcaaaacaaagcaaccagtagcatcatatagttcttcaaaacctgatcacatcacatgtctatgtgagacgatcagaagaagaagaagacacgaagttctaacaagcaaagcttgatgtgcagtagcacatggacatgtataaacgtcatttccatatcatatcagttcgctgggaggcgggggcgacgccttgggcggattaaagccgcagccaaaggcgcaactgcatgtgttctcgtcgaggcaggtgcctatcccgtccgagtacgagcgaatgcattccgagaagcaccgttggcacggcactttcagtatcttccgcccaatgcactcgtccgtattcacgccacctgcacaaatggaggatcaagcggctctcgctcagggctctgcccaacaatttccaataacttttttttttgcgatgaacaattctgagaaaaaaaaactatatacagagaaaaacatacacacgtgtgtgtatacttggtgtagagatgatcaaattaaagcgtcttaaaaaatagtactacctccgtttttaaaagggactttactttgttagatgaatatggataaatattcggggaataaattcttttttagacgcaggtaacatatatgtacgagactacctgaatctgaaggtgttgcttccgccgcaagaacgacagcaagagcaaagagcagtgctagtagttggctagtcttcatctccagcaaacgttggccgagcgttggatcagtagttgctatcctgaattttgcttgtgtctgatggtgctctacctccggtagtactatatacagtgtgtgtaatggaggtgttttatactgatgttgtgtttaccatatcggaatgttattatttttcatgggataagatataccatcaatactttgattctaataaagatctaaaacatatgtttatgccaaaataaggcatgctattttacaccttatttatttttggacataaggcgtgtgctacctcttaatttatgattaggatatcactttgtgatacttcacggaaatcttacctcgtcatatttccacttcatctaaccttacatcgaaattcatattgagttaacggatatcgtcaaaacaagacaatggtactgctgaaaccgaactttaacttgagtcttggaccttgtaatagttaagcctcatctcaagtgtgaacctttctccacccccacgaccagagctcgtccctagctctattttcctctaaaattattgggctttatttaccaagtgtcatttatcttgtctcagatactcaatcatttagtccgcgattataaatttagaggctccaataattggtgtgttgatttgcagggtcaattaagtctatcacttcgatcacaactattttaagaagcatgtggtgattagttagctggtgataatacaaaaagatgagcttcccaacttttaccttctagtttattttctgaattttataatacatactctcataatctgaataaaatcttggactgttgagagaattagagattctgaaagaagccacacctattataagacaaccccaaatagggcccatatactagtatatctgccatcaagatcaaggatattccaatggaggaagaatggtgatgtggtatgcatctttaaatccatagaagatggtcaattgttatatatgtttcttacactcaataacttatcatgctcaaggattttataaagagaaattttatggttcttgaaaaagtacttcgaggcatctaaattttacactaaattttatgtgcctcgaggtatcaaattttatactagaaaatatggcaactccggtacttttttaaggataaaaaaattacccttttataaaactaaggtccgcacatcaagtatgttccttaggttacttttgaatttacataccgtcatttttactttttctgtaatatcttagaagtttacgaattttaaaattttaataagtttttttttgtttctcaagtattgcctgtgtaacatcatttaatttgatgaatttaaggtaatctagttaatcttttttttttcgcgtcaatcgcttttcatggtctgtctgatcctttttctttttctttgaaaactcagtccgatccattcatcttcggtgttagtgctgaagaaaatgacaatcctaccactaccaagtttaattgcaggacatggtggtttgtccacgaaaccacacgatcgattgtttctttcatgtgcgagtccagatcataactttaaacctttcatgctacttcagagttcaaaaccctctttcaaataaacttcagagttcatcagaatcctctctcagtgacaaaaaaaaatcagagttcagaagcagtaagaacagaaaatgaaaacttcagcgttcgatctcccattcctggctggattcatgcg

SEQ ID NO: 11710 - DNA, 1537 bp, Oryza sativa
caccttgagacaaattccttcttgtagcatgaatcaatccttcaccctgaacacaacaaagacaaaaaagacactttcggcgccaaatagcctctcgggctaaaccactataccaactaagcttgagcaaaactcaaacttagcaacaggaacaggctttgtcattatatcagcaggattatcatgagtacttatcttgcatacctttagcttaccttgcacgactacatcgcgaacataatggtacttgatatcaatgtgctttgtcctctcatgaaacatctgatctttggtgaggcatatagcactttgactgtcacaaaacaagttaatgcaagaatcaactccacaaagctcagcaaacaatcccttcagccaactgattctttacatgcttcagcaatagccatgtattctgcttcagtggtagactgggcaacaacaggctgcaatgttgccttccaactcacagcacaactaccaatggtaaacacataacctgtgagtgaccttctcttatccaaatctacagcaaaatcagaatccacatatccaacaagccccttatcagtcctgccaaacttcaagcaagcatcagctgtgcctctgaggtacctgaaaatccactgaacagctttccagtgttctttaccaggattagccatgtatctactaaccaaactcatagcatgagataaatctggccgggagcaaaccatggcatacatcaaagaaccaacagcactagaatatggaactctagacatgtattctacatcctcatcagtactagcacattgtaaagctgataatttaaaatgaggtgtaataggagtgctaacaggctttgcatcatgcatgttaaaacgctgaagaaccttcttaatgtagctttgctgactaagaaataacaaaccagaatttctgtctctagtgatttccatacctagaattttcttagcagcaccaagatccttcatatcaaactcactactcaactgtttcttcaatgtagtgatttgttccttgctcttggcagcaatcagcatatcatcaatatataacagcaagtatataggtgatccattaacaaatttaatatacacacagctgtcaaattcagacctcttaaagccatgtgacaacataaatgaatcaaaccttttataccattgacgaggagactgtttcaaaccatacaaagatcttttcaacttgcaaacataatcctccttaccaggtactatgaacccttctggctggtccatgtatatctcctcctcaagctctccatgtaaaaatgttgtcttcacatctaactgctcaagctcaagatcatacatagcaacaatactgaagaatgtgcgaattgaactatgctttacaactggagagaacacatcattataatcaacaccagcaatttgactgaaacattttgctactaaccttgccttaaacctcggaggctcgctaggagataaaccctcctttctcttgaagatccatttacaacgaacaggcttcttctgttttg

SEQ ID NO: 11711 - DNA, 12037 bp, Oryza sativa
  unsure (1)..(12037): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgttttggttcatgagcttggtgacttcttccgacaacgctttcaattcaactcccgcagccgaagccaagcctttcgcgtacgtgctttcctctagtagcttctggttgcgagtctctagttgagcttttacttcaatcagctcacacaccttctgcttcagctcatcaatctcaactgactgaaggacaccccccaaaagaagtaagttaaatgtgcaaaccaaccaagtcatagagaggcagcaccataatgaagagcaagattgcttagaacctcaaatggtacaagcagagatcattttgagtcatatggtgtaaaaataagaagctgcaataaatgtttttgaaatctacagtatgcaaagattatgagatagtgcttgcgtggaagtgcatgatcaatgatttgggataactgcctattggaacagatcagtttaaactgaaaatctgatcctcgctccataacacagggtcaactggccaagataaactttttgatcatactaaaacaatgttttcttcgatgtctgtgttgctgtggggaaatagaagtgtgcatagttgtgagggatacagtgacaatttggtgttaataagctattatatggcaagcagacatagattaactgaggaacttaaattttgaaggaggttctaagtggtctaggttctgatctgttggcccagttatgaaatgaaaggaaggcaaaagaaagaagatagaattaaacctgtggttcttttggcgacgtttcaccagggacctctctaggaactgatagttcttgatcagcatgattatcagtttcatggttaattcctgcattcttctgcatcataatgctatttgacagtgaatccttagcttgaagagtttggtaaagttgctctttcaggtgagcaacctcctcttgtaattccatgcattcagttgtctggcaacaaaagaaattcagagaagcaatacgaactgatttcagttatccaccattcaactttcagcaaaaaaaacaaattgattttctagcacatctaaccttttcattaagttggtcttgtattactctgttatctgctgccttcacctgcaataaaaaaaggggaaaatgaagcttcacagactaaacttgttgtgcgcattcacatgatagaaacaaatgcgctgttctgttcataacaaaccacacaaagctgtatctaattatgcacatgtatagcgaagggacaagaccaatcctgatctgaatttaaaccatcctaagtttgtgaggggagtaacaatttgtttgttcaccatatgttccatgacaatagagtaatattgcacaacaaagggaatactatggatgaaaaaactattacatacaattcgaatattatacagtcaataaaactaattgaaagttgtatattatctagcatagcacaataatctgctaccaaaaattggtgtgctagattcagttgcaataactttggaaggaatcaaggaactagttttaaaaattgggtattggctgataaaaggtttgcggcgatgactcctgttgcatgcaacgtagtggtgataattgagcttgaaacttgataatactggctgtgcatcataaatacctcataggaagtttacagttgataaaattcatatatataagtttctcttctctttttggttcatgactttttaataaacccttgtacaatacacatgaaagactgcaaagtgcacaaactttttcagtacctcgagatcaaaggatttctcgttgagttgctcaagcagttcagcataagactgaaaaaccaataataaaaccatcaaattgtttaatagaatacttggaacaaaacaacatgaactgaagcgaatgcaggatgttaccggagtaagttctaacttgtcagccatcccttgattatttgagatggaatgaggtatctgcctttctaaagacgctatctgatgcttctttcccttaatttcatcattaaccttcttcatttccatcttcatatgtaaagaagatagagtttcaaggtgaaaagcttttagcaacatacgaaactgaatatcaggtaaggtatagagtacctgaatcttctcattatttgggctccttccagcttcctcggtaaggcgctttaggacacttgtatgaagtgcaacctcccctgacaaaatcttcaattgctctctcagtaagtcaacgtgatctattgtttttctgctggcctgtcaacatatcacgtatcaaaatatgccaaaaagaagtccatagtaagacatcatgctgtttatattacatcactaggatttgcaactatattaatcttctacctgtgtctataaagaagtccacactagtaaatatttgagcggtttagttgtcttggtaatgctaaaaatgtatcatgtaccccacaccatgtgccatccatgtatagcacttcaaaatttaaattatgctcttagttaatacacgttagccaacaaaatatactacaacaaacaaacttcagctgttggctatgagttcaaaaataacacattataaaccagtaagccaatcatgactcattagtcgatcaaagattgtttaaaagtggattgctggtttaaaactttaactaagtcatccttttctgctttagatgtatttgtttagctgatatttcacatccgacaaatttcggcctttaattaccaacaatgcatgttacctaccagaggtgtttcttctccatgaaggctgtcagtagcgaactccccatggccaatgctaaagagatcaaccgatgcactctcaccaaccaaagaatttgatattcttggttcggaaggaaaattaacactctccccaataggtgttgaaggagcagttgatttagtcaaactggacttgtcaccttctgaacttgtcagaatagaagctccaccttcacgtttctggacaatagaaccatgggaaaatgttcgtgtgaatcaattattatttcaattttaaaatcaggattggtgcacatgagttcatctatattgtaacaattcatgacgattgcacttgcatctatgtaaaagataaatcaaaagaattgaataaatggactattaagaattgcccaatttaactatacccgaagtttaaaccaattaagaattcctttccgattctttttctcctccttcgaatcttcaagtgtcatgccaagtccttcaacaggagaaagtaattcattgctttcattatccaacacgatatcacgtcttttgtaaggtaggtacgcaagctgcaatttgaacaagcaaactttatcatacaggaagttacccatactaactataatgaggaaaaaaataaagtagtaactcaaattttctgcaaacacactaaaacagagtctgccgatttattgccaaaagtatctcagtaacaaaagcaaactacattatcgaaaaaacaaaagcaaactaaggtcaaagtgtaacatgtgtttgacatcataaccatacctcctcttccccaaaagaatgtcttcttcttggtccaggatgtggagaaaatctagaagtttgtgtcgccttagtggagaccaagataagctttgtgagacgctgtatccttgcaagcaaagcagctttagcttcctcctcttgttcgagcctagactgcagcttgacgttaccatcttctagcttttcatatgataaacaaactccagttaggatgatacattcatacaccggcaaagtgaacatgcaacattatataacttgtaagtataatattattaatctacagcacagttcaagcagacaggagtagctgaagacaaatctgtaaacaactcagttaatagcatagcagatctcgcatacatacagttaagcataatgtgagcagcaaaggggcaattgctataagacaataaatattccaccttttgtttccaaaggatgatattatcttctccggcatccttcactggagtgccagtaataatacccattttcagctgttctagttcttcctttaatctgcgaatctcattctggtatttctttattaaagatttttcatctataatctgcccaacataaagaaagattcaggagaatatgtcagaaatacttcatatgatatttggcacaaaaataatggttaagaattcctgctaacataacctactttgttttgtgatgcttggacctcaatgcgttttgcacggtgggcaaatttcagtgtattatgagtctcttctgagttgctcgatgctggagtcactgtacagatcagctgcaaagtataatagaatgaagttgtcagacatccaaatcacattgaatattaaaagaaatacattagctttaaccaccatcccaactgataatgaacaacttactgaaacacgtccttgaccactcaaggatgactgaagtagacgtgttagttttgaatcacgaaatggaatatgtgtagcttttccgtcagtaagtttcgatatcacctggaatacaaaagggaaaaaagcttcttaacttccaacctatgatgataacctctataacagatttcatggatcatgacttgcggcattattttatatgtaaattgaattcatttaactggataataaatgcaaacatatcaacagaaagtcaagcagtgcaacagaacacattggaacttggaacatattatgtcgaatgaatagcaaaacagatacaaccacccattatgccaggatgcaaagatcttctgatgtacagccaatgactggacagtaatcatgagacttacagttccaagtgttagcaagcttttattgatataagatccttctttccggcgtactccagtagtttctgcccttgagctctcggaacctgccagatcgatgaggttctgcaaatgagtgagacaactaaataatcaatacatgattttggcagtatggtcaagagataactgaaaacctaaaacccaccagttgtgagaaggtaactgcctcgccttcattagactcaccacaagggctgctctctacagtctgtcagataacaaaacgaaatgaaaagggagaaggaccatatcctgatatctaatgttcttccactagtgagaagtatattttgcatgcaatttataatcttgcaatacagcagtgcaaaggaaatatcaatgtttcgaagttatataaagatatctaaaaggattaccagtgtgaaaattgtatgacttctgctactaagtagattgaagttagtggatccaacatgtctatgctctgcaaaggaaatatgaaggatctccattagtgaaagaaaactttaaaccatgatcatttttattactcacgatcctgataggttgcttctgcaaataactaaatgttaatcatgctaaaaatgaatggcacagctggaatagtgaacaagttgaaagattctaaaagatggtaatcacaagaagaccttctccagcagcaatgagggatagggcatgtgcaggagataatactacttcttctttgataccctcaacaaatgttccctgaaaaagtaaatgtagatgaaggaactatcagtcaactgtataaaaatgatgctttaaattcattcaaaattctataaagtttaagaatgaacttcaaagcatgctactatatggggtatgaagtatcaaaagatacatttcccacacaggggaacaaatgaacaatgcatggcaccattgtctctaatgactaagcacatgcatgacaatgtttacacttaactttacactgtttttttactctacacatttgaagaacaagacatagccatattaagtgaaaatgcacatgttacctgaggatcctctctaattcgtaagttctgtccagctggattgagcagatcattgacaacctagattcaacgaacccttaattagagcagcacaaaacatgaatatgtgaacgatgcaatgatacaaatatgattgcaatgacaaacctcattgtaaatttccaagtatgatacacggagaagaaactcgcgatttggtgtctacaatggtcagacagtgacataagtgtacagtgcataattgcatgttagtttatttgtatatacatgatgggtccatgtttaaaattacctcttgtataatgctaaatgcgtctttgacagccaaaggtatgatccctggggatctttgatctccctggcccaaaagaacatgtgcatcaagatatagatgaacatttgaaatataaaggaaccaacctatattgcacaatataagcctagccacatataaaaacgaaaagtaaacttcaacatgagtaaattgcaaataatatgctgcagatgggaaatggaagctgcctatctctgtgaatggtaaccacaatacatttaaaaaattacatggtgataatatcatattatcagtagcatttaacatgtgacactttgattccctgtcttatttgctggacttgggacttagagagggtcagataaggctgagtttttattagaaaagaggaacacataaccaacaagcagttataataacttgactgcttcgttttttttttcctggatgcacaatatggttatactctgaagccagtaaaatctatgattaaaagattaatagaaacatgaagctgtaagtgttctcacatgcattgtgtgggtcttcccgctgcttgtaacaccatatgcaaatattgtacctgtggcaataaaaaacagaaacatttatacatcaatctttgcttgaaaccaaaaaaaaaaaagaatccaccaccacattctatcaatgaatggtgtgcaacaataaatagcttatgaaccaaaccgcatatatctgtatcgctataatgtttagaagatatctcatagccatagtatcatggcattctgtaaatacaacccaagcctttcttttcttgaaaagttagcttgaaacagtaaacaagctgttatcatggccctatataaggatagtaaagatcaattaccatttactccctccatggcaccgctgacaacatgttgagcagcaacatcatatacctgacgggttgtagtagttggtgcaaaaacccgatctgaacagcatactatattagtctctgatcaagtaaatttgaagggggataaaacaatatactgatagccttagaatagccccttaaataatattctctcttttcatgagatggcatacatactcgcttgactagctcattttatagaagaatatattgtttttcattcataggctagtatatggaaacaaggtatgcagaaactcttttattccaaacaacaattttggtgccttaaccagaaaatgtcaacaactgattcccaaaaatggagagtattgtgcaaagttatatatgttaaagtaaactattgaagtccttcacgcatctgtacatgtgtcgattcacatttttataagaaaaattatgaataagactccgttccattaacatgacatactgccagtgcaaaacctcttataattagcacaactctagcaagtccaacagtgatgagccattgaagtacaaactcaatattcgtttgtacatgaatagaacaagttatattaccatgttaacacttgtttttacaaatagcctgtatggagccacagaatacaaatcagcgtacagattatgtgttagtacaggaacagcaggtctgcaaacataatttactcccaagtgtcccagtacaccagttggcaaaactactatattgaaatgagaaataaatataattgatgaagtgatattgagaatcccaacaagtaaaccgaacacttagcagaattgagcataatcttttaggcctttctttctattgcactgctaagaacagctgtaggtccaagtcgcaatacagatttgagaagcatttccgggacactaatttgagtgatacaatcaaactggcacgagataatttcaggcatccaaggtacccacaaaaaaacaaggaagtatcacgttcacagaactccttctagaatctagatataggctagaggactcacaccaatctcacctaatactccagccttatgagaacagcgatcgtttggacagaactcaactaaattcgcatatgccaaacgaggtgatgatcagaattcagccagcagagcgccaatgtcaatgccaccaaaagcaggcacgtaccgtaagcataagcaacgctgggattctgctcgctcctcacgaccgtgtcgccgtccgcataccatgccacctcctccccttgccgaatctcgcgggggcttcacaagcgaaaaccaaaacccaaatcaaactgcattcccccaaaatccaagcgcgaccaaacgaaacaccaccaccaccataagcaaagcgagacgaacctcagcggccggaaacggacggtgacggtgacattctccttgggcgccgggtcctcgtcaagcccggcgaacagcggcgacgcgggcccgtcgagcgagagctccggcgtgagccgcgacgaggacgtggtggtggtcgtcgtcgacgtcggcgaccccgactgcggtatcggcagttgctgctgctgctgctgctgcggctgcggcgaactcctcaccaccgccaccgccgccgccgccgaagacgccctccgctgccgcgaagccggccgcgtcgccattgcctccacagcccgagatctagcagcacgcggcggcaccaccaccaccacccgccattggatccaatccaagtatccaccaagctaatcgcccccccccccccccccccgccgctttatgcgggatttttcctagggctccccttttccctttcgtctggctcactcccccccttcatcgtgggtgcggctttcggatggctttcgcactcacgcctttttgcttccgtcggaagcgatgcgggaggaagaggaggaggaggaggacgcggacgccgctgcaaaatgtagaagaaaagaaatcctccctctctccccctctctctctctctctctcttctctccaactggctcttttggtgggtttattacgccacgggagggagcaggacggggtgggtgggtggggaagaggaggctgacaggtggggagggcgctgatgggtccacatgtaggtgagtggatgttgactcgtcggagtcactggggtaggggtttccgtggattttgattggttgtgggcgttggggtggtacggaacggaaggagaggcctctctcttctcttccaactgttgcgtagggggaggcgacggtttactccggtttgatgatgatcatctagcgagattgctgtttttcgagtcagtggtctcattaagaaaacgtactagcaagtttatcatggtagagtagtagtagactagtagtttgatgaatcaaataatgtagtactaccaaaaatatggtagtactatcataagccttgttttgcaaaatttcataggaatttaatctggccctgctcggctgtcatgttggcagctgtgacaggcccattacctgtttcaccccaaaattaagacgtgtgatgcgaacgttaattcttcactttaaatgcacaatggcgatggttgtttctgtaagtcgctgttagtagatcgcactgttatggtggtggttgcggttgtgctggacgagtggactcctggaccagtaacatcattctccctcacagccaatcgatactccttttgcgcccatttctagttggtgcaataatctccatatatgggaacctaatacatatgctcctctcttaatgcgtcacttacactgtggcacaccgaaaataacacctcttgtcccgtatccaggcaccacgcgccgatcccatctcctgtacccatcagcgttgtctttgtcgcgcgcgtacgtagctagagtagtagctacggcctacggcctgggcgcgtcgcgcaccagcgcgagcgggcgcgggcagacaggacgaacgtatcacggcgcgcggtcccggttggatggatcccgccgatcgagcgacaacagtgccaggcgcgccgcgcgcccgcgcgtcccgtccccccatcatccgtgtgcccgcgcggccggtcgttttccaacagcgcggcgctagctcggccgcatcccccggcgcccggtcctcgccatcacacgcccgcgtcggggcacgggaccgcgcgccaagcgccaaacgcgcgtgctccgagggcgtttgcaaatgcaaatatgcaacaacgcccgtgagccgccgtgtggccggcgagtgctcggcgctcgccaccaccatggcaccataggcggacgaccttcccgggcgtcacagacggagcacgggcaagagacaaacccgaccttcccaggtggctcgatcgtctcacagacggaacacgggaagcgacaagtcgacaacccggggcgccactgtttgggatacaaattatatgatgctgcagctcgcagctctctgcaggtgcgtgctgctactgtgctcggtcctctggtgccggatttctttcgagagaaaatgccgtggaaatggaatagtttccgtcacttcggtcagctgagttgcacactcgcaccacatgcgttcgcccagtttgttttgactactggacaatggacatggcgatttggcgagaccgtcagtagtggccgacgtatagtagtactagtagacgagacgcacatggctcaacgtgacaaaggcaacgagtgctagctgcttgttgcactggttcagtaagaaaaacgaagtcaaatatgatttgaagtgtattaaactcctccgtgtaagctcgtagtctaatggactatcccatcatggaaatgagtggacatggtgcccttggacgtacgcagtagcttggatggtatagagtactacggtatgattatgtcctgcacttagcatagattcgattcgcaggtggagcaattagggcacccacaatggttatctataagctatctacaagagatccatgtcagcatattttcctacttgaaagatattaaatgaagagagagagcaaagctatctactagcttagagatagtctatagagaaaaacgagacagtgcatgagagagctatagatacctatgtagacatactattgaggtggtttactattaatctagtctattgctgagatgtacatgttttatagagagcaccatactttaccattgcgggtgctcttagcatgctactataagatgattgtcaggattctattgtcatcattagggctcatgctctgctccatttcttttacagctaggagatgctctgcaaccttggactgactagtgttttttcctgaatgtcctaaattgcaggcaattgaaaaagaaatttcttgtcagggatcagaattcagaagtactccatccgattatctgaacttgtttcagggaaaaacaaacttagaagcatgaactagcagaacctgccatcgtcacactatctgtattttagtaggaggaccgctcaggctactcctacttcacaagtcctttgcagcacatctccagaagatgcagtcatccaatgagacatacgcctgaaatagtagcccatgcaccaaacaaaaatctgcgtgattgagacacttaatcgcgtgcaacgacgagaaagaaaccgattaaaaatactgagtagctgggctggtgattcatctgcctttgtttactggcataatgccatt

SEQ ID NO: 11712 - DNA, 1444 bp, Oryza sativa
ttttgggacggagggagtatcttgctagaaaaagttcatgcatgttgacgtcgaaagattgagagatcagcgggtagaatctttcagtcaccgtactgtgacagattcatgatctaaaatgatgcatgcacgatgcatgatgcaggtctggggataatattacgaccatatactacttcatactgttagtatatatgagtagtgcatttcaattaacagtatgaagttaaaattccccggagaagccaatcattttctgcttaacgacgtcccaccctatgcaaacatacaattcatatcttgatgggcagtactgcagtgggtacccatgattttcaccttaaaaaccgtgccaatcacagcatgcatgcaaatggagaccagatcattcattagggcggatgcatatgcatgcatctcgtgtcagatcggtaggtcgatcgatccatatgcatcgatcgatctgctgcagccagtaagtatatatagcctgcccccaccgcattgcatcatccagtcggagtacgtaggcagcagcagccgatctgtctccgattggcgccggccggccgcctgcccgcctcggcccggcccatgtctgctgccttggtgtcggaagcagagcttcgctcgcgtcgtcgtcgtcgtcagctagcaactgatcaacagttgcgctagctgcaacgtacgacgagcgcgatgagatgagcaaactcgccgtacgttacagctagcgtctcgtactgctccggccagcgcgcggccggccggctgcccggatcggagtaccaccaactctcgcccactcgcattccgatgcggttaaggctgcacatgctagcgcgcgcgcccggtacgtatagtagtacagtacatgcttacaaacagcggcaagaacgaagagcaaagaaatctgagaaagatcaatgcgtcgtcgtcgtggtggtgcaggggaagcacatggattgaatcagtatatagccttagctgctgaggcgaagacgcgaggtgagatcgtgatcagatcggtgatgagtgggcggcagtagctgaactactggccgatctgtgcatctacatggcttcgctctgctgggcacaagtacagctgcatgctgcatgcgcgcgtcttctctgggcgctggtcctgcattcatgcatgcccggcaaccactgcatgcgacgcggtggtggtggtggtggtggtggtactgactactggctgctgctgttgccttctgctggagctggacgcatatgtcatatgtgcatgcagtactaccaccgctgcagagcaaaccaattggcatgattcagtgccccctatttagatctgtggagagtctcttgatgctgtgtgtagtagtactgatcatcgctgcatgcaccttgctggccagcagtgacctgtagctttctatagcttcggtgtgtgtatgatcct

SEQ ID NO: 11713 - DNA, 20116 bp, Oryza sativa
  unsure (1)..(20116): unsure at all n locations
tgcgcgcacccctatcgccgatctcattgtttgtctctgtccttggcctgctttcttgcttgcctctcctctccccctcaaaattgcatattgtgcttttctgtacatgggacatccatgcatagagcgcagatcagttctctctgctcttctttatttgtaatggaatgataatctgaggtgtttttcgccggagaaattaatcatcaataccgcatgcatgttccagtttctgtccctaagaccaaactttattgccaaaccagtgactttgtatctgaatgttgtctgtcctgatgcgttttaattatctatggctatagtatacacatctgaaagaacaaaatggttgcataataagtagttgagagcatgcatgaattgacggagatgatcgacttcggctttttttgcagcatctctttgagctttgctggctagctcagtaccggcttccggcacagcatgcatgcagccgtgcatattggagtaaaagcatactataggagtaaaattaataacgatcgaagcactgcagactatgtcaggctgctgtgccaccaaatgacgacaagaacgtcgaccgaaattgaatttcgtaaagtacgggggccgtacgatgatcgatgtgcaatgcaatgcaatgatctattagctgttctgaaaattcatgacgtgtggccggtggttacatatgtacttgatgagattaattcaggctatttaatcaaactatgtacacgtacaccacgaggaaatccgtggttttgtgatctcaattacgtacgcgtatagatggtcagtagatccagtaaatgtttgtactgtactgtgtgttcctaggctattagcccagaatgtttatgtatgacaggctgcattttctcccgatgtattgattagacttagaagtagtactagctaatggaattagcagctggtcgtacgtacatgtgtaagtacatctcatgtctcgatttatatggcgctgaatgattatcatctatagtagttcatatttcttcatgacatttgagacccagaacttttttttatactagaaaaatgatgagctaatcacacagtagcgcattccattttttattttacgggtccaattttctgtctcggaccctgtgaatactctttattgattctttttcctcctctatcaatataaagtggtaaagcttttgcttttccttaaaaaaattattgttcactaatatgatgctagctactatacttttgtcccattaattcgatcatcgcgcaggggtataaacaaacggaaagttatcctccgggattgtctattagggtttagctaggtagaaaaatcagactgactaaaattctatggagaggtgggtcaataccgtaacgtaactagtcgccaatctatatattgcacagactattatatatactgatactacaaataataaaattctaaagttatgctaaacatgttgattacctttttgaattattgtagctacttatattaaaagaacaagtcacatatcagtttcaacttactaattaatttaattttgaactttagttagaatatattaacttaataaaataataaaatagagattgcaatctaggtaccatatcacatatattaattacaaatttttagattattaaattagagccatgctattttcaattgcacaatttattaaacatgtactatgcatggtcacgataattaatacgatgcatcaaatcaatggccagagtttatggttaatatgagagctttcttgaattatccagttagtccatgagaccatagggaaatcattactagctagttaaaacaaatcatatgtgtgctatgaaattcttttctatgtgcgcttttaatttatgaaaatcaattaatacaccctcatgtccgtacaatattaattgcacgaggaacaattgtattttgcattttaatttcttgttatatatcagcagccttttccttcacgtgccaatctgccatcagtaaattattatattactgatcatctataagaggaaggccagaaagtacatgaaatacacctggctttggcagatggagcacatgctcaaaagagccatctctgaacaaagcaattcagatggacgtataattgggccatggggtggaggaaaagaaaggtcatgtacactatatacatacgggcccatgtacgacagtgttggatccacacattttcaatctactgctgcgtgctggaaccgttcttccacacacatgcatacatttctgtgggtaaattaattattcctgtttattcaagcaaattaattaatttaatttcctgtttattcaagcaaattaattaatggactagttttttcttctgtgttttctttgacttttcaagccaatattgatatccataacaagtgcatcttttgccgttttggaattgattttttttaactgatctttgcaattcgaaggattttctttttctttgcctggtaaaaataaagtggcaacacaagctaggtagctagctaaacttggatccggacaaggcaaaaagagtagattatttaagctatgagaattaacataccctttcttgcgactgctaatccacaagaagaaaacctaattagacatggattacaaatggaggtccaagctgacaccctccttctgccccaattcacacctacctagcatctccggcgacgtcgacgagcacgacgacaacgaaggcgacgaggacagcaagctcatcggcaccatctcgtccttgcatgccacctcccccgccgccggcgtgcccgccaccgtagtagccagcttgtcagcgccctgcctgccggccgtgctgccgaaattctccgtcggcggcggcacgctccacagcccggcctgcacggggctaccgttgatgggctgcgccatggaacctggcccggcgaaggcgcccggggcggcgctcgtccacatcgggtagtgcgccggcggtggcggcggcggcggcggcggcgggtggtggtcgaagcggccgccgatgtggtggtggtagttgaagaggccgtacatgtgccccggcatgtagcggtgcatggcgagggaggcctggaggtgagctcgcttggcgtgctgccgctccctcttgtgcgcgttctggtggccgcccagcgcctgcgacgtcgggaagttgcggcagcagtagtggcactcgaacttgcgctccgccgccgccgtcgcggcgccgccgttcttggtgccgccgtcgccgccgttgctgccctctgacgtgaccgtgctgccgttggccgcgtcgggggagcctgcaccggcctccgtgggccgcagctgcaggtcgttggagaattcgcagccgaacagccggattgtgtcccgcgcctgctgctgcggcggcggcgccggccggatgaacggcagctgcgagaacgagtcgacgctgcgcatgtcctgcggcttcgccatggccgtctaaccaaccaaccaagctatctgcttctacgtgaaccaaaaccaagaattaaccacccaactcggggcaattcttgctagctgctgctatatcttgcgtctccgcgctgaagaaattggctacgagttggtgtggttttaaggggatatgggagttgtaagctggggcggaggagagggggacgaagagggggaccatgcaagaagtaagagcagagggggactaccaagcttaaagctcccccctctctcatcaccaagtacaaatgcagctgcagtggcagttgctgttgctgcttgtgccctccctgcctagctaagctactgctagtgcaagctatcgcctcatcagtctcacacacaatgacacaaaacattaaccccggcccatttctttcttggcaaatatgggactagtacatatacgtactcacacaagtgcagctatagctagactggttaggtatagctagctacagagagaaattaaaatctggtagtgtttattttctttcaaacttctaaaaattctaacacatcagatgcttaacacatgtatggagcattaatgtggacgaaaaaaaccaattgcatactttacatgtaaattgcgagacgaatcttttaagcctaattacgcgatgatttgacaatgtgatgctacagtaaaatttgctaatgatggattaattaggcttaataaatttatctcgcagtttacatacggaatttgtaatttattttattattagtctacgtttaatacttcaaatatatgtccgtatactttaaaaaagtttagcacacgaactaaacacggtctctctgatgatttttttttttgccctgtccagctttcatgcatctgtagctatcagtgggcatcaagtggggggagatgggtagtgtgactccgtctatccgtcgctctctccctcccctctgctgcctctgggattggctgtagccgggggttctttatgggaggttggcttctttacaacatgagagaccgcaggtggtcctcctggggacggcgacgtgctcgatcgcattctgcttgcttgcttgcttgcttgcaatattgctctctccctccctgttcatgctgctgctcnnnnnnnnnnnnnnnnnnnnttactgcatgccggccggccggtagtgcagcagtcatgcatgcatcgtttgcatgcgagtttttatctctttatagctttgcgcggtggtactgctgctaccatcgtttgtagatcgatcgatcgatgttctatggatggcatggcatggcagcaagctgcttcaattcgttcgtttctctccgtttctccgcctgtcgatcgatatggtggtatctttttgacagcgcggttataataatcgtgggcgcgcgtacgtacgtgttcgatcgatggcgcgcgctgcgtcgatagctgggatccacatgcatgcttgattgctggatcgaaagctagctaattgagatagccagctgagtgctgcagttttgagatcatgtcgatctctacatacactccatggctgctacagtagcttttttttcccctcctctctttttctgcaggcttttgtagaccttttctttttacggaattccatgcatgcattcagcgatttttcgcctgcttgttgtagtagtgatatggaaaaagggtaatttcattggagttgtttcagagagatactacgtgaaaagttgtcaatgtcagtaactcactctcctccaggacgtctggtttcatatggcttctgaattaatgacccctatctaccacaaatggaattggccgtagttgagacttgagagatatactactgtcgttgttgtccatctagctagctagctgttcgagtagaaaaccaaacatctcctacacaggtagtatagatcagtcgatccagtctctccaacttgtgatgaacattaatgctcgataggacaagaaaacattttcaagcctcatgggcgcgtaaggccgtagagtgaccgtgtgccaaccgcgatgctatttgaacttgtgttatctctttaagaggtactcgtctggataagtacatcgccaacatcgaaacagtgcacgcatgtgtctctcgacaagtacataatgatgacaccaatgaaatctccatcttaatttcatctgtggtacagacatcgcatatgcatgtcttttttttctttttttaatttcttcatgtccatgaattaagattgtttgtgttacaatatttctactgcctaaattaacggcggctcccaggatagagggacacatggaaaagctgagtgaaaacgcaagctcgactgggactcatgatctcagtaacattttctgacacttacgtgtatgacagatatcaatatcgaccagaacgagctcatcctaatcataatgaccactcagagatccacgtttatttcaagttgagaaatcgttccaaatgatcaaaattccttactacgatttggacagtttttcactggtttaattaacctggcgcaaaaacgaagaataatcaaggaaggaccaccgtgtagctgtcagtagtatgagagccatctatctgaaaacacgaaaatgggaacgctcagagaaaataggagtagaaacaaagcgttgatgcgacacgcaaaagtagcaacatttatgtacatcgacgtgcatctggtcatcagtactcatatgccctgcttgttgctgccttgcttttcttttttttcttctctgcccctgtactggtacatgtcgtcgtacgagttagctagcgggcaacagttgtagccacagcttcgccgacggcgactccgaacccctgcaggtgcaggtgggtgcacgccgctttcacggcgacgtcgcggccgcgcgctcgccactcgacctgccggtcgcgccagatctcgcaggcgtcgccaaatattctcgacatggacttccatttgtgtgttgtagtagtatcatcgatccatcgatcgattgtctcacgcgtttttcaccttttgccccctctccttgtccaaattgacaccgtgttcagttccaaatattttcttcaaactttcaacttttttatcgcatcaaaattttcctacgcacacaaactttcaatttttccatcatatcgttccaatttcaacaaaaacttttaattttaacgtgaactaaacacaccgtgaataagcttcttcttctccttctcatcaggttgcagtaatttattggcagatccaactcccccgatccatccaccacacagttttcctcgtaaatgccgtggccgtacgatagatatattgatggtaggctcgagctagccgtcgataagacacaaacgcttgtcaggctggaaaggatttgacagggaaaaggtacgggtacttggtgcaaataattccgtgccggttaggctgctgttattaccgtgggcaagtttctcacccacgcacacaccgatcgaccgatggatccgtacacttttgcacgcgtgagccgtgtggaaaagtcgactcgcagcgggcagagacgacggtgcggccgcggcggcggtagcatcagcaacgtgatggtcgtcgtaactgccggaaaaggacgccgcttgcatgttattttcggtaggaagcgatcgagatcagcgcgagacgagagctagctagctgcaattctgcggctctgcccaacccaaccatgcgaattgcagtgcatcatcaccgatcgctcgctcgctgtctctctcgctctccttttcgctttcgctgcttccaacgaggggcaaagcacgcatatggatgtgcaggtacggagacgactagtatgcatgctggtatacgtgcttttcaccgcgctagctagctaactctagttgcaggacatgacagccttaccactgctcgaccagagtactacctcccctctctcccacaatagttgtcactttgacttttttttaatatttaatcattcgttttatttgtaaaattagtgcaaatataaaaaaaaataagtcacttaaagtacttttgataataaaacaagtcataaataaaataaataataatttcaaatttttttaataagacgaatgatcaaattttacaaacaaaaactaaaagcgacaagtaatatgggacggaggtagtactctcttcacattttgttttggatttttggtgggaggctagttggttggagaactacctcatatcaggtactacataccaaggatatggatattcatctcttgagatgatatccctcgttacttacatgtcacctaaatagttataaagaatacgaaaacacgataacatagtgacggagcgtggggctcctcaccgggagaccgcgcaggcccccctttgccggttcggccgggggccctgggtgagattctaagctcctagtctgtgtgtggaaggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctctttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccgggaccaacgtgccatctccaggagctaacacgccggctccggctagggacgagtgcttggaggctctcatcctgacgggatagggcgaggcgtgcgtcagaccgcctgtcgccatctaacccacgatctgatcggtctgtgactggtcactgaccggataaacaagcgcgctgcactgcgttacatgcggcgtgacgcgctcgtccaaaccgcaataaatgtggttaggtgagccccgctatgctcacctacccaatatacgcggcgcaaaacccacaaggggtcggtgcgcctcggccctcggggccgagacgggagcggtccgacccctcggggagacaaagagaagggcggccgtatcacccttgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgtgagaaacgaggagccgggcacaacgttggcaagggtataaagtcgccgaggaagagatttgcttccttcctctcgccattattccccttgtcttcgccgcttgcgccctaactccttatttcctgtgccctaccttcgccacacgcgctcgctctcaaacatctcttcttccggcgtcatggcacggggctccgctccgcttgacggtagcgtgctgccgccttcccgcatcgtgagcgagagacaggccggtctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatctcttcggctgttccggtggttcttcaccgtacagccggtgtcgccgccgtcagtgattggtggttgctacttccagccgcgggggccggtgctgaaccgctacattccctgcgtcttccgcaagaagtgggatgactggaagagcgactggttctacacccccctcgccgacgaagcgcgcctccgacttccgagccagcctccagcgcaggcctccaactggcgggcgccgatagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggctcctgaggacttcaagatagtggtccaacgggtgctgaatctcagctccgtggaggcatccctcattcctcaaggagtcctccccctctgcagcgatccagatcgcgccaacatcctgaccatcatgcaggcggtaggggtgtcggaggagcgggctcctcgaggccacgatggcacgggcgggagccgcaggggggaacaatctaccccgggagggggtcgtgcttctgggccccgcgacgggggcccggggagcggccgccctgccgacgcccgggggaagaggaagcaggaaggaacccctcccccgtctcctccccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggctcggaggcgggaatctgaccggcgagaagccgtggatcgcctacgggaagccgaggaggccgcccaggtggccgtccgagctcgccaagctgaagaagccgctcgggaggaggccagacttcgccaggccgaggcgacgacatcctccgaggcgacctgtgaaactgaccggcaagaggccgcggatcgccttcgagaagccgaggaagctgctcaggtggccgtccgagctcgccaagctgaagaagccgctcgggaggaggccagacttcgccaggccgaggcgacgacgacttccgaagcagctcgcgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcaggccttggccgtcgcaaacaccacggtgttggacgggttaagtgcccagatggaggccttgcaagcagagcgggtggagctcgacgccgcatgggcatgtgtcgaagaggggtgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacttggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgtggccgcggcgcaacggctggcggacagcctgtccctccgcgaggcagtgcgggaggagcaggcgcgccgtaatctggaagatgcccgcgccgagagggccgcgctgaaccagcgggccgctgagctcgaggcgcgggagaaggagctggacgcgagggcgcgcagtggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgtgccggccggcaggcgggcctctggggcgggcggactgcgaagtacgccgccaaccaggggggcctcgcccagcgcctctcggagatagccgggactctccaacagctccccgaggagctcgagaggacgattaagtcatcctcgagggacctcgcccgaggagcggtggagctcgtactggcgagttaccaagccagggatcccgatttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgggcgcatcggagtgagcccccaggcccccgccaatctttaaatagtttcttcttttcttcttccgaggccttcgggcccccttcttgtatagactaatttaatatgcaatcaaataaagaggaaatttttttgtgtcaattctatttgttgtgtgtatgagacgaggatgcctgtgccgcggttcttttgtgtcttggcttgagcaagggctcgtgcccaggtcctagtcctcaaatggctcgggtcggggctagtgcctggggagatccacatgtcgagactggctaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaatacgagtgacctatttcaagtcaagatccttcaaaaggaaacaacagcacatatacagcctttaggaaatcgaaaatgcttttattgaaatacagatataagagaaataagaatctgcatatgtggtagcccccggccagccctgcacgcccgaggggggtgcggggttggccagagcccgaaacctgacacccgatccccctttaggggtagaagcgacgaaggtgttcgatgttccacgggttaggcaactctgtgccgtcgcccgtggccagccgaacggagcccggccgggggacgccgatcactcgatacagaccctcccacattggtgagagcttgctcaatccagcacgcgtttggacgcggcgcaggacgaggtcgtcgacgcagagtgctcgggcccggacgtggcgctgatggtagcgccgcaggctctgctggtagcgcgcggctcggagggccgcgcgccgccttcgctcttccaagtagtcgaggtcatctctgcgaagctgatcttcatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttctcgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttattgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctaggccggctgatggatttgcttggcgtggaattgacacgctctgcatcgccggaccaggtcgactgcatcattgagagctgttggccaatagaaaccttgacgagaggctttgccaaccaaggtgcgcaaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtttgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaagcgaaccaaatatctgaggacctctccgctcggcgaggtcaacgtgacccccgcaccggcgccctgaagagacagggagccgttgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagttccctctcgattatgcaagatttggccgagggggtaagacgtaaccaccgtgacccgatgtgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggtgctctttgtccaagcggcctcacggggtgcactcgtcctctgtgccgacgacctcggggtcggaggacgacaggggcggccttcccacagtggcctcggggccgtcctgggggtcgggggctcctggcgtcgtcggacaagcgggcaaagggccaactccggtggtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctcccggctctctcccgggccaagccagcacagggtgggggtgcgcggaatgaggattgtcctcatcgcgctccacaaccaacgccacactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagagccttctctcccagcctcgatatgaaccgacttagggcggccatgcaaccggtgacgcattgcacatccctaagtttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttctgctagatccgagagtaaggtctcttggttgcgcgtctttacaaccaagtcatcgacataagcctcaacattacgtcctatttggctacctaaagaaattcgagtagtacgttgaaaagtaggacctgcattctttaactcgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcactgcgagacggtgctcaatcacctccctggggaccccgggcatatccgccggtctccatgcgaagacgtcagcgtttgcccacaggaaagagacgagcgcgtcttcctatttgccgtccagaagaccaccgatccgtgtggtcttggacgggccgtcgcccagggcaacctccttgaccgggacctcgtcgcatgtgactatccgctgcctcgggacggcgggggcggaggtgccaagcctctcgtcgcctcccttgggcttggacgcggcggcgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtaaccgggaggtcgatatgacctagcggccaagtgtgacccggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcccccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcatgaagggaggtgttgtggacgatgcaccacatgccggttgggcgctccctactgagagcgccggcctccttcttttggtcgctcgcaggcctcccctttcgggtggcccacggagcgccctcgacggcgaggacatgaccctcgtcgtcagaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccccctgaacgcgtagatcaccgcgtgtgcagggatgcatggtatggtgttgcggacttgacagaaccgctgaatgtaggagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccctggcggcctcgatcccggtcgtgtagacctggagaaactcggcggggttgacgctcccgtcatatttttcggcgatgtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccaaccaacgttgggctggagactccgggtcagggacaatgggcgggtgacgtaggagcgcgccctggggcgtgctgccgtcgccgtagacaaggaggcgacgctccccatctcgccgcccttccccatcacccgtggatgtcgaagtcgcggatccttcgaccctctcgagcgcctcctcctgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtgtgtggagggttcgcgggagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctttttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaaca

SEQ ID NO: 11714 - DNA, 634 bp, Oryza sativa
gagagagattatgagctacttctaaattaacaggtaacctccacacaaacttaaaaaaagatgtgtgagtattagatgattgacatttgtgtgttggaagtgacatattgtatatgttgccttttagtttattaatgaataatatggataaaattaaaggtggcatttacgtctatcatagtatttgctcttgtagtcgccgcggagtccggcaaataactgtcataactttttcttttcttttcatcttctttatatatggctgggtgcttaattgtacatagttactaagtatatatagttagcttaattatcatgcctggtttatgtatcggtatgtctctgaattggtctcgtgtaaaagatttgccgtttgatggaatttcagaagttgccgtacaagaccggtactactagtgttggacatgtcaactgaaagtcgtttggcccaactgagaaagtcgaaactggctcttaacagactagataccttaagaaagcaaaagaaggaacagcatactgacctaattaaaagctttctgtgtcactctatggttcaattcccgcgttttgggttacttgtgcacaacaaaagtactagatcctggagcacaaaaatccaagctgcaaccga

SEQ ID NO: 11715 - DNA, 796 bp, Oryza sativa
atcctcctaatcaattcaaaactacttcgaatcgaatccaccgataagaacaagtgcggccgttaggatcaacgatcaagcggtggacttagggaaacaaactcacatggccgagcgagaaggtctgcgagggggcgggggacaggtgcgaggcccaggacggcggcgcgtacggcctcttggagaggaagctcccgatcttcccggcggcggaggcggcggaaactccggccatccacgcggcggcggcggcggcggcgtggaggggaatggggagagagtggggcagcgagcagcgcgtcggggcagcagctacagtccaaaacccacctggtgcctggtgggccccacgcgccatctactgagcagcgggcccctcctcacgtgccccgtgtcagtgagagaaaaggagacgtcgttttgactctttgcccccgtgtccactcgctttctctcctcctggtccttggcgtggaagccacaagaggaagggattaaaaatcaaaaagaaaagaaaaaggaaaggagaagtggaaaaaaaaatagttcgctatctcgctccagtgtccaaatcgcgcacaagttctgaaagcgattgtggttggccgctgttgatcggtgcaatctcccgacgtctcgaggaggaagaagaagaacacgtcgggttagttcgatttctcttcatttttttgttcatttttttctgcgcttttccgcggcgatgtggtagagtgggggagtaggggtttgatgcttccagaggagtcggagaggcgatttttatgggatttttttt

SEQ ID NO: 11716 - DNA, 5539 bp, Oryza sativa
  unsure (1)..(5539): unsure at all n locations
cactgaagcaatgggggtgtagcaaatgagtggcggcggcgaggatgaatgaaccaatgtttttcccttgattagatgactccaccgccaacctagtgtagcttgctcgctgcagccaggtgccgccattgctcaagctgcttaaggagggcactgacgatgccctggaggctaccacacgcctgccctggctgcttggcttcaatcttcaagggtcaatcgaacctccatcagaggagaacggtagattcagattgaggaagagcacactatttcagtggtattttgagagaaccaaaggctttctattggtatatatcacaatgtgcaagttcaagtgatatatacccctttttatattaaactatttattagttattttctctcttcgttcatctcatacattggagtattggacacaactagtcttaaagttgttgcagctgtatttgctgtctttattggtttgcacttcttagttccaattcagcagtccgtattcagtaatgctataggtttcccttctataacaagtgcaaaatgtctttatctcatttcaggttctctgttctttgggggactcctacagatgtaattggttctgtaagttggggacctaatcaggtgaacacttgattgtgataggcttgtcaccattgttagatatgcagcaggttactgacacaacaggggctgattttgtttggccaatctacatgtggattctctaccgcagagtgtattttcatgctgtatcattctagtggccattataggttaataactttatatttctatctaaggtggttgtttcaaacactggcattcagtaatgtgtttttacattcctgaaaatgttctgaaaattttcgttattgttatgctgacattgtgctacaaatataattccaacatgagtattgatattgattggagtcgttactctctgaagatagataatgttcttttatacaaaagtatgcaaactttcttgcttgtgtcattggaacttgattttctattacaatggatgttgatttcagggttaagaaatgtctgaccaggagagagatgatattcctatgctactaagaaatgttgagctaccaacgtttcctcctagaagtacatcaatgtgcataccagttagggatgatgaatacgaagaagacacatttgtaccccatactggtcctctgtttgttcagccaccaacacaaactgcagcagcgggcattccatttacaaatacaccagatatgcctcctcgacctccacaaggaaaacaagtcaacaagccacatgcgataatgccagaagaaattggaggaaacaggtggtcttatagtgggaatgttccaaagaatgaacatttgatgatgtctggacctttgggacaatgtgacgatcctgattgtgtcaactgccctcctgcttgtaaaaacaaaaggcattttcacagaggatcaagtacattggacagtaaggtggtcttacttccctctttttgtaggaatgcacaaaacattaaaactatatgattttatctgaacctgatagttgtggctggattgcgcaacatttttctagtaaaatagcatagtattgatacatacttcacaatcatcataagtgatctggattcgagaagcctagtacttctgaattataaagtagagaacacaagtctaaaagaaacataaaagataaaaggcaaaaaaaaaaaaacagagtatagaatgcacctctacatagatgagaggtaatattagttgatatttatcttcttcttatataaaaatctcctagtaagcaatcaacatttggctacagataactcaattttaagcatcaaaatttctatttcaatcttcaatggaaaataacagccaatattgctggaggtagcgctgtagcggaagtaccccgctattgttattgcggctgcaattgtggccattgtgaatgctatttagtaccttggttcttagttttttttttgtctagttagatttcttcaacataatgatcaaagcacttcttaagagcgcttaaagttactgactgtggtattgttgtattgaataatctaatctgttttcttttgctctcttgaagttccataattttctttgtgagcatggtggtggatggaagaaggaaattgagcgtttcctttcacgcattccagttatgaacccacatgcaaaagttgttcagcaatggaatcagttctttgtgatatcatgcctggttgccatattcattgacccactatttttcttcctattatcagttcaaaaggtaactagttcacttgaagatgctagttcatatccatctgtcaaaagcctacaactttcttgtacacttcatttgttgttgcaccttgtttgtgagtttgtgagctaatcttgtgtaatttttcttactcctgttgcagcattctattctcctatcggttaactgttctaagtgttgatatcttgtgtaatggattgaaagggtcaaataagcctaaaaggggaggggggaaggaataggcgattaaaacttttaagtagatgcagaagcagtgcttttcggaaattccgaaaatctcagatactccgaagatcaaagctgacctgcacttacttttgttccctttttttttatgcaggataacaagtgcattgtgttgaactggcattttgctacagcacttgcagttgtgagaagcgtgactgatgctatttattttctacacatgcttcttcaggtcagtacatcattgcttttgctattctatagaaggttctataattcatgttccatgatagggtatggttccacattttataaaattctttcataaataacatggtcactaaggcatcagatggaaggcagtttgattatattttggttctttggtatgcatattaggacaagtatatttgttgagtgatcagtagttttcttctaaaaatgccaaattagatactggttttttgtgagtataacttgcactttttatctgttgacaatatgtgagaaaaggctcagccgctcaggttcaatattcttgtgtcctggtatcatgttttagtaactaacagtaatgcattgtttgatcttcagcggatgatttatcatatctccatgatcaaatagttgtgatatctttttaccctttgtttgttaattgtaatggtttgtcatgctttgactccattctggtatcatgttttagtttgatttatcatatcttgtattttattttattttgcatctatttgttcctgtccagttttaaccccaagaaaacatattatcaacttttgaccgttttattttttgcatttctctttcagttcagactggcttatgtagctccagaatcgcgagtagtgggagctggagatttagtagacgagccaaagaaaattgctgtccgttatcttcgtggatattttttactcgacttcttcgttgtgcttccactccctcaggtaacttgttttatccttctgagttgatgtggctaaattttgacattaagcttcatttttcttctttatccctgatggatgacttattatctaggctgaagttttcctttatcattctatttatatttttatattgctttggtactcctcttcaagtcggtagcagaaggcaaacttgttcttagggttatgataattattttttagggtaggtcaaacaaataaaagagttagctactgggaacgcactatacatcctggagagtatgttggagacctggcacaagcagcataggagttaggaggtcccagctatccatccagctgttgaaaattgcttttcttgtttgcttggcttattactttgcatctgccatggctttgtggaccggtggccacaactgaatgcttgcgattggcaagtgctagtgatccatgttcatctttttcatgcacacagcaaattcattgccctatgtagctagtgttatggacctatcatgaacagatcaagagcatttctttcagttctcttcacgtgcacaatagaccacattatccttttaagctataaacttgtgatctccactattgatgtactttaaaatacataagcttcatctaaggagtattggttcaagtccccgttgaaaatatatgctattgaacctttcaggtttattttggtagtttcttgttggtctcagagtatttgccaatgtatttaagccaactagaaattgacaagaagtcaaaaagaagttgctgtttagcattgaaaatactatggatcttgggcatgataatgactaattgattattccatacttgtgaccttagcagattgaggatgagtctcatgaaattgatcatgcagaggaacaccttagctaggctggcaattctttgttactttctgttctgtttgccatcaatattgtcagtatgagcatcatttgatctgattgcactgatgccctttatctatttattgccccagttgcttatgtaaatcagaattgcatttttttctaaccctattaataaaggatattcatcgaaacaatttacacctttttatatcttattggctaatactttttttttgtcttctgttccttgataaaggtgatgatattgctggtcatccctaaatatgttgggttatcaactgcaaactatgctaagaatttactgcgtatcactgttcttcttcagtatgttccccgcatcatcagatttgtaccattgcttggtggtcagtctgactcatctgccaatggattcatattcgagtcagcgtgggctaactttgtgattaaccttctaatgtttgttttggcgggacatgttgttggttcatgttggtacctatttggattgcaggttagttcagcttctatttcagttttctgcacaaaaatattgtgtttattcatgttgaaccagtagtttttcatctggggaaattgatagtgtcacttaaatgttgaaatagggaaaccactcaaatcaacctttgcatccactcaaatattgaaacttaccagtatgccctccctttgtcttcttatttctccattctcctttaccccctcacaaagagcagcagtacgactgttccctctccctcatcattgttgccacctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11717 - DNA, 444 bp, Oryza sativa
tctagatcttctgcttgagcacttgccggagctggaccttctggctctccatccgtgcctccatgagcttggatttcaggctgtgcttctgggatgtccgtgggtactccatgcagcccttgaagccccggttgaattgcatgctcattgaatccggggagctccattgccctatgctcggcgagctgaggcctatttcttgaatgccactgtcaatggtagaatgggtcccaacggatagccgaacattaaaagatcttccattgatcgtctccacagcatctttcttgcagacgtcattgttctttggacgggacgacttccagagctttgataaggctgattctttcttcttgggttggttcatgtttgtcaggtatatatcagtcgaatcatccttcagtttctcagcttccttgtactcaaaatcgtttcggctcgtcc

SEQ ID NO: 11718 - DNA, 3788 bp, Oryza sativa
gcaattattgaaccgttccaagctaaccaaggtaaacggtcgtccatgcttcagtcaagggatcgagcttggctgatttggccttcttttttaaggtcgcatttgggcttttttgagaccgaagaaatccaggtttacgcgtaccctttttgcactaccatgttgctgcatacatgccgaccggtgaacgcatcaaacctgctgacaggtcagtttcaggtcaggtcatacacccacactcgatggattgggaacatctgctgacgtgcagtcccaactataactgcacgttagagattgcacgcaatccagtcatccaatttttccgttgaaggtccagattaaatgctacagtagtcttgctacagccctaacggtgtcctgttgaaatttgggcatttgaatttacatcctacagccctaacaactgtttaagttgtagtcacgcaggaaccaaatcgaccatcgatgtatcgtatcaaagacaatttgtaaggccctgtttaggtttcaactttttattctttagactttcaatttttctgtcacatcgaacttttctacacaaacaaactttcaacttttccgttaaatcgttctaatttttttaaacttctaattttagtgtggaactgaacacagccttaagtcaattttactcgtcaagcacaatatacacataaaacgagctactagctactacatgaagcttgaaatataagcaaccttttgttctttaaaaactagtactacttgactagaaaattatagtatatttcagtgaacactccatgtcaagtgcaaactagttaagcgggagttcaaagtgtaggagtacgtgttaactgtaaccaatgacctggtccaggcggcaccttttgcggattccgtatgtacttttcctgcttcgtgcggaccaagcttccttcgtcgtgttactcgagggtgaacgtacaggactcgttattcgctgaattttcatgtggttttttctcatgttgttttcctagtaacgcttgataactacggtgtgtttgctctctggcacggaaaacagaacggtccattagggcacccacaatggttatctataagctatctacaagatatccatgtcagcatattttcctacttggaagatattaaatgaagagagagagagcaaagctatctactagcttagagatagtctatagagaaaaacgaggcaatgcatgagagagctatagatacctatgtagacatactattgaggtggtttactattaatctagtctattgctgagatgtacatgttttatagagagcaccctactttaccattgcgggtgctcttagtacgtgattaattaagtatttgctatttttttaaaaaaatagattagtttaatttttttaagcaacttccgtataaaaactttttttaaaaaacataccgtttaacagtttgaaaaacgtgcgatggaaaacgagggagatgagctgggaaaaaggggtatccgaacacacctactagtgcaaacttacaatttactgtagtagaagttctcatatcaactggtcaccctcagctagcatgagatcgagaagagtcgttcaaaagtgaactgtacatgattcagtcaaacaatccgagtaaagcttgctagtgctgttcacaattactcatgcagaaaccaagtcatagtttcacggggttgtcacggtgtcacaccgtattcgaccacttgttgcttgttgcgtactagcatacataccatgggatgcaacaaattaaggtactatgtgtgcagctaatataacaatattcaaagtgctcacactgatagacactctcaaggattaacttgacgtcttgaccttgatcaattcatcataagtacgttacgagtcgttcgccggtacggttcttggggaacaaggcaatattctacacggtgaaaagtacggaacacaggctaagctaggagaattaaacgtaccattttcacagaacattctaagaaaacagagttaattatacaaaatgaaaccaagttgttgcacaaagtgaaaaatccaagcccaacttcaactgtcacttgctagctaggccgacctgttctacattgtcatcactgaagttctccatggttcttcatgtacttttcctagtatgtgctcggtaagcttccctgatcgtcttacccgcagcactataaaaggacgaaatgggtggcttgttggaggcaccaaacattcagagacatcgagctctctttgatctctcgctgagctaagctagcatttgttcatctgaagtgttattccagttaagttcaggttcagtagcagcagagggcgagctcttttcagagtaatcgaggatgcctgaccacaacggggtgaagaagagcatactgagcgtactgtgcggctgcttttctccaccaaagacgaaaggttgagatgagatcatggcttcatgtacatcgatctgtagtgttattcatcttgttcagatctagaattgttctgtgtacatgagaggtaataagaggccggtgtagtggccgtgcgtcccagtccatcaggtagttttccattgatttgatttgtactcttgtaggttatagttgtttacgccgattgtattgttccatacgtatgtgtggttgtgtgttttgtatgagtcttgagtgataaagaattaccagcttgtttctgaacgttttcactatactcgcaactcgctccactgtcccctgaatatgtctgtatactattactatgaccgagtcaatgcttataggtggttatagggaaaatatagtataaaccatatatacgatggaaatctaaaaattattgttagatgtaaaaatggatgcatgagatttatccacgtcaccaagagtccgagtaaaatttttactcatgatttcatgattgaaactgagagtagaatttttacaattggtgacatggacaaatttcaagcatgcagttttacatccaagaacagttttttactacatattttccttggttagggtctgcctacccgagcttgggctccagccaattccaaacaatcaaagtttcaaacaagctgaaacaaaagaaaagaaaaagaagaatccatggatgtgttccttctaaaccatccatgttaccaagatgactcctgcactaaaagtttccctattattcttggcgatcatcttgtgacctccaccataatcaccaattaaaaagaaattatctaagatctctccctttaccatcatacctctaattagtcggagatgtaataatgtaaatggtagaagagcgtgtgtaattaatactccctccgtttcagattacaagatgttttgactttggtcaaagtcaaattatttcaagtttaactaagttataaatatagtaatatttaaatactaaattagtttcatcaaatcaataattgaatatattttcataataaatttgtcttgggttgaaaatgttactatattttttctataaactttgtcaaacttaaaacagtttgactttaaccaaagttaaaacatcttataacctaaaacggagggagtagcttttagttgtgtagcgcccgttccgtcgtggcgcctagcgggaaaattatctcttaaaaaccctatttgcgaaatttgtttccttgcttgttgtctagtgtccgtgccatctcaagatctcaatccccgatctatcgtcgagttcaaattccgaatccaaatccttccaaaatcatttcctccgcaaaagtctattttgcctcc

SEQ ID NO: 11719 - DNA, 11915 bp, Oryza sativa
ctctcccgggcgctctctctctctctctctctctctcgctttccccggcgcgttccccccccccgactcgctactcgcgcgtgcgagagccgcgccgagcgccccctcctctcgcgcgagctccccgctcgcaaagccggccccgtgcgccgtcgctcgcgcgcgcgcccgcgtggtttcccgcccgagccgcgtcgtctgcgccgtccgcgtcgcccggtcccgctgcccagccgcgccgcccgttgtttcccacgcgcgcgtgccgagtggccgaccgcccggtcgccgccgcagtcaccctctgccgcgccagcccgcgcctgtcgcccgtgtcgtcgcgccgctccaaaccgccccgccatcatcgccgtcgtcatcgcccggcccccgccactccgcgcgctagcctccaaggggcggaggcagagagcccctctccctctgccgagtcgccccgctccctcctccttttcccgaatcggcaaaggggcgagccccctttctctccctccttttcctctttttctcccctttttcccctctcgccggcgtcacctcctgtcgccgctttggacgctagccggagcgccagctcgccggcttgaccgcccatgtcggttcccctctctcaaaccgacattgccgcccttttaaacccgtcttccccctcccttcctttcctctcccattcgtctcctcaccgttgtcgccgctcccgtgctctgcctcgcctccgccgtccatcgccaagcgccgggagagccggtgcgttcgtggacgcggaaggggactccgggcgcgccctcttcttcctcttccccggcccgaggccggagagatcactcccgcgccgtcggcctctcgtcactgcgccccgtcccgcacggtagtgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtaacacccgctcgtcgccggcctcgctcggcgtagttccgcccaatccgacgctagcatcggattcccgtagccgcgtggatgctctcgccgccgggaattggcccctcgtgacctcgtcgccgttttccccttttcccgccgccggttgccgccgccgcgattcgccgccgtcaagctccctccggcgaatccgagccgttggctcgtctcccctcatcacgtgcaaccacccggtgtgctcgctttcgccgatatcgccgtggttcgctccgccgctcgccgctgttgtccgccgtccgttccggccggcgtcgtcgtctacctcccgccggcccgcgtggcagccacgtaggcgccacgtcggcgccagctcagccgaggtcgggacgggccgaccccggtcagcccctccgtgcgcgcgttccaccgcgagccgtgaggctgcgcatgggcccgccgcatccgttcctccgcgaaccgcgcgcgtgcaccgcgtcccagccccgcccgcgcgcgtacgccgcaaactccctccgcacggtgagccgagccgctaacaagcgggtcccacccgggaccgcgcgcggtgagcccggtccaccggctctctctcccctcccctcccgcgcgcgcgcttgggccgtcttgggccggccggcccgttaagctcggccgagccgctccatttaccttgggcagcgccctagccgcccgaggaaaagtctgatttccatccctcttttcttttcttttcttttcttttcttttccaaaaaggatttaattaaatccttttcctttagaccaaaaatccaataatcttagaaattcaatatcttcccaaccgtaaatctgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctctagcaaggcaagccacctttgaacatcttgagcctatatttgaaatttaattatgttgcttgaaaaatattatgcattgataggatcgcacttaatcttttgtcccgtctgcaagacagattggcggacttacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttgcgaactaaatgaatttccaaaaccgcggaccggggaacgtaccgggtgtacggtttcccgctctcgcacttaaggaccgttttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggcaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatctgcagctgatgggatcagctaggcccgggtggctgtttgaaaagttgtaggcccgggtggccgtttgaaaagttgttggcccgggtggccgtttgaaaagctgttggccgggtgccaaccttgttttaattctaaagactgatacattgcacatacttcgaccggacgagacgcactgtctcatccgtgtggttgagaagcactcgcttagttgtttttagaaaagagttcaaataaaatcaattgcaaaaacaacagccttcccttgaagcctgcattaaacacttaattcccatggcttgctgagtactcccgtactcacccttgctctatataaatatcccccccagttgctgaagaagatgaagcagatcctgctgatgaggagttcttccaggagcaagccggctacgatgagttttagggtttcggcctagttcccaagtcacgcctgtgtgtttggtccaagtcctggcttccgtttcccttttgtaatgcagttgtgagctcgggatctgtccgcagcccaacatgactgtacttctactctataataaagagacctctgttgctgtgatattctgtctccctgtgataccagcactgtttcctgggactggtatcgattaacaggctaaattggagcgtcacgggctagttccggtcgggactagttcggggcgtgacaagttgcaagcaaatttactggcatgtaagagagaaagaggagaggagagagaaacgctgatgttaaattttacatcaacccttagcttgtacggaatacatgataaaaagtaatttttgctgcataagggtgaggaaaggaaggaatgataattaaaaaaaacttttatagattaatgattagagcatatatttgtcttaactattgtaatagggatagtttttaaataacttgtattgcttaggaaacatactatgttctatctttcggggtggggttaggggtgggtgggtggaggcggaaattattgctctatttttttgcaaggttggaaacttgttaacgcgaaacaacgtgataaactaaacaggacaataaacatcacacgaaatacaaaaatattccattgcatgcaagatgaccgtggtagagtctgttcttaaactttcagcagagctgttaatttcagggtgtacatgcagtatgattcagtttcagtcaatcaagaaaaacacttgcaagctactgtactttcggcgtcatggccggccggctttgcatccaagaagaaacatttccatacacgtacctggtgatctggtcgtgatcgagctgatgagaaatgatgaggtgacgctgaacctgaagccttggacgacgtacgcagtacgcttacctgaagagacaaaaacaaccgcccaagctaagatttggtgggggcaaaccctgtcggccgcaaaggcacatacatatatattccatgtaaattacgtcgaaggctcgtagatgcgttggattttcgaagattccaacatgagacgtgaaactctgctaaggtctggtttagttctcaacttttgcttcaacttttaactttttcatcacatcgaaacttttctacacatacaaacttttaacttttacataacatcgttttaattttaaccaaacttttaattttagcgttaactaaacccaccctaaacatacacgcgcttcctgggacgacgaaattagacgcatcctacatgcagaacgtcgtacaatctcgtcaatgtcgctagcgaatcgtggccctatttttctccgcgcgacaatcagccaacacacgcaagatcgatagtgcgccgccttgcgtggatttagccgttgtgattgtggtgaaaaaacaaaagttcattgagagatgaaaatggaagtgcatttccttcccaaaaaaagaaccgtccgtccgttcgatacggctgcatccgagtcacactttacactagtgcgcatttccctggtttttacccccgaaataggcctgaaatgtccctccattttggagtataagctctcaggggtacggacagaaagcgaccgtgctatctatttatactccacgcattcagggctctgcttattggcagcggttgttgcttgcagagttacagttccaatactcctcttgacagagagcacccgtgttagttcgtagaagttgttccttgttagctgctgatggagaacggacgcggcggcggcggcgacgacacgacgaatcggcgaagcaagccggcgccaaagcgcggcggagccctgaagagcatcctcagattactctgcttctgcggtgctcccgcggaagcatagttatgaattatgatgatccatacacgggcgtaaagcacgtagctgaatctgggccgctcaacacgataaggagtacgtttggtatatgtcactggttccctaattaagtatgggtttgttctttccgtgcttgtgaaactaatgttagtgttgtaaattaggtacgctggtgttggtcggtgtggatgagtcatgtctgtctatgtataattatggtcttagttacattcatttgaacgcatgtaatccaaatactcatatatatatatattctcctcatttaagttgttatatacctacacggcttggagacgaaagcacaaacagcgagggtggcggtatcgctaagacgagcccgcgtgagaaagaaaaacggcccgctcggcacagcccaaccatggatcctcgcgggtgggctgagacggcgagacttggtcactagcacggatgcacgcgcgccattgttccgcgcccgcgaatccgcgacgcggttggcgtcttggttgcgaaccagccgcgcgctgcgcgcaccgcggcaaccgtgccgatttgcgttgcgttgcgcggcggggcggggcggccgaatcttgcggacttgcacagttgcaccgaccgagagcgattgtgccttacggttacgggggaatagaaatcgtcgcgcagcaagcacgcacgaaataggggatgatgctacttgcttaattttactttagattaagtttaaactgatgcgggtggtgtctaagtttgtattaaggggatgcatatatggtgaaaatagattaattatagtttaaaaaattttcttaaccgggttcctgggcactcccctaatgtactctagctccgcccctgtgtgcagccccggcgagcatatgatcatttggacgcccctcggctcgctccgctcaatgtggtgaactaaacattagttaaagattatacttgaaatatatatagttctacttaccaatcaaagttcagtaggctcgaactaagactgtctgttaactaagacttacaaatcaaatatatatatagctcgaactaagactgtctgttagcttaaagatttcgtaggctcggcttgagcttaattgagcttgagtctaggcagatgaacttgcttgaactccgccctactctaggctgatgaagcgaaggctatagtatgagcaaatcatcgttgttcgaacaaacttcggtagctctggttatatactgtagtaaaaatgttacagtataatagtcctcgcaatatatttttcttgtttttaatatttagtttgtcctgaaataaattaaactctcgtagcctaaggtaattttagtggtgctttaatatgcagttcctccatcctaaaataaattaaactcttgcatcccaagataattttagtggtgaggaaagtagtatttgtgggtgggtatgttaagggaattgaaactataaaactttttgattcatttgtaagtctaatccctccgttacattaaaaatcaatctagtactatgaatttagacatacatctgtccagagtcatactaaaatatgccacgtccagtcctaggttcgtttttcgtgggatagaaggagtaggtaagaagatagtattaattgatttatttcatgactttgaactctactagtatatggccatgtttagttcacaaaacaaaaacttttcacccatcacattaaatgtgtggacacatgtgtggagtattaactgtgtttagttccacgccaaaattagaagtttgaagaaaaaagttagaaatttatgtgtgtaggaaagttttgatgtgatgaaaaagttggaagtttgaagaaaaaattggtaactaaacaaggcctaaatgtaaataaaaataaaaactaattatacagtttgcgttaaattgtaatacgaatcttttaagcctaattttgtcatgatttaacaatgtggtgctacagtaaatatttgctaatgacgaattaactaggcttaataaattcgtcccgcagttttctggcggaatctataatttgttttattattagacaacgtttaatacttcaaatatgtgtccgtatatccaatgtaacacctcgaaataaatttgtttccaactaaaccgggcctaatacggagcatctgcgcctgtgcgttctgaagcatcttattaccttaatcattgccatctatcattgcagtactagtttgcagcaaaaatagttgaaccgttccaagcgagttgctacctttaaccgtcccaagctaggtgcgcttgtgaagggaacgaacttggcttgccttcctttgttttatttttcttctaaattaagactgcccatactccatagctagtcagaatcccagtttacgcgtattatttgcagcgtcgtgttttgttgcatgcatgccgaccatactagaaactgattaaggacttgtttagtttcaaactttttctttaaatttttaactttttcatcacatcaaaatttttctacacacataaacttttaacttttccgtcacatcgttccaattttaaccaaacttctaattctggcgtgaactaaacacaccctatgccaagttcaagtgcatttaactgaaacaatgacctggtccaggttgcgccttttggcgattgcgcatgtactagctacttgcaaaccaagtttcctcaatttcgtcgcgtgaatcgagggtacatgactcgttaattattcgctgaaattttcttatgttttttcacgttcttttcgtagtaaagcttatattgatatggacaattatatcaagatgatacggttaagtaaatgactatacagttgagtaaaaaggaatatgatattttaaaggtaaaattggttctatggcatcgaaagttctcgattttgattctatagcattaaaagtttatggttcactttaatagcactgaaaactacatccgttactatttttagcattctgtcagcagttccgtcggctcaccccatcctacctctatcttcttcctcctgcgctctccctcctatggttgaccactcttcaaggcatcaggcgagctcgaccatgacagtatagcgctgagcgagttggagccttggatggtggcagctggttctggcatgctagaggcggcggctcttgggtcggtagacaacggatccagggcaaggaggagcgggtcggcactcaggcgagcccgcaacgagcgcgagggtggtgcttcggggcgaatttgagggccgatggatgagctcgatcgagggcagcatgtcggagagagctcaagggcgccgacaataatttggagggctttgcttccgtgcggacccgacaatgccggcgacgagctggacaatgacacttcgggcgttcatggattggatgagcttgaggatgacgcatctaggggagaccgagggcagtgcacgcggacgaactcggaagcggcacggccgcggaggaaatggacctggttgagcacgcaagatttgaacaagctctagcatggccatggcggcgcggcagacgagatcgatcgacgattgcgctgtacgggcaaagctagaacgtggatagatcacacctagcaagcgcggatgaacacagcggcttgcggatgagctcgtgagggctcacgtattacatgacgagctcgtggagccagcatactgtgttcgcaccatggctgaccggcctgagctcctgtatgactgctgtttcgagatgagaaggaagtggaagagggccaccattggtgtttgatctaattttttgttgaaaaataataataagaaaagaaaactaactggagtttggatggaatgctaaacagaagtaacggaggtaactttaggtgctatcaaaatgagccgtaaacttttgatgctataaaaccaaaatcgacaactttcgatgctctagaactaattttgtctattttaaactagccaccttacagtgttcaaaagtaaacggtgcttaagtcaaccaatccgagtacgtaggagcaggagtatatattcaccgtccaggtcctagtttatgcgtatttatatcacagtgttcttttgcgaaatactcctaaagtgtactcacacaacatattcgaccacgtgttacataccataccatggaagacaataaattaaggaatataatgcagctagccggaccccggcattcctccaaattaattaagataagtaattagagtactattaattattgaagtgctcatcacactaacatgctcctccattcgcttccctcgcttcaagctcttagtcccggtcacaagtatagggcttgtttggattgaagccaattatcccctaccatatatagaatttcattcctatgatcaatttcataagaaaataactaaaagacatggtcaattccatagaaaaataagtaaaaagataatatttcttagaaaacttttatttggatcaatctttcttgtggtgcattttcttataggattgaattgaaaaacatgaaatttcgattcttgcgtttttcggtcatacgtttcaaacgagagccttaacgttaagacaagattatgtcaaatttctaaattttcgatcatcaacaaaattttcaaatatttagtttaaaaataagagaaataatatatgtaaatttgtctcagaaaatattatcatattatcctaatattataaaactattagactttgtaaagttattttaatatataaaatcgatatttggaattttaaaatattaatccaattttatcctttccaccaccggggagtgatggttggtgcgacctattctacatatattattgtcactgaagttaattttctatgcatggttcttcatgtacttttcctagtttatatacatcgtgtttggaaagcttctggtcgtgttacaatagcgaggcctataaagaggacgacattggagatgctgcctggaggcatcaatcatccaactcttgttctctcgcttagtttctttggccatctgaagcattaattaatttccagtttagttttgggttcatcatattcagtaatcggtatcagagctcttctaacagtagccgacgatgcagcgtcatcccaacagagtgaagaagagcatgctcagagcaatctgcagctgtttttcaccacccaagacaaaagattgagatcggcgcagggtgccgcggcgcgacatagctttctgcagtctgcacgggttagtacacgatcgggattgacggggattatctacaatagtgctcatgcagtggtagctatagtcacgagcatgtggacctaggtcctaacgtttagtgactactactacatgtacatgtacagtagagaatccatatacacattatgttgggtcgaaatgatgatgcttatgtctgatagtatatataaattatgttgggtagaaatgtcgatgtttttgttcttgttttatgtcatatcgatatgtagtgccgcaacaaggccggcgtggtggcagtccagatagtccatcaggtcgtggtcctttatttgatctgtaatgttgtggagtagtatgatattgtgtgctagttctttcatacatgtaacgtgccatgtagggttgtccatcgatcatcttttattcttttgtaaagaatggctatgtgtttgcaaggaatgtgagtgatagaagaattactaatgtattacttcctctgttctaaaatatatatatttctattatttaaattttataccacaatatgaggatttctacattgattcccacgattcacatcacttccataaatccagagccaatgacttcaaagagaatctaatccattcaaaattttaaaatagaaaactgaagtaacttaagagaaatcttttcaactaattaaccttagtacttgctaaacaacctaaaaatattatatgttgaaatgtagtgagtatttacctccactctcttaaaaagaacatatacatatatgttctatttgaaaaaaaaagtcgtaaaataacctcaaccatttcctttaccatttttataacaaaataaaaaatggtaaaacagaaacagaaactaagccggagccgaaccgcaagctataattaaggctttattagtaacgtcctactacatacatgcgcgtgtaatccaaatagcattttcattttttcttaaaaaaaaagtacgaattacccccccggccgcgaactatcacagtcgatcgaattaccccctgaacaacaaaaccagacatcctccacccccaactatgcaaacccgacaaataacccccatgagcactgttctgagcggtttttgacttgagtttgtacacgtggcgccaacatggcaatccagtcagcaaagaaaatttaaaaaactccctggacccacttgtcatctccctccctcgaccaaatctctcccaagtcccaatccccctacactctctctctctctctctctctcgctcgcttgagagctcggggcggccggctagcggcggcatcatggggagagcgcgctacggttagcggaagggtgcgccgaggagggcgctggaggcctggagcctagaggcagcggcgttgctgaacgttgcttttagcaccctgcggcggcggtgc

SEQ ID NO: 11720 - DNA, 1306 bp, Oryza sativa
ccccccaccccctcccccacatcgtagcaccctgagtagaaaaggcgggtggtagtggcaccggcaggagaggcgggcaaaagagacggcggcgacaggatctaccacctctcctccctcacctccgccactggtcgccgcccccattcctagcctcgacccagccgccgctctcatcctgaacaccgcctccgccaccagccatcgccgccattccaaacgctgaagagagggggtcgaaccgagcctccaaacgtctccatcaccagccgacgagcccccttcccgagtcccgcctctagttgcatgcctctgccaccagccgttgtccctatcccggaccccgcctcgagccgcctccgccacctctatcctgagcgacgcctctcctgcctccgccaccggccaccaccccatcccgggccctgcctccagccgcctctgccacccctatcccgagcaacgcctctcccgcctatgccagtctgccacccccatctcgagccccacctctcccgcttcctccgtccagccgacgcctaccccgagctgaagagaatgggaaagagacgggggagaggaaagattaagagagagaagaaatagatgataggtggaccccacaaatttattattattattgctgactggattgatacgttgatgccacgtgtgcaaactcccagtcaaaacagctcaaaacagtgttagggggtaattcgtccggtatgaataatcgagggtgtaaaatatcttgtatttgagtttaagaggataattcggtcggccttaatagttccagggataattcgtactatttctttttttttttttggcaatacatatagcacgtttaccctgcaactgcaattcacacacgttttacctggcacaccctgttctttaacgtttgcgttatttgttgatggtaaactgcgacgcgagccaccccttcctccgttcctcgtctcggaggcggaagctctgcatgcatcgcggctaagcgagacggcccggccaaaccgcgcgcgaaacgcagcgtaaagcccaaccgcgcgtgttgatatctatggcacgagcccacgtgaaaataccgtccctctcgtctcggcacagcaccacggaataacggatcgcatcgcggccgcgtttcgatcgggcggactgcacgagcccccgcagttcggctgttcggcgccaccgagccgaggtggttgcctggttggtgcgttggcacagcccgcgcgcacgcgcacacgcacacgcggctgaatctttcctccgcgcgcggggcgtgcgcgtacaa

SEQ ID NO: 11721 - DNA, 1705 bp, Oryza sativa
cccatcgcagcgggccgggggagtgtggtggtgacttcctcatgaagccagccgcttttcccaactttagtcttcgccaagaatttctagggatcatacactcgtcatttccatcccccaactctttaccaaaagaagttggcacgccgtgtctcatgtctgtgggggagtaaaagaccgacgattgatttgaatggaagcatgtagcagagaggagatctcgggtccagtccaatacttcggctccgttcttttcagctcagggactaaattttttttaagtctctatcacatgagatgtttgaacactaatttagagtattaaacatagattaattataaaacatattctataaaccttggactaattcgcaagacgaatctattgagcctaattaatacatgattagtccatgtgatgctacagtaaacatttgctaattatggattaactagacttaaaaaattcatctcgtaaattagctctcatttatgcaattatttttattattagtctatgtttaatactctaaattagtgtcaaacaccctatgtgacaaagactaaagtttagtccctacatccaaacaccaccacttggggaaaaattttgggtttggttatcacatcggatatacggacacacatttgaagtattaaacgtagtctaataacaaaacaaaccacagattccgctaggaaacagtgagatgaatttattaagcctaattaatccgtcattggcaaatattcactgtagcaccacattaccaaatcatggcgcaattatacttaaaatattcgtctcgcaatttacacgcaaactgtgtaattgattttttccacatttaatactccatgcatgtgtccaaatatcttcgatgtgatgggtgaaaagtttttgttttgggaactaaacaaggcctcattcataaaattattaaaactgattacttgcttcacgatttgaaaaaaaaatgttttctcaaaaaaaaatcttctactgtagtattatttagaccacttattttaagttattttaagttctttggtaagttacttttcataatatttaatttaccatgcaataaatagataattcacgataaccatcagctcaacaatataattaaagggatatctattgatcttttaatggatttataactttaaatcttgcagaattttttcaagggactatcttgcaaaaattttaaccaatgatatatcccattttaaatgaaataacaaaaataaataatcataaatctagaaaaaatagtgtaaaatctaattttggtgcactgtaactgagtataaatatatgctaactggatataaatgctatctaacaaagtatatatgtaagcttgatatacatgaacatgaattttgatacaaaatcctacgaacgaaagttgaaagacagaaacctaaaaatccattgtaagtaaaatagcaaaaatgtaattcaaagcctttgtgtaatcattaactcggcttctgatcttgtctcggccccatgtccacacttctaagttcgaattaatcgctacaacaaacaacggtcgggccttcacgtagcatccctggccctcgatgttttcttatcgatcgatcctttattggcttccatcaatgcatgcatgttaatacagatttgctacgtacgtagtacgtacgtacatgcaagccatgcatgcat

SEQ ID NO: 11722 - DNA, 16782 bp, Oryza sativa
gaattcctgcatccccacctcacaaattcaccaatggcttcaataatgtggcgccgcagattgaagcagtttacccatgtgcagctggaaacagatcctgagacgtaaccaaaacgggcgccgattgttgagcaaaattcagtaatgaaaaggatggtactggtacgtacgcgagtcgttgtaaagaatcaagtgcatgcatatatatgctcgatcgccagccggtgtcctcgctcggatgtgtgcaactgtggaatgtggaggctgcatatatagctgagctgctgggccagttgtgtttgtaaaggatatcaatggtgaagaacagcaacaaatcatcacgagctgctttggttatgggtaggtggccgttttaaatccttgcagatggttcaagattcgcaacagttgacttggggttgccatgcaataactgactagctgacagtcttagtacatgtgtttgcccaccattcaattttgccactgcacatgctcggctctaatactccatagctagcgattttcatataaataagttagggtcatgttagatttagaggattatctatttagacagtgtttagttcctttaaactttcaatttttccgtcccattaaatatttagacacatacatgaagcattaaatatggatgaaaaaaccaattacacagtttgcaggtaaattgcgagacgaatcttttgagcctaattacgtcatgatttgacaatgtgatgctgcagtaaatatttactaatgatggattaattaggcttaataaattcgtctcgcagtttacaggtggaatctgtaatttgttttgttattagtctatagttaatactttaaatgtgtatccgtgtacttcaaaaaaattttggcacacgaactaaacatggccttcattataaaaataattaatatataaaaataaacttaacagataatttaaaacaaaatggtctaaacaatatagtaggaaaaagtgttttttaagaaaaaaatatcttttaaagtatggggcagataattcattttcaataatctgaaaaataaaagaacaaaggcctagggccatttgaaacaaagtatttaccggattatggcattttaaattgtgttttaagtagttttatagctaatttgttaaaggtgtggcaaattatataaactgggaccaataaatcgttgatcacaggtgaagtttagctcaaataattaagtgatttgccacaactgtatcaatctaaatgcttgcctaacaaacattgacatgtcgacattcgacgtgataaactatggctgtggacagaacaatgtccttaccgattacattgttttatatcagcggggaatgtgaaacatgccaatgaggttcaaaccttcaattcgttccatctcttcgaatcaaggcagtatataactactactcgaagggatgtaaattttagtggaggatcggattagccgcagctctgaacaacatgcatatactcctagatcgaagaggagagaggaattgaaatagctgtcacaagacaccaagcaagttcatcattgtaccacagtggacaagactagtgatcagtagctagtaggataatccatgtgtctaaattacctagtactgtacctgatagcactggtcagtggagatggtgaaaactagaggcagaggctccgcttaggtcgttaggcgcactgtttctttcggctgatttggtgtgggtgtctcgcacatgcttcgccagttttgccactctcgcagtcgcagctagcaacaggcgccttgcgctgcataatcacaaagtctcgcgcgtacagtttccgatccaggacagaaaagctttgggaggtgatagtcgccaataattacatcttagtacaagattctaccctacaacagacaactcggcaaagcggtaaaaaaaaattagcagctctaatctattggtgtcctaggccatatcatctgttcctactcttgtagtactacggcaattcttaattaacttgttcagtgtacgtagtacagtatcattgttgcttcaatttcgccggcatccttttgagtcgggatttgtgactagtgaccaccaaataaactatagtggtaatctttttctgattgtagctatcaaattagacatggtaaatgcgtcaccaaccaagcaaattaacacgtttaggcagagccgcagaatgcactacatagatcatcaagcaattagcacagggcgcaataaaaatctttcctagccgcgctactgagtcccttctacacgatagtaggacgtacggcatgcatgcactctactagctccaagccctgcaagcatgaatgtttgtcacccaatcattaaccgagtaggtaaaggccacggttaaatatgcaaatcaaactataatagggccttgtttagtttcaaactttttcttcaaactttcaacttttccatcacatacaaactttcctacacacatcatttcaatttcaatcaaactttcaattttaacgtgaactaaacacaccctagcaaaagtacagagaaaaaaaaacaaggctacgtttttctcaagatggacgtgcagctttgggtagagacacggcagtcgagctagccgtagttgcagtaagcacacaggcaagtagatatggtccaattggcttaaccatttttattttcttcttcagaggaatggcttaaccattggtgagtgagcatgatggagtagtaaaactgttggaagctagcattaattcatttgcttttgcattgaccattagcagaaagagtgagtgagagagcaagtaaagaagagaagtagcagagcacgcacctgcaaaagaggccacttccacttccaagtcgatagtttctctgtaaaattaactcatgggtttacaccaaaagtcgaatcagcttatggattcatgtcagggctaagtactcgtaccctttcttgaccccctttggggaactcatttctgttccaggcctgattgatctcccttttggaccatgccttttattgatcaatatgtacgtttctttgcttcattagctggttcagaacttcagattagttacattctttaattggtcatttccttgtgccgttgtgcatatagatgattgatgaacaaaccacaccagcagattaatctgtcaatgatcacaccacatatatattttctctgtctgtttctttaggtttaccaaccatgcatgcatggtaaatttcatattaattattgacatttcatatcatcctctgaaattcgatgtttcacatcatccaatactactagtagcttttaagtactggtagtatcttaaatagtgatattgttgtgtggacccttttggtcattattggtgatatgtgaagccccacacttgggttgggcaaaggagtttctgtaacaagtacacagagctatgataagctcgcagttgtccaaggatggcagtaatggcagaagctcaaaacttatggtacagtaaaaaggagaaatatagcaaacacattttcttggcctcgtccaaagattttcatgaaagaatgctaaagctaccggtgctgtccccgtctggtgcagcagcgatacgaacaaaaacatcaacagtcacgtagtacttgcaactcctttttactctccccacccaacaattttactttaccacccctcggtcacacttgatggcattaattcctctactgcaaatgtcaaatattgcatgtgatggcattggcgtgaaatgttttgtgaatacatagaaatagcttatgatcatgaatataacatatagaaagcctcctccttttggattaaatgattttaccagatttttgtaggataattgagttaagtcacgtgaaaattccgtaaaaattcatgttttagccaattagccctaaaagagcaatgttacacgtacttaaactttttttaacagagctcttataaacattgatctaaatcttttgaattaactagatgacagttacaagaaatctagatatatgacatagcacatcaatattagtaagagtttaattaaaaaaaatagtacgtttaatattttttgttctaaggttgtatacatgtcacacaaactaaactataccacattattaacaaactgtctacattgcttttaagtactaatgtactatccatatctatctattttagatcttttgtatctcggcgagtatatggatggacactgttgatcaatttcacaatgtattgaatgcactgctggcaacattctccgatgatgatagaaagggggagagggcaatcaaacataacgaatcacgagaaaggcctagatgcatggagctatccatccagcaaccgcaactttttcccctttgctcttttgctcttgtttattcgttcttttcccattgaccggttgctggctgcctggctcctcctattgatcaattccgtccattcccatccgcccaattcgacacagcttttgttgccacgaaagttgcctcctatttaagccccatcctcatcagcattcagctgcacagccataatagctagctctctcacacacataaacacacacgaaaggacgtaacagggcaaaggagagtaaggccatggccctagacaactaccactcctactacgtcgacgaccacttcgtgctgcctcctcctcctcctcctcagctggattgggattgggatcagctacagctgcacacacttggaggaggaggaggagacgccgcccaagatggcattcatggcgcctttcttccggccatgcgtaagacacacccactgctactagctaccacctcacacacagtatatacgtagactcatgcatacgcagatacgcttgctttcctcttttgcttgcaagctagctagctagggcatgtttgtgtagtgaactagtgagatagtgtcgttgagcttaggttcgttggtgtgtgtagtaggtttggagtcgccggagtcgtcgtcgtcggaggcgtccagtggctacctgcaagacgccgtcgcgcactggagcgaccgttgcaataagcggcagaggatggcggaggcggcggcgccgcctcgacggccagcggcggcggcggcgaacgaggacctgcactgccttcttcaggtaaatgccatcaacacattcatggacaatgtacccgtcatcgaagatatatgatgcatggttcatcgtagattcattgatgcaagaacttgttgcgttttcaggtagctatagtgggtagctagctcggcgcctagacaatatattcattctttagtagtggttacttattactggagcttttttaaaaaagatgaaagatcatgagatcactgaaacttttttgttgcctgtaaaacttccaagtagcagtagtaattaatctcgagtagaacgaaagtgctaagaacataacagagatcacagcaaagtggaaaggcacaactccattgtcgcaatgtcgcatatatgcagtaacatatacttacgtacaaaagagcagtgcagcgtcgtcgtgtctcctcgcagaaagcaagctgtgcctgattgtcttcttcctcgccttttgctctagctaactcgtagctgctgttgttttgttgcttgctcttgccacacacagagcttctgggattccagcagcagcggcggcgaggggggtctcatgcatgaattgaatatcatgatcccggagagcggcagttttgtctcaggtgattatgaatatcgacacgtccttttcaatcggacagcttttactaccacatctaaacaccagattaatcatatctccgatcgagttcttcctcgtcactgcatggctgaatttcttcaggctaagcaacaacagctagagacaaaatagctgtcggcttctcatcacagtcaattatcagcaaacttagtacatctgatcttagtgtcaaagtagttgcattaaaacaacttaggaccctgtttattgggcaggagatgaggacgacgcatcgggttgggagcaggagcagaggggcccgatcagcgcagcagcagcagcagcaacatcagcagtgcaggtgccagcggcgcagggaggaggaggaggagaggcagctgatcccatcctccacaaccacaactcctcgcccgccacctctcgcaccaccaccgggcaaggcgctgcgcagcaactgcagctgcaaaaggcaactagtgcagcaggcgcgggccacgcagcggcagcggcagggcggccagggcgccgcggcaattactcctgcgaggagcacgtcatcgtgggcaaacagcagcagcagccatcgccgtcctctcgtgccgcctccgcgtcgtcgcctcgtcgctcctcgtcgctgacaggtgaggtgaggtggggtgggggtgggtgggtgaccggtgggcaattatcactcgccgcgcatgtgtggcaactgaggcggtggcagggattggggcggggagcagcagtgcttgcagtcttgcagatgtggtttcgaacgtatttgccttgttaaacagtttcataggcatgcatggatgcatggcaggccgcatctattgattgcccccctcagttgttatttactccttcatagtatagcttctataaatgaagagggtttttaagtaaaatgctacatctgtcccataatagttgtctttctaggattcaaaatttgttccaatatatttatcactagaaagtactagttgtcacatccattcctctatattcaaatttcttccttttctacccctaaactactactccactcctaaccatatataccatttaatgtggggtattatagtcttttttctgaaatcttagtccctgctaaactatctagaatgacaagtattttgggacggacgaagtaaatagtcatgttgttactgttcaaccccccttaataataagaattgcatttgttgatgtttatagaagtgtaaaagaaatttcttggtcattcattcacagggaaggagaagagggacacgggcgtgctgtacccgtttgcagttgtcaagccgctggggttagaaggcggcggcgcggcgacgctgaacgacgtcaaccagaggatcctgaagcggccagccaggccggtccggcacccagtcggccagttcgcgtgcagccctgctgtgtacgctcatggactaggcctgtccggcaaagcagttgttagcctcacaaggatcaggacggcaggaaagggcaccataaccatcatcagaacgagagggtgaagtgaaggaaccaattatatggagaactgaacggacaaatgtcttggtcaggaagttaggataataatgggggagttagtttacccacccttgtaaatacatagccacatcctgtgggtgaggagggttcaaattcaccaggatgcatcaaggtatggtacatatggaagactgcattgtatcgttaccttgtcggggcctcagtactgtattcaattcaaccctcttatcatgccaagcataaaccaagatgtatattggcacagcctttaggtgcctgcgtaggaagtcccttatcccggattctgatgaggaagatcggcaatgaactagcgagtatcagcacataacaatcaataaacctgctacgtgtaactgcaaatggaccgtcgaatacaagaatactcgaaagcgctatagcctatcggcctctctccaccatcgccgtatcgcgtgggcgtttggctaggagtataggacgcaggcatcacagcagcggagcataacaaataaagagtaaacagtatcctacgagaacatggtatacaactatacctactaacatcatttgctgcagcagactcagctaacaagaggtagtatgcacccctcatctagcaaccctcttttgtaattaccgagtcatatttttacggtagtttcttttttttttcaaaaaaaaatgtgtcacttcaagcattgtacacatatataccacaatattagtatattatgttcagaactaagctttccttctttccgttttaaaaaggacaagcatcgtttaatcgcagaaagatgataaatgaagacatactccaggcttttgattgacgctagggtactgcataaatacccccaacctgctttcacaaggagtaccatgagcaagtgcagtaagaaaatgacgaagaaactaaaaaaacatatttgctgtaaaatacagcatcacttgcctgaagacgcagtaattttttatttatcaactcgattctctgccagcttttgatgttccattttggcaagacaatttcaactttatgctgccgctctatgctttcctccatcattacttcatattgacctcttcctgcagttgtgcccttccaagaagcatgagccaaccaaatacaaggattggagtgaccagacacaagccgaacatatgtctccaggaacagaaaataaatcacattaatatgtcacgagattgccaatctaaagatgctttggatgtacatcgtgtccagatcacattccatgcgacataaaggttcctgagcaaccgatcttgagagtccaacaattatgagttaaaagatcacatgcaaccgatcttcagttgcaagatggaaccttgagataatatggagatctcgaattatggacaaaaacagggatagctgcatcacgtatctgtttcatcttgcaggagtatctcataaatgtcagttcgaatgtgcaattccttgtcacgcattacttcttggagatctgacaactctttcagtgtcaaaattgaactcagtttttcaaatccatcaagccataatcgtttagacctgcaaagtgggatgtcttgttatgagtgccaagttccaattgtcattagtttggccatcactcaagttacagtttaaatgtttaatattagaaaacaatagcagctaaaataacatgaaaatagaacttgtgtttcccaaacccacaattaaagatggaactttttgataaaaaaataaaaaagaaaaggcagaagctacaagttccgagttccaagtaacaagttcatagagcaaccatatttgcaagaacaccaatttactgtcaaagcactttcttccaaaaaagtgtggttatttaaactttatactctattgtacatttagctatctgtaagggcaatagcacaacaaagttcaggtgcccattatcctctgatgagatctcttctgtactctagtaatatagtgtaagtataagatacaaatgtaacaaaaaacatataaatgatctttgttccaaattggctacataaaaatagctggatatagatggatgatagaataagcaatcatgtaagtataaccagagaaacatcaaattgcgacaacatatttcagtaccataccatggacaggcatgtatagctctgaagaacacacgccgagctgcagaagcattgcaagctatctctgcctcataagctagataacagcgccacaacagaacggatttctgtaacttatcatcagtcagagctctctcaaacagattgtgtattctattgtctgatccagctttgcacaattcaaaggacaaagcaaagagcaagccaattatggaaggatccctgataaaatcaaaagacaaagagcagtaaatatgcaatgcaataccatgcgcacttcagaagatatttttagaagagtgcatgcacccaaactggctacttaaaggaaaaaaaaatacttgatatatactgtttactgtgtcaggaagttcgcaggttacaaatgtatctctatatactgtgaaaagcatcacaaaaaaatgtattgctaaaggagaccaagagaatcattagcaggatcaattacatttctaccttattacacaatatattccatatttttgtcagagaagaacaccatagcatgtaataaaagcagtgtgttatggattttgtagggaagagaactcacctttgattaaatttgtcgagtgtgagacgtagattattggaaacactgtaaaggcaacctagagttaacatggctgcatatgattttgggttgtacggatatgtttgtattccttgcgatatttttggccaaacccttgagagactcaactgattaagatttttctgaagctgcttgatgtagtgcatccacaattcttcgaattctaagctatggttgttctctgaaaaatcatgataagagtatgcttaatagattgcgaatttgacagatgagaataataatacatatttacagacatagaaaagcaaagtaaatgaaaaggataaataaaatcatgaactatcaagcactgcagaaataaataaatgtaagatctacagtgaaatgctagttaatttggactatgggtggagacttgtgatccaaataagcttgatacttcatgcaaaatcttggtatcaaaagctgtagttgacacctgagcagccttgggagtactagaaaggagcttgtcacttccagtcagaaaataggtatgtttattgaagattgtaaaatatctaagagtttagcaagatacatgaaaacaatttcaaatgtcaaactaaaaaatacgtctaacagagccctaaagacaggttataattcaatagttagcagatggtagatagccaatatataacaattaaaggaacagaaaatgtaatggcttagcatgtggttgcttttatgatcagtatctattagactatcactagtacttgagaaaaaagtatgggaggacaaacaatggctacaatttgtacaaaagtcaactcgccccgcttatagataaataaacatacacatgagctaaaagtaaaggcatgagtaattatcattcagattatcaagaaaaaggtgctgaaggatgaaatacctgaaggtgtcatataaaaggtctcttctataacttcaagaccagaagcaaaaccagatgtcatactctcaaacaaagatgctgagcagattagagcaacagactcttctttcataccatcacttgcaaatgaagatcgcaagcttctaatctgctctttaaatccttgacgagcctttaacacctgaggtcgtgatatagacccatcaaaagaagcatacttcgccttgtcccctaagcaggacagaacgtggattgcacgatccacagagtcagaattgtttcttgaagcatatattgctagctccatctcagcataccaaaaataaagaataggaaccttcttcctgagatcctgcccaacgaaagcagaagcgagcataaataaatgtgctagaatagaagactatataaggcacattgttgtgctgggaatagagccctgaaatcaataaaactatgtttgacatagctgaccaagtaccgatgtggtgtttcctttccaataacataaactgctcaagacaattaactacgtagtatatgctttcataaagttgcttgaaacctattctaactcaaccacgagattgctgctagaccaatgtgagaaacctgaatggcaaaaatatgttagccaattttcttgcaacaggccacatcaaaatgattgtctattgagaaaaccaagtgtcacaatgtccactctataatagtagctacccctaacataatattgcgaataggttgagtagttatagcatgtgatctaagttggtgaccattggtttgtgtccatggtggaattgaaaataatattgtgaaaacgagtgagtacctctattccaaaatagaggttccctacttgccataggaggtgcgcagtcaaactttcaacactttcaaaaaaaacttttcaaaccttaagcactaatagatatcatgttattgtttctcacagtaactaattccaggcagtacattttataatgcttatcaatgtataatgtaaaagaagggtataattgctagcagtgtgtcagagaaccattgcaatatacagaactacatctatattggaatttggaagggaggtagtgagtgagacccatttgacatactgatctatatttctagcagcattggcacattacaaagacataatgacaacattgattgtatttttggatctgaacatactgattcatttactttatggttttacctctgaagctccttgagaagttgatagtgccaagtcgaatatatgccttgctttgacaaagtccccattcatagcctcaattcgtccatatattccacaaagcaaaagatcctacccgaaaaaggtgacatggttcagtttttttttcttatttcaaaagaaaagagcgtcgtgctccaagtatcactgttaagaatatttactgatacatgtagtgcaggtatataaatattaaaaaaatgcacacatggaactgttggaaaagcaagatccaaaataagatgaacgttgaaatactttgagctagttaaatgaaatggatgttattgaattgaagagacatgtctcaatctctgaagaactcagtttgattttggttcccaaactgcatgatgcatccagtctaccaagagacgcagattaaatacaatgcacgtattcaagaaaacataaaatgcacaactagctagcttaaaacacatgaaaaaactaccggtttctgtatgctcattgcacaactaacgacctagttttcacctgttatgctactcagccaagtgatgccaaaaatacggaacaaggcatacctgtctgtctttcttcaatagatttttggccaaagcccgggatgcggtggctggagtagccagatatttttcttgagctgtatgaatttggggggtaacaagaacagcttcctccaggatatgattacgagggaatacatcaagggaaaagcaatattgcatttttcagaaatttcgcagtgccaggcctttgagaaaattcatgcatagttcctaacaatgacaccattttattatgaactgaagtttggttcttgtctataaggttagacaccgtactaagatcttcctgaatgtcatctgtaatcatctctaggctcaaattcctatcaatccaacttgaactgttggtggatgtcctggaatgtaaaaatatcctgtagttaactcattggtacacaacaatatgaaaatggcaagaaacaaattgtgaaaagtaacaacttattcatagtgcaacccaatgaactgctcataattaatacagatttttaaggcacataaaatgaggacaaggctgatataacacatttcacatctcactgccatcgtctctgttttcatcctacatgtccaaatgtttgcttgcaaggactataaactcctgggcagtaataccattaccatctattttccttaatttctggattcaagtaaaactatcaacatgatcagcacaagtctaaaattaagatgcacttgccatgttgaatcatacacctcattatacagttacagctatcattagtatgttctttcaaaggcccatatagtgatgatcttaaggaatacgttcacatctttaaaaaatgagcaataatatttgctgtttcactgaggtcgaaatgccatttttattgtacaagtgctagtagactttgcgtacagagaatgacaacagcttatctgaaaagaagtagatgaaattaccatctagaaatttttccaccatagaaatcaatgaattggcatatcaaagaaaagcgagcctcttcagaagatagagagaacaggaactcagttatatcctcaaacaaaattactctggaaagctgatcattgtcttctccagttggagcatcatcagaataaagtgatcctgtccatgaaaatggcatccagtgtaagtactgggttagctaaaaaaacaatgtgatttgtcaatctacaaacacaaggagaaaataacgtaccaagtttttcatgaagaggcatccattgttcattatcccttgataactccataaatgaccatctattccacgtttttggatctttaacttcactattgtaatcagcatctccatcaatcccaagctttttcagcaaagattcaacatcttcttgtgcagatgggtcctcatcatctggattttctgcatcatttccatcagatgtcgatggttccactttgcttgtttcactattagtccttagagaaggatcaaaccaaccactccaaccacccctttcagtttcttgggtattttcttgtatatctatattttgtctactctcctcatcttttgccaaccatctggaccatccaagagccccatcttctccgattctagcaccaccattgttccagaagtgctcaaagagtctttgcttactgcttgtggtcagatgaaggggaggggagaataaactaaattctatttgagcctgaaatagtgcagttgctaattcccgatgtccagtatgccattcgaaccgacacaaattcacaaatatatccactagaccgagttcaagatgaattaaggaagaatacttaggttcgagacgatcatattgtgtatcctgtgaaaaaaagaaagaaagaataaacatcagaaaattttaactcgctaacagtgcatacatgccgagagagggatagaaaaaggggagggggagcagataagctgaactatatacaaagaaacactgaagttgaacctgcctacatagcttagtacaagctgcagataaagcctgtactgcataagcgtaagacttccgtaggtcagatactttgaatctggagaattccccttgacacagaagtagatactgtttccacaacttacaactatccgggtgtttcatgagtatctgctcccatttatccaggagattctgggtgctatccctctcaccatatgccttcagaagataaagcaataattcttcattatctggattaagctctacagctttttccaatatactaatttttctttcagttgtttgcaaacgggctgctttctgaggttgagtactggcaactttatcctgtaaaaagtagcagagaaaatttcttcagtggatttataaagagcggacaaggaaaaggttgaatgaagaaacattatattaataaggttgatatcttagaactctctatgtaactactaatgatatcccataaaagtaacaacaatgtggatcacactatgcactgtttcacaaaagaaatattataacatcagacaaattggtaatacctggaatcgggcaaagtccaaccaaattttctcattgtgagggaactcccgagacatcttgttgaattctcgtgtcctccgaagtatttcatcttcccaagattcttcaagttcctgttccccagtagtgttattttcaggaagagatggtatccctagggggataaaatcttctgggagaattgcagagttatcctttttcaatacttttaggtgtttgaaacccttatttctttctacaactgcatatttcgccgagtagtagcgacctccagctcttgctttgctattcagtccatctaaatctgactcatgacccatatgtaccgagacacccaagttatgaaacaaaagccgttttagaccacgtgcctctggcatgttttgagacttgtagcgtgcaatatccattctgcataattttcttgtgtgtcaaatttcagtaaaatgaaaaatgcatctacagtcaaactaaacaaaaatgaagaaagcagaaaaataaagaatcaactcatgaaccaaggaaaaaaatggaaagtcacaaaatcacactaagcattaatattctggccaaagcatgatgtaagctgattcattctatttaaatcagatctcgcttttctcaagacgaaatcaaatcagcccacttaacttcaaaggggactaaacattaatgagcttcgagttcagtaaatttgcctaacagtttcttgcaactcaattagcccagaggcttttatttatttccctcagagatcacaacaaatatgtttaaacaagtagctatgaatctaggaaaacaaacttgatactgagaattctgatgatgccctaaacagaagcaagcctgcacaacatctaacatgccactttagcagctagtctagcacaccttcatggaattgcgcaattaacataaacgcccatggttttcaaatggaacctgataccgcaaaaatggaacaaacccagtgcgtatgcctgattattaacttcagatgacaatgcaagttcagctttgctacacatttcatatgcaaaaacctgacctgtatatcgatccaaacgccaagttatcctggtcgcccttggcgtcgaagtagtaatccttagccaacttcgtctccgacccagcccaagcgcgaacccccggctttcgcgaggcttccgcgctattgtaccgctccttctcccgcctccgcttcctcctcttcctatccttccgtctgtccctcctctcctcgtcggaggccggaggcgacggtgagtagggcagcaggtcatacttagcaggtgcgggccgtggcgcctcctcttcgtccgacgaggcgcttagcggcggcggtacggatgaggaggcagtggcggggatgttgagggaggaggcgtcgaaggagaagctagggtttgagagccactgggaccccgccgcgggggcggaggattcctcgggcgcccagagggggaagagaggaaatagagaggaggaggaggaggagcgggcggcggctgtggtgggagcatgcggatcgccttctccgccggcggcgaaggcgggtggcg

SEQ ID NO: 11723 - DNA, 8376 bp, Oryza sativa
gtgagagatcgacagataattgggggcataagttcacttcagatcccttaatttgtcgccaaatctaaaattcatgtctaagggcctgttcactttgatgccaaaaatactttaccaaattgccaaaattttggcaggatttcttatatagttaccaaaatttggcaggaaactaaacgtacacatatttttggcaactttaccaaaatttggtaaggttgaaaatggcatcaaaatgaacaggccctaaacctctactccctccgtcccataatatagcaatctagtataggatgtgacatttcatagtacaacgaatctgggcaggccgcatgtctagattcattgtactatgaaatattttatctggtcctaggttgttatattatgggacggagggagtatcagatatgactgtatgacgcgtccctcaactcctaaaatcagtgaaaacaatatctcaagacggttcggatgatggttttcggttgaggttgggtttaaatcgtttccttaatcggtactccctctatctaaaaaaagccaacctgacccctcctagtcctacgaatccgtagtactaggagggtcacatccctttttaggttggctttttttgggacggaggaattactagatataatgtgttgctcaacttttaaaaccagtataagcatgcgttgctcaacttttaaaactagtataagcaagatctaaaggtggctcggacgacggttttaatgtctggtttaacttgatcctcgtcccacgcttactttctgttgctgcgttctggcactgtccattgcgagatgttaaaaacacgaaaggcgcacgcacggacgcacggcaccaaatgggcagcaaccggaaaacccgaacgatgtggctctcgtttctcgcacgaggaaccgagacatatggtttgtcttcatcgtcaggaaacgaaagcaaaacgcccgcacacagggcaaactcatgctttgattcacacgcaacaatcataagacggttcccatggtgctgtgccgccccatgcatgctcaagcattcttcatcccagaaaaacccgagctcttttagacctacaaaaacatggatcgagaggcaatacgatccacatcgaacttagattaatctacagtggagcgggacgatgttgagcacgagcaataggtcgctctcgcttcctttgacccctgtgtgcacgacgttcgccggtggcgaggaggacggcgcgttcacggagaaacagcgcaagtatcccatcaagatgaggcggcgcatatgcgcgagctgcgggctgcgccgcacggagcaccgcgccgacgccggcgtcggggacgagcaccacctgccgccgcgcaagcgtctcctgctcaggcgcggatgtgcaaaagaggaggagccgcagccggagccggaggaggaggtggagacctggagcggcgacgcgatcatcgtcacaagggggaagagagccccgcggaagaagcgcgacaacgcgccttgagcggcttgagctctcggggtcgtatctatgcgtgcctgcgaatttgccatctgccatcctacctgaagtaatattgacgaccatacagcaacagcatgtttcctccaagtaaaattgagaaacgtgcagatgtttttttagataatggaatgaaacattccagcctttgctcatcagagctacagccaattattacaaagtatcgtagttcaaaatgaaattaaacacaccaacaaaataaaagaccaaaccaagataaggagtatacatttattcaagtctatttgtgaatctccatccatagtttgcaaaaagttgcattactgtcgtctcaagcctacgacatgcaaccttcatatgctctccatcgtgcagatgtacatttgcgttttgcaaggaaagaatatgggccagccaatcgtgtttgtttcccaggatggattagcaggatcagcttcattcagacaagaacagtgcaaatgtgcaatacatctgaatgcattgcgataacatggtgtcctgacgatatgcggccgctcaagcatgagctgtagtgctgtaccctgtaaggtgtcaaaactgtagtggagaacaacatccatcatcacatcacattttaacaagattggtcattgcgcagggagttttcagttgccttcctgcaaatattaacaaaaatacatatcaaggacttgttttacatcatattaatgcaaattcaccacattatgcattagtgagtaattggcatatagccaatactaaacaaagaagatttgttactaagaaaaaggatcaacacagccaactcataaagaatttagtgaatgattaatatgcctgtctggcgaatattttttctattcatcagactcaaccatcttagaagttgcaagaaggtagcagtaaatttatgcaacactgaacaacatgctgcatacctctaatttggacttagcttcagattcacatgccttgcacaaaatctcatagtttttttcaagcccaatctgtagacactggaaggatcacgatatgaacatcttaatcaataaaaactatagtttataggcaaaacaataccagtggatctactcgtgatggcgaagtactggatattacatatctgcaggataagagttacattgaaatgtttcaaccagcagtcactgcaatattaacaaaccaacgataaggtataaatttagcataaataaactgtggaggaaatattcaagcctagcacttcacctcaacttcttgtagaaagccatagcaaggttgttagctttctgaacagttagcatcactgctcccatttggctctgcatgtacacgccatcaaaatcagctgatccttcatgctgagatttcagatagcaattttatgctaaaaaatgtacatgataagacagatgaaggaataagaggtatcatagaagaatataagtacgcataatatttctggaaatatgtacacacaaaattgagcaggtcattttagtaaaccatcagtaattgttaaacaagtcacattaccttacaagctataagttcaatcaattccattagaaattttcccagccccttcccctgtgcagaaggcaccatctgtaactcatagacataaacaacaggaacatcttcttccaaaacaaatctgtagtgtacaaaaccaatcaagcgatcttcattacatgcttcatgtgtaaattctagcccggaatcttgcttcataatattttgggtggtaatggcatttgaagattgccggacaaagatatatcgtgcttctggggcaaccatttcccggcgcttaattttctcttctgaaggccattctggcccatattgtccctccatgttaacctatattattgctttctagcattacattcaatatttatggggaaactgtaaaaggaagatatgcaaaatatccagcagcactaagagcaaaatgaaagagaaatatatgtgaccttgagaagattttggatgtacttccttgttgataatggaagttgatttccatgtccagactccaagtagaccaaaagacctaagcataaaaaaggtgagattgatataatgcccacaacacacatataagaaaattgcattgtactgaataggacttgttagggcctagtgttggaattatagaggtaaatttgacattaggagttttttttcctttcgctgggaatattaatagtttctacatcatgatggaacattactagtcctaaggtagtgaattttgttcaccaacagacaatgtaggttaccatttctctgatacttatgaaaatcaggaaattgcgctagatgatccttcacggctacagctttcctgataagttcttcaacagccttctttctccccaatatctaggcaaaggcagaagattatctgaatgagaccctgatattagatacatctccgctattactcctcaaatgctacctcggtgacaggagtgacaaaccacccaccaaataagtttaaaaaaagaacttttgacaaaaatctagaggttgcaacatacgtattcaacagaagaacacatgagtctaataaagttgacactgcagctttcgcagtttatgaaaataaaggaattcgacacacttgtagggtttgaagtgcgcgctaattgaactctgacataaccaagtgccaaacaccatctactaaaaaaatacacaaaatcttatcagctattcggtttcgcggaatataaaacaaatcgtatcagccatgagtaatcgactacgggtagggtgaaacgaacgagctatcgatactggccccatcaacaagaggagaggagagaaatataaagacctgcttcctgctcggcctcttctccacgccgccgccgccgccgccgccgcttctgctccgaggcctctttttctccgccgtcgccattatcccagcgcttgctggccccgtgtcggactctcgctcgggtctctctctactctctcgcaccgtcgcccggccgccggatggagggggagatccctggggaagaaaggggcgccgtgctctacagatgggtttgctaacttttggcccaactcggagagggattgttttaggtgggttgggccgattctagattggttgagaacttgagaatagggttcacattttcgacaaaaacatgtcgaattccatgatatttcgacgtttcgacatgactcggaattaagttttgattgaaatttcgaaggttaaacagtagatttggtcaaaattcagtcgaaatttatcgataaccgatcgaaatttatcgaaaaccgtgataccgatggggctcgaaatttagtggtcaaccggtaatgtaaaccctgagatgcatgaaaatctcaggattaggatgccgtgccataatcctaaattcagaggaactcaaagggactaaatccacgaggtttttgcaaaaaagtgttgtctggtaacattatagaaaagcaagtggacttaggcccccttaattcaaaggaaaatcatatcaattttgaaggatttcatttctatagaattatatgaagaatgtctcattccatgcaagttttggacgaaaattaacatgagtagaatctcatggaaagtttcatttgtatctttatcttttctcaaatctatatggtccaatcaaatgatcattctatgttttgcaattctatgttttatacttgtattattatctgaatcaagtatttttcctattcctccatttttttcatttctataattcaaagagtttttctccaaaattcatatgaaataatcaaatgatttcggagaagccattcatttactccaattctccaaaggaccatgtgggaaatttttctgttgaattttagtcctccaaaattcctccacttttccttcgctccaaagaagccaaacatatattttaattgatgggctggtagcattttgttttcttatgataaaactaaataaagtacggctattcatacaagggtcaaagttctagaataggaacaggcagataaaaaataacactatctttatttgtttctgtctaatctgtaagaatactcaaatttgagtcgtttaaatgggtcggcaatgaatatttgttctcgagtgacgtacagcagaattcccaaacccttgggctccaccaaccgttgggttgtcttgttaggcccataccagcgatcgagaaatgaacgatattacagggaaatttcggcgccaccgactaatggtaacaagtttcacaatgattagccggtcactacctgttctaatgaccctgcatcttgactgaatccacccccatgtattttgccgcgagaaatcatgagcaggtgacgaatgctcatgcgccatgtgtgcatgtacagacgtggagacaccttggattgaagccagccaggtcaggtcactgtcacctgttcgctcgtgaaagcaacgggcggacgccgtgatcccgcgaaggaagctgcgccgaagctgcaggtgcaggtgcccaagggctaggatgcagacaaacagcagccaatatccatcgcacgaaatgtacgggcacacacacccgaactgccataccggccgacagctataaataaggtaatcagagttcgtgcccagaacagaagccatattcggaaagaaaacacctcgtctcgcggcgctcactcagattactcacacatcccacggcggcgtcggtcgtcgtggactcgtggtgcattgatccgtcctaatcccatggctccgaacgacgccggcggtgtcgccaaggaggcgccaggaccaaggacggaacgcgcccgccgcaggccgccgatgcagcgggtctacgcgttccagttcatgctgcttggagcgacggccatcattggcgtgtacgccgagccggtgtcgtcattgccgcgcctgttcctggcgcttgtgatttggctcgtcgggtacctggcgctgttcatgggaatcatggcacgggattgacgtaggactgtaaaaaaaaaaaaaaaaaagctcaaggctcatgagctgctcgagcttgactcgtcctaagttcgattcgagctcggctcgagctcctaacgaaccgagctaaagcctattttaaagttcgcgagctttgtcgagccgagcttgagcttctagattttttttattgttatttaataaatttgtagatcaaatatgttatttatataccttgtattggcatcatatatttattttattctttttcctcttctacgatagatcataaattaattatttttaaaaagattatcctttaaaatatatattgttctaattaaaaatcaagctcaagcttaaatcgagcttgtttgaaaggtcgaacattttatagactcggctcgagcttgtatcgagctcaagcctagacaggcgagctcgctcgagcttgcctgttgacagccgccttgacacaccaagctagcggctgctgctgcttttccaacctgaacaatagtataggatagatattgtcggattacactgtaggcgatcaagattattgacccgaaggcacagtcaattccgtgcaagtcccgcggatttaactgtggatataacgagttcgagtccttgatgaactagtcccatcacgtcgagctgagaagtgcccagtggtcaaacagttctgttcgtttctttggactaagtactactactccacctagaatttgaaacggaaggagtaaagcataagagggcagctagcccacaagataccgtggaaaagtgatgtcacgggataattaaaacacacgacaaaataaaaaaatggcgtcccgtgtccctgttgtccacgtgaagaggcacgatacctagctggctcttcctgatatcgcgcgcttcccttgccggcgtcgtgttgcctttgcacctggagaagcacacacctcctcgtcggcgtcgtcgcccctaagcagcgggagcagcagacaactcccccgctaaatcctcctctttgcccccaccgacagcaacaacaacagaaggagaagagaaacgttgaggagaggaactgaggaagggagaacagaagaggaggcaacgaacgtgtggccaccggtcagccaggcggcgacggcgtgctcccccttcccccacctttgaccgtggtaccaggtacaataggtatcaggtgccaggtggtacttgataactataggtatctagtacctgataccatgcacatggtacccatggatggtacctaggtactaggcatctggtacctgataccatgcatatggtactgttgacgagaaaatcgaacacatcggctgagagatttgcttagctcctgtgcaggtccaaatcttgattagatgcgagcgtgccagtcagtttgatcctgcaactgacaagatatgcaaataatagatcaaaacagtcaatcggctgacaagccgatggaatagttccagccgatagccgataatagccgatgccgatactagccgatagcgatagggtgtaagcaatcggctatatgtccaatgtagatgatgatataaaggcaatcggctgttgataataaaatataacaataatatagtccagtataaaccaatcggcagataatgatatgataaataagcatcgatccgaaggttaaagcacacatcaactggaggtccgatgtcatgaaatccacaagattagattaaacagtgaaacctttgttgtcatcggctaaatccaacttatatgtatatgcaatccttatgagccgatgcaacgtccagataactcaccggctgaaaccccgatgaaacccttagtggcaatcaaaagcaggctagagattatggttcta

SEQ ID NO: 11724 - DNA, 7156 bp, Oryza sativa
ctcggccgccgaagacgacgacgacgatcccttccttctggctggcttcttctcagccttctcggccttatccagagagagagagtgagtgagtttgtggaggggaagggaaggagataaggcagagatcttatccagtttatcccgttgtgacaggacaccgtgtagtagattttctgaaagcataaattagtgttgcatctctcggtaatgacttggatacttagtattataaaatacagcctattgtacttttgtttggtcgctattgagtcttgatgtcatcttctcaatttatgtgaaatctctttgcaaaaagttcttccgtttctttctagagtaatgactggtacagcaatctatgtatcgacgacctgatggccaagggcagacaacatcaattgtcaacgatgcagctggcattcgcaacttgttcagtatcatttgtcatttgagacgagagcgtatcctggtatgaatatccagggacaaataggacaccttaaaatacatgtacacctctgactactcgctacactaagatatgaacaagaatttgtctggcttgtaggatcggcctgcctcaggctgctagcttgcccaaaatcgccgtgtctagaattttcgtctgatccgtcgtctctagaccatccaccttcacaatgccatcagatccgtcgactcccagcaatttccccgtgagtccacgccaagacccagacattatctttagcttgtcgttcttcttaggcttgacaacctcaaactcgtttggaaaagcagttatttcatccccgctgcctgacgacccaagtgcgacgcggcaagatccatcctagagtttaaattcaaggatgtgtcagtgtaggaaagtgaaagaagaattaggggggtcatcttgtagatgtaaaaatagtacgcaccgggaggacttccttaaccacaccgcaggtggtatcataaccttccctgagcacattgaccaaaacatctggtaaaagccagttcctaccgccctcctcacctgaaagcagtttgggaattagtacccaaataagtgcatccagagctctagatagtttcgatcaccatccagattgactgtagaatgcattttgctggagaagcaacgaattcgaaggataaaaatattacctatggcaggagacattatatccatttcaatataacccagagtcatgggctgaccaccaggtgtgctcgggagatatgatgcaggatttggggtcattggttgcccactaggtgttggagttgcatatgagcttggattttttccggaggcatcaccgaaactaactccaggtgtaacagcccatcctgacccaggggtgggggcttcgtgtggctggggaactggagttcctggctgcaaaagtgaaatgtagaggctcaaaaacttaccattgattgccaacccaaagctaatctacagaaaataaagagcagtcaagaaatagcataagtgcatgacgaacttggtaagttgggctgctttcccaagtgacagcatcttcccagccattcctgtaataattgaattagtcaacaacaaatctatataaaataaacttatactagaattagctcgcttgcacaacataattcattttcattataaaactaaattgcacataatgtcagcatacaaaccttggtggactcattggtgcccatgctcgactaggcataggagttcgcattccattaggaactggtgttgctgtaaaagacgaacaccttgttaatatgtgtgtgtgcaagagagagagagaaagtaaataccatttatagcatgaactgcataatattttcgtttggccaacgacacaacgccagtcaaattttacatcgttcatctgaattacatctatcacacccatttcgaagtgcttcctgataagcattcaggagaggaaaggctccctccaaaaaacaacaccaatcaagatacaaagaggtgactactcatatagtttaagttgattaaacagtagagaaatgatagccattgattatgctgctaaacagtacagatgcactagcctccatataaatcttccatcaccatctgagtactcaagtactaagtagcaaagtctatccgcattaattttttacatattgagtagatgacataaagaaaacaaaactacaaagtagtgccatggaattagtacttctctccactttacatttatgacattatagataaacctcccagtctcttaggacccaaaatagctacattgggatcataatacaacatttttgttacttcttagtaaacatattctgatatttagcagtcaaagttgcttcggttatgtccaaaactacatatttgtatacggaaggaacaaataagtgatcttagctgtcttaatttttataataaccataatgcatgtaagatggacacacctccagggtcccgcaatggagtctgaaaaggacgcagtggcgttctagatgggtgcacaggtgtttcgttgccccatgaattatgagattcactgtcgatacaagtagtcattaaatgaaatcaaacagctttccaaatatacggacaaggaggaagaaatttacccgaatggagttgcaacagtagctgtgtcagcaatatcttctctcttaactacatatttgaagcaagatagttttaaaaatcagaagcaatagtggggatttggaaggaatgcagctcaggaatgaaagttgtagtgtgtccgcagcgattgctgcatgaagaggtgtactcgttgatctccttttattgggacttgcttcccttcttaatacaaatgcgcgcaaagttcccaccaaaaatagaacaaatgacaacaaagattcacctgcaacaaccttcataagtgaatcaagctccattcttacaagtgctccgcgaattactttaacacgaccacgatatcctttgtaggggccagatttaatcttgatacatctattcaccagggtatcatgccctttgccaccatgatctctgcctccaaaccgtctgccatctgcattagataggaaggacaattatgaattggtattgctattgcatttagcagagcaatgcagcctaaataaaaaaaaaacaaggagctgtgcagataatattcatacaattagtatgaggtgctttaggggggagccttcctggagattgcaaaatccttgctgaagatctaaaagcaccaaatcgtggatcaactgtacccataccctgtatcagagaagcaaaatggttaggaaaatcttccaagacaaccaacagaggtaaatagcttcaaacatacatttccgcggcggctaccagttgatcccccaacaaggaggcatgattgtgcgcttgcacagataaagcctgaatgttcaaggtggtgacgatcataaataaaaagtactcctctgtgtatatgttccacagacccttgctttccctgttgtgacaaagtgtattagacatatagtataatgggataatgtaataaacatatattctgacagaaaaaaaactaaaacagaatataatatgaaaagctaaaaacaaataaaataaactgtacacactttacaagctccttcaatgaccctaacgacatcctttgttgacacgatattactggaccgatcttttgcagatgttcgccgataaatcttgctttttatttctctgagtttcacaagaactagttcaggtttgtcaggctctcccttgagaatctaaatgcattttgggggttagtacacaaaaaatatgggaacaaaagatcattaggcatacgtgaaatgttctatacaaattttcttgcctgaagtgcttctttttccacctttataataacaccaaaagataagtttctgaaaattgaatgggaggaacattgttattacatagccgttcaatgttgtaagcaacaacaatggctcattagaaattctgagcttacccaagaagtacaagatcatgcaattcataatcaccaattctggtaagcccagtggttacctcagaactctccacaacatgatcagcgaacacacggatctgtaatcatataaacacatcagaaagtcaaaagcataatggaagtttatccaaatagtttcttatacttatgtccacgaaaattccctcacatgctctttagttgtgtccgacaaaatgatcaaaacatggccttcaactttaactaccaagcccgttgcaccttcttgaacaccagacaccacttttacatggtctccaggattgaaacatttgcagagatccccctcattgaagacaagtgtgttctgcaggtacacaaagagatgtataaattcgtaatggctacattgaaaatgacatgaaaattccttttgcaagtaattaccagaagaccaggtaattttgatcggatatgaacagtggcatcctctgctttctcaacatagccctctaagttcttaagatcacctttaataacaataacagaatcacctttcatgaagtgcccttttttcctatttgtaaatagggtggacaagctggccgcatcctcatttatgtcattatcaggttccctgaatttctccagttcatcaaatgatggctgaatattgtgtgcgcttattgactttattgaaaacgttttgtgcaagaaaccatctttgaattttaaaccatcaaccatttcatagtattccccagagtctctattcctcctccggtcaacacgaatgttcatctccttatttacaatcgagttagcagattgcagcaatacaaatatatatgaatacatactgattacaaacggaggaaaaagcaccttgcctcattggcgctaaataactttggtggtggaacaaatgatttcttctccttcacaaccttaagtccatcctgaaaatgggaaatactgatcatgctagcccatcggcactggcaaaggataatagcatgcagatgaccacggactacgtacagatttttaattttcaatttactcaaatggtcacttgttccactataaattaatacatctggcattcagtgaatcacatcagataggaaatcctaacatcataccaaatgatggcagcaacaacctaaaaaggtaatgtattaacagcagatgcatcaccacaaatataacagggcatgttaggctgaaaggtgaacataaaacgtggcaatttataccaagtaacaacttacaaatttgtttgccaaggcttgtaaatctattcttggaatgagtttcacagtaaccttttgatgcacatcatcaacgtcaacaacctgatggaggtcataaaatcaaatagtagcagaaaatgttagcatgaagaaactgtactgccgtggtgatggccataccttggcaagatcccctttatatgcaccaagcttcattcggacccatgtgttaattgaaatatcagtagacttgctctgaacagagagtacatcagccacctctcttataggcaccagagttacttttcttgaagcgaagatattgcgcacacctttgcaagcctgtaataaattttagttcccatcacatagcaggaatattacaatgtcaggtcaagcaccgtacctctttgacatgggcttctttatatgcttccacataaatgtaattcttcaggtgatctaatgcaagaacagatttaatctggagatctggcgtatcaatggacttctgcatcaaacaaatggctgtctcccgttcatgcccaatctgaaaatcataattggatatcagtgagcatcaaattatacagaaaacaaattgtggagcagaacattattcgatagaacctgcaacataccgcacatttcaccatccaaagctttggatccttcaccgatggcagaagagcttgctgttcaacctcagtcacaccatcgtcataatccacaaaatgtgatgacggaattatatacctgtcgtgtattagcttcacaagtgcatccacgtctcctcttcatccagcatagaagatggatgccgtctagagcttcttcccacatcttggtcagggtcgtcagctcgagtatcatcaataaagcctaccaaaacatgaaggaccatagctgacagcattaaaacacttgaacttgcttttggatattatataattcaacacaagatatattttgacaatgtgaatctgataataccaaaaggaaggtaacacatgttagtagtcagcacaagtaaacagcttagttagtttatgaattaattggagcatcttccctgtgccgcattcgaaacaaagagtaggagcatcttccaattaggtttcacatttgaaacgaagattttttaacagatctatcacaataacatagaacagccatcaggccatcagcgtattcagacaactttgaacattgataataggtagtagcagcaaattcagtccatcatattggcatgtcgcagagtcctgccattcaaggcaacgtggctttaaatagagatgattgaatgaactacgcccactcgcccagttaacttcttggttggtgaaggcctaattggtgtcgagttagtttgacggaactacttttgtcctagcaaatctgcccaatttatgacaaaaatcccggaatgaatataaacttttgcctccaactgaagttttcacatatcgctaaacagaaatctcgattcttattgccattagatgagactaaaccaccacaaacaaccatagaactgcaacaacatggaatcaatacgaaattgaccaccaaatttaatgaatctacacctggaccatttcgaacagagttgattatccagggtaaccgggaaggaactagcattgaaattgttggttcgctcaacttagcgcttaattaacaaacacaaattctacgtccaatgactcagctagcagaaaccgaaacgaaattgctgatttcgctgtgcttcgtaatttcggatttgggaaatcaatctaacgattctatcacggattcacagttcaaacaccagtgagaccaccaggaagcactcaccgtcctcgaactcgccatcctcctcctcctcctcttcatcgtcgacctgagccatatcgtcgatcaggatggacgccctcttcctcttgcgggcac

SEQ ID NO: 11725 - DNA, 3882 bp, Oryza sativa
cctcttcatcctcctcctcgcggctgccgcgcgacattgcggaggctagggttccgcaccctactctcgcgagtcgtggcggcgtgggtgcgcgatgccgcggagcaaccgccgagagtcgagcgcctagtcgcgcgtggtctccctgcgcggactccgcgtgtgtgatgctgtgcgagaatgagggggaagcgtttcgatcgattgctcggaactcggaaggggaggcggggggtatttattggggcggcgagcaaccgcctcgtagccgtaggctcgaggagggcagaggtgctggctgggttgggccgggccgaagtcggtgcgcaaaacgggggaggaataagtctattatgactctctttatctctcttcttgattgaatcgcctctcaacagcaaaactgaatataatgtcttccccatcttgaaaaaccgatacaaatcaaactctttcgatgatttaggaagtggttcctgtagacgtgatatgttaattatagttgactcgctgaatcagctggttaaacccacctatcagccactctcctctctttattttcctctctcctctcctttccatctatctcctgaggtcggcagcacatatcccgccaaggagaccataagtaatcgatgttacacgccccgttggtggcgacgcaactgcagagccctggggtcaaccagccacatcggcagaaatcgttttccaaaccattgaataagtcgatttacactagttttaaaaatgagggagatgttatatgcagttttaggttgagggaggctatttaatcacgagcaagagcttagagaagtcaaatagacatattctgggtggacaggatcgagggattgggcacgatcgcacgagaacagatgcgtaaagagtaaagaccgcaacgggctaaaattattttgggccttctcggaaagtaaagaacgaaaagatgtgattgggcttcgagccttggcccatgtggcctgcatgctgcaacgcgatggcgattccaaagcaaacccatcgtctggtcgttgccgatgtggagatggaagatgctgtcgcaagcggcacgccggatatgcctttcgaacaaacaacggaagcaggcgcacagctagtcagctatctggtgcacaacacgtcaatacacccggtgagcaatttatatatatagttgttattatatgaactacaatatggtgagttgacaaaaagacccaatacattaattggttgatagataattttatcacggcaacgttggtagatcgatcatgaccaccctaaggtccaatacggaacgaaaatatgaaatatgtagttcaatttacatactacaaccagacaagtcaatgtattaatgggttgatgaattataagcattaatatatcaattattgccaaatttcatagaatgttaaagcttgatttcattgttgattttagggcctttttgtttacccctacaagtatgatttaccctcttaaatattttaaaccccgaactattaaatctggatgaatcatggcaacaaaaatatcagctcattatgcctacctaccagcctatctcgttattctttttcttccatgacgcaccaacccctccttggtgatgtcctagttctcgacgccccaacctactttcctaggcaatgccctagttctcaacgctccagcctccctccttggtagcgtgaagccatggagggaccttgataatagcatgtgaagttgtggtgtgaggacggttcaatgttttgccctctagatctataccacccgctcaagtttcacctcattgggtccccgtacaatgatggaggggatgtgtcttatggatgggatggtgaggttggcattgaagcacttgattcggtgaatgagaaggttgacatacttgatgcataggtgagcggacacgatttgatctccttgagcttgagctgtcggtgtcctcccatatgagcttgcccgccaccatccttcatgagcttacgagtcatcctctcactcgccctcccctcctttaaaatagcaccaacgaacttccctttcatcccctcctagacaagcatgtccgccaccgtcctccactaatttgcgccactatgcatcctctgtcactcccatccccataaatggtagatgggcttccccttcattccctcctagccagctcggaacgtggtcctccacaaggtcgtgttgttctttgttgctcccctccttcaaacaacattaggaggttttccctttctcccttttggccctctcgtcgctcgaattacctttctttcattgatcgaaaaaagtaagtggaaagaccaaggtggtggcaggaaacagaaagaggacaacagggaaggaggtcgtagacagcgacggccctatatttgatcgagcgagtaagaaagatagataagagggtaagaaaactaataaaatgcgtgattaggttgccatgtaatgaaatcgatgtcatatgtttgcaacgtaatattaaaactaccacttttttttacgcatgggaaggggtacggttttggttcgtgttgatttaatagctcggggattgtcaaatttccgatactctagtttaaggggatagataatacttttatgataatcgaggagataaatcaaatccttttctttttatcatggtctgttttttagatttggttcatacaaaattatatttttcccataagagcaggtacaatagctggatattagccagctataaacatattttaatgagataaacgatgagagagaagagcagcgggctacagatgtgtagccagctacagcacggactccaagacacaatgtatatatgacatgtgggaccatatattaatagtatagaaagcaactattatatgaattggctattagattgattatagatgaattggagttaatagtgaactatactattaaacttgctctaaactacttcatccgtttcacaatgtaagtgattctaacatttttcacattcataataatgttaattaatttagatagatatatatgtttaaatttattaacatcaatatgagagaaatgctagaataagggagtacttttaattagaccgttcatgtttccacggttagttccttggatcttgtctgaacggagtagctccagcttgttttctccaggaggccacgatcattgatttatctatgatcaatctgggcgtacaggccaataatttcacatgcaataaacccgttacacggtgctcgaggcgtcacgcggacgccgttcctcctttgcatgtggcgcctagaacctagagccctccgtgcacctgtccgaacacgaaacaccacacgtcatcgctgcagtaaacgccatcattgcagcacggtccacgtgtcaccatatcatcggtcgcacaccatcgccgcgtgaccgaacagccgcagttgatcccctgagtgccccactctggatttcgataattacgtatatgggtcactcgccttactccacgtcggatgctgcagatctcaccgacatatgggtccaatcttagtgggccccacacgtcacttgcataccagtggcgtcgggtaggccggcacgtagtatttgtctcccctttgcttcgacgcggggaaaccagaaatgcccgaagcggatgacgcggcacgctggcttgtgggagcacacaatctccgggcccacctgtcagccaccccccgggtttcgtgaaagtccgcgccatcaacgtcacccccacgccgaccgcacccgcctccggagaacaaatccgggcacgctgacaggtgggccctgctcgtgctcgggctccacatgtcatcgggatataaatatccgaaccgtctcatctca

SEQ ID NO: 11726 - DNA, 15678 bp, Oryza sativa
gggggaggtaggcggcgtatttaccccaccgggggtggccattaactctggccaccttggcatgcggataggcatcaccatgggatgcctctgacctctgcgcaggtattcgacgagatacctctgcaaatttttgcttgcgcctttgcctggattttgtggtggcctctgatctcccgtttgatgtggaattttttgcgtgttttcgcgtatgtggttcagggaggtggtggagtcggcgtgatggagagcggcgggaagcggcatttcttcccccttacgagcttgcaaatcgggtaagtctccttctgtgtgcgggggctctgttttgatctcgcggtggaaacgttcttttcattgcttttggtggaatgttccagtctcgtataatttgggtgctaatttgtgtggtccacaatgcaatgtagtcccgttgtgatataagtgaaaaaaacgagaagttacgagaaagttaactggataacttcgatgaacacggttgaagttagttacgcttgtttcccaaagggcagtggaaattgatcaaaactacaacagtcgtttattcgtttgtgttacttggtggaggaagttccagcatactgtttatgagaaaaagacaggaaagctcacttgtgggagtgggtagctgaattgtcttgtattgcttcattctagtagcatttattttgttacagaatactgtatatcttgatgagagatatgactaaagttagtaggagtagaaaggaaagctgttcttggaaatctttccaatttaaggtagtagatgtttccagtgtaaaggcacaggatcgatactatactggaacggttcaataattcagggtttgtcatttctccctacatattcatgcagagatgataaaacaaacttactataccatcacgttgttgtttgcaaaacaatctaggttttattcctaggtttagttgcctatcgtaggttgataattttgtgttttgtgcacattcatcataccttatcgactggaaatctggaattgtggctttactttacttctaggttcagtaggctgcaatacatgactccgtccgtacactggaggaaagaaaatgttaaatactgtgttcctgattaattttattttgatctgctattgtccacctggatcatatgatatcaaacagtgaacaatgtggcggttattttatcctttttctgtacatccattggactgcatttgttgtgcaaagtcgtatgaccttaagttgtattgcaattatcttaatttctgaggtgggcaattgtgttaagaattcttgcaaactgcaagttttgttttactcctcacagttttgcttgcatttactaacctcatgatcttaaagtgcaatgtaaatttggattttcatctatattacagttagttagtctgatataattattatatgcagggatttacaatcatatcttgctgaacttactatatttttgtgccctcatacgaagaagtttctcatattgcttgataaccggccatggctgcaagaccaggacacaaaacctgctcacctgtggcaattgatggtcacaaaggtatgctttactgttttacgagccacttgtaagcacacaaacgagtacttatgaatatttgttcattgcttacactttcatgtattgcccttgttacatcgattctggctcgtcttacttgttgacttcttgtcattttttgctccagtcaagactttcaccttttgcaaacactagaactaggagaaagggagatgaaactgggaagaaacttgtattctctaaagatcctagacatggttctcatttgtggaatccatcatccagatggtataccttaattgatgatgccatgcggaataaaaagcttcatgtgaataggctgaaggattctcgcctgctgaacaaggaactgcaccgaaccttatatggctttataatttttgaggtagactgggctgatgtgcgcggcatgaactatttcaatgaacttcaggtattgttttagactgaacatgatattcatagctattaatggatggtacatgcttattttgtttttatgttgttgtagactgatacttctatggcagtggaagctaaaacaatgaagagatgggaatttgagagtgtcaaccaagcttcatcattaatcacttcatggttttctggaaattactctgaatgccagctcctacaggattatttgaacagcatctctcctaaaggtaaaggcatgaatgtgctctccattcttctctgctgcatgtgcagaccacttatatgcttgctgtacaggaaatgtgttttatgacgctcagaattatttctcaacacctgaaggggacagtgagaatgtacagagtgatgatgacgattctggacctagtcaatgcatgagagagtcgtcaagttttacaagctcctcatacacaccacctccttgctctggaccttacaagagaagaaagataataagatctgatgctggaaataatatgtctgaagaatcatattctgaagttgtgacctcaccaacacattcatcatctccatcttcctcgtgctgcagtgatgatgattgtggcaagactctgctcgagcctagcacatataaggatgtgttgatcttattccggttcgatgaccacgatctccctttcagactaaaagaagtaatactttctgatgtgaggctgttaacattgctagagtatggccttccttcatgggtcatttttctccagtcatatccagtgttctgcaagacatatcgcccatggatgtgtcctcttgccagggcattgtatgtcttgatgtcaatagttactgttctcataggattttatgacctctacaagaatgtccccatgttgaaggcaactgcatcaagattgtttggccctttctttgactggatagagacgtgggaaatgatttcacgactgaagtatcttggaaccatgctttttctacataacttccagcaggcttttacatggtctcttaagattgtaactgctactaaatctgctctaagtgttttgacaaagccaatcatgggaccaattttggaggttcttgaatttaccctgccgctatggaacctttgtgctgaaacagtaggacatctgagctcagttatcatgttggcgatggagacttcatgcagtgtagttatcagtacaatgcagatgattatatggcctttttggctggtcttcagtgttgtgcttaatgttggtatgttttctgcaacctctgagacgatatgtctgctactctgctcttcaatttgtattgacctcactatgataaactttttgtgttgattctgatatctttctcttttgtattaacttcagcaaattcagtcctgtaccctttcgtttggcttcttggagaaattctagctgcacctttccggcttgttgttgcgatagcaagttttgtggcagactcttttgtggacattgttggagttctgagggagacctggtctacattgagttccttatatcaagttggttctgcatccggatcgaccggacttgcatctgaaactaccatctgggggtcactatggaaagatcttctgtaccaggtaacaaaaatatgttgatgcggccagtaattatattaggaaataggatatatggaacttactttgactttctttttcagattttccgtgcgattcgaagcattctgtatggttttgttgccttcttttcaacatgcaacaggcatcggcttaggtaaccttccttctcatccgtatgtggtagtattttcaaggtcacatgaacattaaatatgaaatcaggtatatacagaaaacatctcgtattgactgtcgaattagaattttacctgattaatgcctcatctaacatgtcattctgttgtgaacttcactggtactctggtagtgatttagtaacatggtcgagtggttcaaaataaataacaggattatatagtgtttcaaagtttacattatcacttcatgtgtgctgtgtgttaactactacttcatgctgcagcatttacaaccacattcaagtatttctccgacgcctatctcgtgttttaactggtgcacagcataccacctcttgtgaaggcacacggaggtattctagtcaaaatcatcctgtaagtccttacttttttaaaaaagttacagtctatcatgattttttttcatgaagtttaggggtaaaaatgacccttggaattgaaatcactagttcatataacagtctgttatgacaatctgagttatgcttcattgctgtttgtgcctatgcttttcccactaaaaaagtgcaaagtagtctttacaatcttggttgtttttcctagatgttaagctatgttgaactacgaaatgtctacagaatcaagtatgaaactatgattgcattttaacccacaagtggtgataactgtgaatatggctgcttttcttttcactgcacgaactgctgtaacttggattatcaaaatcatgcttatatcatcttttgcattccacatatattctacagagagtccaacatgaagtaacagttcaaaactaacttttctatattatagtttcaactaacttgtctatattatagtttcaactccttacataaacatgtctggtgtatgtacttctgtagcaaaggaaaactcacacgagataacagtgggcctggcaacttgacttgccaggtaacaacctcattcagggagcctatgcgcgggataaatagagatagccagtcgtgagctgaaaaaagtgtgaacaggaaacatttactaacacagaagcatacccggtcgactggacagaccttcaaaacaacttgcttggaattggaagagtcatgtacaggtttataccgaatgtttcatcacatagctttaatcatgtatcctatctgtaccagcgggcaagtagtgaaacaaaacgccgcaattgtacatacgcagaatctgttgtttgttcattctaatggcttgtatagcagcctagtaggtttgtgcatatcctcccgaaatgttcctctgaacaacaattttgtaattacatccgagtattagctaaatagctaagcatcaatttccataacacggttgtccaatcttttgtcttaactgtgtgtggtactcagtttcacattttaaaaacatcgttgataatcggtttcccatccagcatcacaaaggaatcgaaagtcaatactaatgggcctctacacagtaaattcagcatatatacgtttggtgggtcctcatatgtgtttgttgggtcctccagttttatcattccaaacttagatcaatcctcatcagttggaagggagagaataatctgatgtagcaagacgttttaaaaccgaattcttcagccagggtcacctttttatattcacctctctttcatcagatctcatctattcttcgccgttgtcatttcctgctgctgcacatggaggtggtgtagcatactagtagcatgcaattcaccctgccgcgtcaccaacggcacgtggggttggtgaaccggtccatgtgtgcaatagtgcaagatccaggcttgattccccatcctagccgaacggtgaaatggagcaaaaaaagaagataaggaaaacaaattgcagaaccagtgtcaccactgggggtgtgtttagtttactccaaaattagaaatttagttgaaattgaaacgatgtgacgtaaaagttaaaagtttatgtatgtaggaaagttttgatgtgatggaaaagttagaagtttgaagaaatagtttggaactaaacttggcctgagacggataatactaaggccgagtttagttccaaattttttcttctaaattccaacttttccattacattaaaacttttctatatacacaaacttctaacttttccattacatcattctaattttaaccaaactttcagttttaacgtgaaataaacgttactgccatttgtggccgtgaaattgttctgaactctgaaggtgggcactgaatcagcagcagtatcaatagtatcatatcggatgtatttgatgtcctcttccgtctgaatctattgactcttttgaagcgccgtgatctaaagtaggcagctcagagattactccctccgtctaaaaaaagacaaacactgggtttccgtgtctaaatttaactgttcgtcttatatgaaattttttatagttcgtatttttattgttgttagatgataaaacatgattaatattttatgcgtaacttatctttttaatttttttcataatttttttaaataagatggacggtcaaatgttgagcatgaaaaccagggtttgtcttttttttttagggcggagggagtatgtgatatgaatggtccatgagtgagctatagctcactggctcactgcaatcagtgtgaaaataaacgtttggttcacatgagcgcactctgtggtttcccagtcttggcctttggctgttgtcgccgcactactgtctactgctgcccgagctgcaggtgcagtacaaatccaagccccaatcatgaaccggttcatggtggtccagggatgacgtccagtgacgtagggtagccaagcatgttcatcattctgcccttcccggcctaatctttcgtgcgatgagtgaattccccagccacaccgacagaaatgcctctgggactcggatgcatgatgctccaagatccacatggctgacactgatcatagcgtgggagttcatcagatcaccatgctactctcgtctgcagcaatggccactcagtggttctcaagaggcagagagaaaaatattaatgctaatgataaaaaccttcgtgcaatgatgcaggatcccatgcatgcgcaggagcgataattctctatctgaaccagattaatcagcctgctttgaatgcaagcttctgccggtctggaatctactactgctattataggagagaagattgcagtgccacccttgccacatggtcgaagcgagaacgaagctgctagtagggaacatgaacacaactaacctgaaaattcttgacaaaaaataaaaaaactaacctgaaaatggtactagtgcagatccaaaggcctactactgcctctcctctcctttgcattatcgcgatggcacgatctcttatgtcaggtatcggaagcagaaaaatcctgtgtctttctgggtgtgttcagttgacgttaaaattgaaagtttgattgaaattgaaacaatgtgatgaaaaagttgaaagtttatgtgtgtaggaaagttttgatatgagggaaaaataaagagtttaaagaaaaggttgataactaaaccaggcctatgtctctaggacatttagcattgggccacgtttaagatgtggcaattaattatttgtcacttgctgtctatgatatatgggtccttatgtctctatgacatgtgggcccttatgcgtctatcacatatgggtctaggggcagattatttatcaccatccgtaagagtggcaaataattaattaatcctctgtctgttgggccacattcgggagcattggcactttggcagccagtgagtcaagcctgtgtgtttactactgtggccaccgacgagagagtgaggcagtgagacgggtggagacgagcggtggacgccgcgcgccgcggccggggagcaacgggcgttacggcgcacatggcgcgccccggtggaggacaagccggacgcagcagaggccgcttttccccccgttgcacagctgggatgtacgtcccctttaccaccagtcttcccccatcatttctcgccgcgcgggccctgatgcgttttcctgctggatttctatccgtttaccacttgatcgctcgctcgctcgatctgctctcctctgttcatcaccacgtccacttcatctgcaactgtgcctgcacgatcgaattggttgtttgccagaaactggctggctaatctaggggagaacgctacatgtgaagtgtggaacagctgagcgagcaagaacgacgaatcgacgacaccatgcgtgacagatgtactgaccgatctacgacgatcacggagaagaccgtgagtacacgccctgaggaattttcctaatcgtgtcgagctcaacaatagctgtgccgcagcacatctactgactactgttattactggtcttctcgtcttctgctgcaatgtgagctggggcaaacactgtagtttggacctagcgaggacatgctgcttccatccatcgagtagtagtagttgcagtatgtcttcgtctcgagcatgagcacgctagctcgactctacctactctaaccagcatgcgcggctgtccgttgttattagcggcttaaaaggcgtccaggcctttttccccactcgatccccatgtgtattcttgtccggacctcaaacataattaaccgaaggtgaagcttgaaaaaggctaacctgtcctcctgtccatttcttgcataatttacctctaaccatttcggctaccttcagatctagccatcaatcaatcaattaataagggcatttccaccccaataactagaatggtgttcatagcattaaataagttgctatctaggacaaaaaaataatatggcaagtgaataaaatgagaaaagagaaggaaaacatgtcttgcatgagacatggttcctacacaacatccaagacattatgtgagataagtagcattaaattaaagtatgaaatagtggtgtttgcattgtaagagtagtgtctagtattagtttcttgataatgtggagtttataaaaaccatatctagtgttatgggttgggactgtcctagctcatctaatcacagcaaacacggttacagctaattaatgaaccaacgtcaccaaagtaccaaaccgagctaaagcgttcaactgcagtgcaaatgtgcaaatgcaacggatgagttggtacactagtgctgtctcgcactggacactggtcatccgctccaaaaagatcctgtggtagctagtgtacctggctgcctttgtgtgcagtcatgcgttgctcgcctcatcgcctgtgtggccgagagactttactgaccaagcaattcaggtcggcagagtttgttacgtcctccaaggagaggaccatgcaattgcatgttgcgaaagcagaaaactggagagaccggggcacgctgtcggcgtcatgctacaagcgttcccttgcgtgtatgcatcgtccacctagtcacttggatgagagatttgaggggaacaaggctacaaaagtacaggtttgttatcgacaattatttggtctaagtgtagctgaaaacagtcgcgcgtatagcacgtttgattaatgctcagtcaccattttgtttcggtttacatgctaacaaaagtagggtatatcacgtcgttgaagtttacattttgtaacactcaatccagtagtccagtcaataaagaattttttttcattaaaaaggtgttttttttaacttattgtagtcacaggtggtgtttggatccagggacttaactttagtccatatatttagacactaatttagagtattaaatataaattacttacaaaactaattcaataaatgaaagctaatttgcgagacaaattttttatgtttaattaatccataattagagaatgtttactgtagcatcacatagactaatcatggattaattaggctcaatagattcgtctcgtgaattagtccaagattatggatggattttattaatagtctacgtttaatatttataattagtgttcaaacatccgatgtgatagggacttaaaaagtttagtcccatctaaacagggccacagtctatgtggagcatgttcaccgaacaccgataaatattgcaaagcccagaatgattttggtcccacatgccagaaactaccacacccacatttcggttcattttcagctcaggaaaatcgtccaacaatttcagctcaggaaattaaatcgtccgagaaaggaacaagtttggagccgttgggatgagagcaattaggtcacgcttaactacaagtacagtctcattcatcgacattgattagccagcaactaaccacttaaccccgagccagcccaagcgctccgtacgttcgttgggcccccgccgcgcaggcggagacaacggtcatccggcgcgccggtcgctctccctcgctcgcacggccgcaccacccacttcgccacgaacccgacgcgagcgcgacgtgcatctcccaacatccccgccatttcctccccacccaaaaccaacccgcccgcgtgcggctggcccactttacagcgcctcacctcccccaaccataaatccccgcccttttccccccctctccaccactcaccacgctctccactacacgactcgtcgccgtcttgctctgctgcctctcgcgcccgcgcagcagtgagcagcagcaagagcagcaaaatggctctacccgggcgcctccgcgccctcatcctcgccgtcgcattgccgctgctcttcctgtccgcttcaggtaacgagagatttggcaatgcaggtggtttagtggagagtagtgtggttgattgttgggttggtttggttacagaggcgggcacggtggggatcaactatgggagggtggcgaacgacctgcccaacccggcggcggtggtgcagctgatgaagcagcagggcatcgcgcaggtgaagctgtacgacaccgagccgaccgtgctgcgggcgctggccaacaccggcatcaaggtggtggtcgcgctgcccaacgagcagctgctcgccgcggcgtcgcgcccgtcgtacgcgctcgcctgggtgcgccgcaacgtcgcagcgtactacccggccacgcagatccagggcatcgccgtcgggaacgaggtgttcgcctcggccaagaacctcacggcgcagctcgtcccggcgatgaccaacgtgcacgccgcgctggcgaggctcagccttgacaagcccgtcaaggtgtcgtcccccatcgcgctcaccgcgctcgccggctcgtacccgccgtcggccggcgtgttccgggaggacctcgcccaggcggtcatgaagcccatgctcgacttcctcgcgcagaccggctcgtacctcatggtgaacgcgtacccgttcttcgcgtactctggcaatgccgacgtcatctccctcgactacgcgctgttccgccccaacgccggcgtgctcgactccgggagcggcctcaagtactacagcctcctcgacgcccagctcgacgccgtgttcaccgcggtgagcaagcttgggaactacaatgccgtgcgcgtcgtggtgtcggagaccgggtggccgtccaagggtgacgccaaggagaccggcgccgcggcggccaacgccgcggcctacaacggcaacctggtgcgccgcgtcctctccggcaacgccggaacgccgcgccgccccgacgccgacatggacgtgtacctcttcgctctcttcaacgagaaccagaagcccggaccgacctccgagcgcaactacggcgtgttctacccgaaccagcagaaggtctacgacgtcgagttcgtcctcggcggcaactccgctggcggcggcggcagcagcggcaaggacaacggcgggctcggctggcaggacaacggcggggtaaacgccggcaatgcgccggccggcgcaggcggcggcgtgaaggcgacgtcgaccggtgaggcgtggtgcgtggcgaacgccatggccggggaggagcggctgcagaaggcgctggactacgcgtgcgggccgggcggcgcggactgcaaggccatccagcccggcgcggcgtgcttcgagccgaacaccatggtcgcccacgcctcctacgccttcaacgactactaccagcgaaagggccgcaccattggcacctgcgacttcgccggcgccgcctacgtcgtcaaccaagcgccaagtgagtagtcttcgcgctcgtttgctcgtacaattacctcattgcattcgtactacttctacatgattccttgcgtttcgtagcgaaatgtacgtgttatacgaacgggtgtagggcttggtacacgctagtacacgttacacaacctggattgggccatcgtgttccggtaaaagtttgcgtaggaactactactacttgtacatggtgattcacagatgggtgggtcacagtacgggtgcaaatgaaaggcgctttgcatcggcatcgtacgggaatgattctcgcttcactgtagtcttcgcagccacacactggcatgtgccacacgattcacacccatggcttcctgcctgggttaaacacaccttggaaagacgcagccggcggttgcaacttgcaaaattgcgactgcaagcagccgctactgtgtctctgtgaccaacaaatcttcactgcggttttgaggtctcgttgcattggattcgagctgtaggtgttctgcttcttctgcattgcactgcggtagttaatgagtggctcagcaagttgtaaacccgcacaagtgcaattatgactgcgatgagatggggtcagcgtggctcgcagctcgacgtgatatgactcgtcctgtattctttactcccttcattcatggtgatgcgtgccgtggctggatgtcgcaggctcgcaacgtgtgactgattgccactatcgtgtcgtgtaccttttgcagttcgtactcctactacctgcatcaatttttttacagtattcctccacttgttattccctcggttaccgccagtatacgcgtctcctcctttggaccagcactacaattggtctcttgttcacatgatagcagcgatttaccagttttttaatcgcgtaataccaccctgttgtatgattctttctttttgaaccgtgatcttactgggtgattgtctattccattgtttgcagagatgggcaagtgtgagctcccgtcgacggtctgaaccgaagcaacagtagcgaaagactgaagaagagcagcggcagcagccatctcgggatgcgaggatttatgaaagaaaatcgaacgccggacagaggaaggagggaaaagaggcagagatgttggaatctttgcttttcttttccagttttcctccctttctttacctgtggtgctgtgcccgctgcttgactcctgctgcatgtttgctgcggcgtagaaacagattactgtagtagctgtacctctttctttttgcagctttggctaatggtgggggatatctttgtttagtccatgtaactacgctggagtatggagtattactatatgattaacctaaatcactactattatagactgatttgtactagccattggttggccatgtgagtgacccactatggcttgtctcgagggccttgttgcctggtttgactcttcctcctccatcgtctggtggatttataccggaaatggtgctttgctttgaagccaattcgaccggcattagagtttcaaacccatgatagcgttgtgccctcgtctcgtctcgtgctttgcaattgtttcgctttcaggctacgcttttgtgaacgtccgtgagtttgttaaaaatcagttagtagtaggttggtttgaaatccgtcgttgggatttctgcgtacttctcctttacaaggagaaatttcgtgccaaactgctctggaaagatccacatagtaacgtccctttttacagtagtatttcctgatcaggcccactcacaaagttgacaggccgttgatcccaacttctcacgacaatcaccagatcaccactagtgtttgtgaccagctaatctaaaatgtcgcgttgacacgcacttgcgacgtacgacgctgatctaactagaaaaggctcgcgttgccaccggctccccacccgaccacggcacacgttgtctcgaggcctttcggcaaccagccaaccacgcgacgtaccggccggggttgtgggcgtcgtgatgtcgtgcacggccacggctgcggcctccgggagtccggatcacatggagcttcgccttcgcgggacgtggcctcccttcggtacaaaaccgatctctgcctcgcctggctgcctcccccgcgacccgcgtgcgcgcgcatgtgagggaagctgccaagcggagccggcaggcgaggttgagctggaccaccgaatggaggaggagacgggagaatatcgggggtttcatcggtggttccccgtgaaaatccgtgccccgccggctggagggccacacgctgatatgcatgcagaggatacagttttttgtgactcgtactcccgtggtggattcgttttgtacctttggttcgttgtctcgtagcatcgcgtaggcggtacaaatcgtctttagcgaggcccggagcttaacatgctcggccgaaagagggcccgtttagttatcaattttttttccaaaaacatcacatcgatctttgaacacatgcatgaagcataaatctatctattatattattaaaacagctcgaaaagaagccaccacgttcgctgtggaagctaaaaattcctacattaatcgaagaaaaagaaaagaagagtccaaatagaaatacaaactaaaaaataactgaaattcggaattaaaaataagcaatactgaaataggagtccatataagaacccaatacgagattaattaaaacctttggtaattctagattttaactgtttacagtagaaaagataagtctatagatctgtactacgttacatactaggagtctttgtccttttctatttctttggcggtgtacacaatacacgtataatctaattcaattacaaacctatacggagaagagttgtgctgccaaataaacaaagcttgcactgctgcacctatatattctgtagatttcaagcatcaacgattgggctggagcggcagaacccaatgatagcgggagccaaccatagtaaaaagacatgatatttacatagacattacaacaaacagatcaatacttgcagccggcaatgcatcaaacaccaaaagtttctttgatgtttatgaaagtacaaatgatatcaacatattgtaattagtgtatatttttcacaggagatgagttagtgcaagccgctataaactgacagtcagattaaacgtttagattatagtggattcataatttaacgttcataatttaacggttgagatataacacctatatataaatataggaattagagttgtagtgctaatacaggtgtacaaagcgccttgctcgatggaataatcgagatccaattctaaaactgttatctaaacctatttgattccagtggaaaaaaaaagcaaaacaggaactaggtaggcagaaagccgtgtatatacgtgtgcacatgtaagtattattttttcagtctaatcacttcaaaactatttagaacatactgtgatatatttgttgccagtaaaaatgaagcgactgcctctttatctattcgatcctttttaatcaccaaatatacaaccagcaattcagatgttttataagtaactaattttgaaataataataataatgaagactatgaaaagaaaaaaccatctacaacacaacat

SEQ ID NO: 11727 - DNA, 13489 bp, Oryza sativa
caatgacgattaagagaaacagcagcgggcaagccatcaaggagcgcagtcgtgacgtttgaatggacttctaaaaagaaaaaaaaacaacgataatcataatatcatatttgactttttaaattccaatgacaactaagaggagacatcgggtggattgtagaacagtacaatgatgacatttgatgtaacttctaaaaatataaatatgtcaatcgacaagacaatgaattaaaaaactataagatctaaatatgaaagtttcaaagaggatgaataaaagttatgacaggtcgggcaatcaaataaatgagaggtaaaaaagtaaggggtgacgacttattgacttttaaaaactaacccgatgataataagattcaatcttttaagatcggctagatggctatttaacaaatttaaataaaaccatgcttaaaaatatataatcctggatgggtgctagccgcgcaacaaataaaggggttacaaaggagtaagggtagcaacaggtgtgacttttaaaaattataaaattataaacccggggatgataatgttcgatctttgaaagtcataaaacaacgagatagatatttaataaattttaagtagaatcatgtgaaaaattagataattttgtgggtgctagccgcgcaattgcgcgggccacccagctagttatataattaaaggaatagaaaaaggagcctccacgttcgctctcgtggcctagaaattctcacattaatcggagaaaaggaaaaggcatagtacatatagaaatacaatttagaaatagctgaaattcggaattaaaaaataaggaatactagaagaggagactagagtccatatagaaatacaatttagaaatagctgaaattcggaattaaaaaataagaaatattagaagaggagactagagtccatatagaaatacaattaagaaatagttaaaatttggaattaaaaaataagaaatattagaagaggagactagagtccatatagaaatacaattaagaaatagttgaaatttggaattaaaaaataaggaatgttagaagaggagactagagtctatataaaaatataattaggaaataattgaaattcggaattaaaaataaggaatattagaggtagagtatggagtccatatagaaatacaattagaaaataaccgaaattcagaattaaaaataagaaatattagaagtagactatagagtccatatagaaatacaattaagaaaaaaaatagaaatttggaattaaaaaataaggaatattagaagtagagtatagagttcatattggaatttaaatccaactaaaattcagaataaaaaggagcctccatgttcgctctcatggcctagaaattctcacattaatcagagaacaagaaaaagcagagtccatataaaaatacaatctagaaatagctgaaattcagaattaaaaaataaggaatattagaagaggagactagagtagttattacacattagtagttttgaaaagttattgcaaaatttaaaattatgttgtcattgtaatatattttaataatataatgagaaaacatatgtgctattatatgagagaaaatataatgatgctagccgcacaatctgcgcgggccctcatgctagtatagataaaaagaaaaattaattgcacagttatgggggaaatcgcgagatgaatcttttaagcctaattagttcatgattagccataagtgctactgtaacctacatgtgctaatgacggcttaattagtctcaaaaaattcgtctcgcggtttccaggtgagttctgaaattagttttttcattcgtgtccaaaaaccccttccgatattcgatcaaacgttcgatgtgacagccaagaatttcattttccccaactaaacacacccagaaaagcacagatgtgtcgacgagacattatacaaaaaggcccatctaaggcgacagcggaagtagcataaaacaacattagcacaaggcccatctaacgtggtagccattgaagcacagaacaatacgattagagcgcccgttacacacacttgagtacttgacgcgatacttacatccccaggttacgtacacacactagtagtagtctagtacgtaaaaacattacgcagaaaaacacgggacggcatgtacagcaccacgtacactaccgtacacatcccatatatctggatcatggcacgcgcagccgtagctagtgaagtctgatccttatcaagcggtggcgatgggcgccgcgtggacgacctcggcggcggacttcatggcctcgaagcgtggctccttggcctcgaacttgtggcgcacgtacaggttcatgtagtcctcgaacacgaacctcgggtaggcggccgccgccgcgtcggcggcggcgagcgcgggcgccgggaagatgacggcgtcggcgccggggttgtagaaggaggcgatggacatgcggttgccgtcggggcgcgtgaggacgcggtgcatgacgctcttgtacctgccgttggtgatcacctccagctggtcgccgatgttggcgacgatggcgtggcgcatgggcggcacgtccacccactccccgtccttgagcagctggaggccgctcacctggtcgtcctggaacagcaggatgatgccaccggcgtcggtgtgggcgcggaggccgtcgacgagatcggggcgcgggcacggcgggtagctgctcaccttggtgccgaacgttgggccgttcgacccggcgaaggccttcttcaggtaacccttctccaggcccagattctcgcacagcaggtccagcaccctctccgagagcttctcgatctccgacgcaaattgcttcatcacctgcctacacaaacgcgacacatgggcttctgttaggcctcgcgaatattcacaagtcacttgccatttgccaaaagcgaatccagttagtgtgagttctgattgattgatagttactgcacgttgtatgatgtatactcctctccgggggaaaacagaaaaaaaatggtgtattcctacacttgttactatctcatagtaggaaagggtgcagagatgcgccactacgtccgttcaagagtaatcgacgctgtggataagccgcagtaaaaaagtaagcatctccttttggtcgataatcctgtcacctttggttgcagtagctgtttacagaagtgggcatttctatagtagagcgcgtcgtgtcaggtgtaactttgttgaggttttggtcaggcctacactctacagtagctaggatactttgtaagcctttgctttgtgagtgtactacttccgattaaaatactgacgatcatttaggcgagtttgcaacttaagcttttctttcagaagcatgcagataaattaacaaagactaaattgagtttgttaatgatgattgatgatgacgcatgcatgcagggtaagtatacctgtagtggtcgtcgacgtcggggaggtcggcgaggttggagacggggcggtggcggacgaagaaggtgctctcccagtcgatgcccttcacgtcggcgcccttctcgccggcctccagcatccgccgcgcgaactccttgaacttctcctcccggcagttggcgtagtgcgccttgctcacccgctccacctcgtccatcagctcgtgcgcgatgccatggttcagcatctgcattcacacatgttaatttcgacatgcaaagttaatactttgacaagcatgacaaatcaaagctaattagtaggcgttctagccggcgagcctactgagatgataagattgaattggtgggtcgactgactaagatggagaataagaatatgtttccatcctttcggccagaaagaacgatgtacgtataggtggctcgatgaacaaaaaaaaatcgaaacatatcaataagttgtgcggccacttaggaattagctagaatcatattaacatttttttgctggttagtacatgctagtgcttggcatgcatatgcacctcgaagaagccccagttctcgcaggcgtcgcggatgacctccattgctgcgcccctctcctcggtctccaggttctccatgttgatcaccgggaaggaggcaacactcgccatctctgtctctctctctcgttcactcgctcgctcgcttaagctgagtgtgtgagtgcgtctgtgtgtctgtgtgtgcactctgaggccggcggcgagcgcccaatttataggcgcgagagcgagaagctagcttgcacagttatctttttcactaggctgactgcctgacccccaggacgtggtgtgcggtatgccttacttcctacatctcaaaataagtgcagccatggttttccgcatctaactttaaccgttcgtcttatttgaaaatttttttaaaaaaattaaaaacataagtcacgagtaaagtactattcatgttttatcatctcataacaacaaaaatactaattataaaaaagtttcaaataagacggacgatcaaagttggacgcggaaacttatggctacacttattatggcacggaggtagtacgagtttacgacaaagtttagtgatttggtccaacggagagtaaagtagtgtggacgtaagcaagctaagctaagctaagctgctaatctgattatctgatctgatcacactgtgtcctgtgcacgccgcaggttgagttcatgccggttacccgacacagtcacaaaaaggttctccacaagatttgctcttactcctaattaatgtctaatgcctttgtgatgtagtagtactatagtgtaatactataatggtagtggtggttactattctatatacctaacctaagtgatcaactctattaagtagagaactacagatcgataagagactgttccttgctttttggatttgatgatgacagaattttgggcatagtacacctggcccagacctgatcaatttgatttgtcaaatgtagacttcacatggctaggtcctatggacacatatcaggttttttaaaaagggtgtggcaatttattatattaaagaagatataacattttaagaaaaaaaatatcaaaccatacattatgcaaaaaaaacatacagtgcttagtttgttaggaaaaaaccgtacattgtgtccggccaataccacctctataaccacctactaaaccgaacaagccaacctcctctaaaggcttccctgcttcacgttgattagtccacgttcaaaacaaaccgaccaacctcatcctatcaaatcagctctctaggcaccaaccgatgcccacatggagcaagagtgtcgtctgtgatggctcgctcttgccgtcagtgtttatggatcgagaaaatatgaattgaattcatagaagaaaaatatctgtattaggcagagagagaaagaaaaagaatgtgagaggagaggagagggcaggcatcggaagtgggtgggtgacgttgccgatggtggcaaggtggtgagctaggaaggtggttcagacctggtggagtcgcctcctggattgctcatgtacatattgtactatgtatttacaagccgtcgctcatcgtcgttgtcaacctgtgcagtagcagctcgacgacggccacctcgacccgtccgcagtggtggcccgacgaaggccgcctcgatccacatctgcctcaacctccttgtcgtgtcgatctggtcgacgttgtccgattcgaggctccaccgaggagaggaccgccggatggggggagaggtgaggccgccagccatcggaggagagaagaggaagaggagctcaagctcgaggccgccggatggggagaggcaggaccgccgactgtgggaggagaggagatgtggagccccggcgaagtgtgggcgaggtgggaggcgaccggatagggtttggataagcatatctatgtggctgtttttcgaaaaaaaaaaattcgtattttttatgtttacagcgctacccctaaaagcgaaattttctcatcttagcgttgtacttgtctgaaacacgaagggttttccgtaagaaacacaacagcatgtttgcgatacgtgaattacaaataaactggaggacatttttgccgattcccactcgaggagtcctgtatactagaaaaacatgtgtcgcctaaagagaagagcaaaaaaaatattgaaaaaacagagaaaaacggagccctacgaactgctaatatctatagatgtaccaactgataccatgaggttgcatgagatttaacaccaaacaggcacacgctttcttgttgattatttgataccaaattattttttggttatccagtgtatttttttcttaaactaattgatatcttccagtaaaattcagttgaaaactcttgaggcttaaacagatctcatttcagtcagtacacaagcattacatgatgcttaattacttgcatcaatggaaccaattactcttttttgctgttgctggactggaccccgagaccccagtcccaacgattggttgattgtcctgtcgttcctgttcatctctgatcatgtcccttcttcctcatctctgctttctccatcatgtaggggccggaagaactcctatatccacccatcgctgcgatctccacttgacttttctggacccatctcattgcctcgctggtgtacatgcatcaatgcatgcatggtgacggtgcgcactgatcggccggcgcccgttcaacttgtcgcgccgcaaggaccaatatgtctcctgcccggccgtgagtgcgctctgctttccttggtcgcgccggttttggggatcgcccgaacaaacgtgccctggcctatactgggctcaccggcactccggtaggttcagtgcattcgtccggaaaagaaaaataaaaacgtgtacatacaaaaagttgtcctcaaaatatagttagtgtttattccctagaaatatagaaaccggttctgatgaaccctaattagttattttccgtaagcacttctacgatatgaatgaatgataatgtcactatttgtttatatggcaaaaactgttgttggccgaagcactcccttcgtcatttctgtttcctactgacgatctccggaccaactgctagcgtatgttctttttctttttcaaaccgtcccactaatcaaaatgtacttagctaatttgatgtatatatatcaccatcctcgtcattagcggcaaaaccaccgtacggacaggttggacggtcgccgagcttcgtcacttcgatttcaatgacgactaacgttgatatcttaaagaagtggtcgaccactataacgccggccctggtttgacaatgccgtcgactctctcactgctcatcatggtttattgggcatacatcttactagattatttggacctgttttaatttcatatttagagggtacaatatccgggccatttctatattcaaggttttaggaaaatcaaccatagtactttagagtttagagtgacggtagtctgtttctaaaaaaaaaagaaagaaaaataaggtgcaagtggtgatgtctaagtggttcaatcattcttgacgtatgacatagggaatgtttggtcggatatgtagaaatctttttcattatcacagtagatcttcaaaaaaagaagactttgtatcgactaaagtatatacttcgactttcatgcgctagaactttagctcgtaaacataaaagtacggtacgagcttttaagcaatggttgggttcggtattttaagaagtttgggatacaatgataaatgtagcggcaatattataggggttttgccgttgtgctgcagtggggagctcatggaacagtatcttttgcaacagtctcgggagaatgatcagtgtagaactgtagatgtgcaagttgccaaatatactcgaattgtgcccgaccgacacaataatagagggcagaataatattcagaacaagtctcctgcatactttggggttttgatctttcacaaattaattttttcataacataaatacgtactaccttataggaaacctcaaaatattctagcttagcagctgtcatacagagacatatctagagtatagttaggggtgttaactttagtcccagccacatcggatatttagatactaatttagagtattaaacatagactatttataaaacaaattacataaataagagctaattcgcgtgacatattttttaagcctaattaatccataattagcacatgtttattgtagcatcacatgggttaattatgaattaattaggctcaataggtttatctcacaaattagtccagggttatggaatgtgttttatcaatagtctacgttcaatacttctaattattgtctaaacattcgatgtgacaggggctaaaaattttatcccatccaaacccctcctaagcagagatcttaaacctcagttaattttatactatctgggggcaaatgactaccttacaatttttacttttttaatctttctacgtggtagtagatattttgctcctactcatgctacggattgagatcctctgagttactgacatgtgggccttctttgctatggacccacatgttagtgactgttaagtcacttgacttaagtagaggatctcaatcgagctacttcttaccttcatccttgttgtcatggcttttaatcgtactagtaggttacgcgtctaggagtaccatgtattatgtactactaacatacttcttcttttcatattataagatgctttaacttttttttcctaaattaaatttatctaagtttaactaagtttatatgaaaaaatttcaaaccataccaatatactattaaactatatttaatgttagatttaatgtgactaatttagtgttgtagaagttgctatatattttcataaaaaaattggaataatatattttcataaattcgacccaatctattcaaatttaactaataaaattaaagcatcttgtaatataaacggaggacatgatatagggcatgtttagtttgcgaaatgaaaatttttgggtgtcacattggatgtttgaccgaatgtcggaaggggttttcggacacaaatgaaaaaactaatttcataactcgcatggaaaccgcgagacgaatcttttgagcctaattaatccgtcattagcacatatgggttactgtagcacttatggctaatcatggactaattaggctcagaagattcgtctcgcgatttcccccttaactgtgtaactagtttctcttttaatctatatttaatgctctatacatacatccaaaaaattcgatgtgatatttttgggaaaaatttttggggaactaaacagagcagaaagggatcctctgacttaactgctgtgcagttgagtcacagttaagtcagaggatctgcttccaaacggggccataatatgaaacggaggaactatagtatttgggaccccggctggccaaggcagtaatcataagagcaccgtcacgtcgcgctccgccacgacagtacgacggatcacctgtgcagcggccctacgaaatgaacgggagctaattagctagctaggcacgggtgatgggtcgccggcctccatcgcaatcgcgacggggtcgcgtgaccggcggcccccgtgaagacgacgtgggcgcgcgcgcgcgcgcgtccgtctcgcgtgcaccagctagcagctgcgcgcgaccaagatcgggttacaacagtcgaccagaaactggtggacgacaactcggcaactggcttgcatgcgccgttgcgtcggcgtctgcgtccaaaagagaaatcgctgtaggatgatttgtatatatataaacgagttgtagctagatgatatgatccataagttgccattggtgattggtcacactcttccggaatatgatatatcattatatttactgtcacgaagagtacgtacgtaccaccgaactctatcacatccactttctgaactacaaaacggcgtagttttttttttaaaaaaaaatctatgcatgaatattttgtaatactattttaaatatgtttttaactttataataagttaatggagaggtatacctatagccctaccaaacggtctgagcttcaccttaaaaacagaaagttgagctagttcccgctctacaattctacttaagattttaaaaatggagatgagattaggctgctccacaattctacttaagttttaaaaattatggtcacttttattatcccttggatgatagacaatgtttctcataactattatatcacttatcgctttccaatgattcaacaataaattatgataacatacaaaaaaaattgtaaaattatatgtaataagcttatatatggttaaaataaacagaaacttacaaattttaagacctcgatatctaggagaacctctatgttttaggcggaacactagtagtcctttgggtgggacgttgcgaaacccataggggctagttttcttttaaatttcactatggttgtgttctcttaagtcctggatcaccgaacagatttagatttcttataattattcgaggatagaaatgaatgaattaactagaaagtatctacatactatatttaaggtaattatttttttataagaaaacagtcattttttcctgatagcaattaatttaatggttttcatatctctcactattccttatccaaaataaagttgccgcattcttagctaggtaaaaggatgacaacggattactctaagctacacataaagtaaatttaccatccataattattttataaaattagatgcaaaaatattcagacttataaaaaaaggtaaaccatatataataagaaaaacaatgaaattgcagttaaaatgaactaaaacaacatattgcacatattataactctagacatagcaatatataaattttacgtgactaagatctatcaattcccttttgttacatcaggaaaacatatatatatagttagtacccactaattcgtaaagctcaacataaagtatgctacatcatcatccactagcaattattatctacagtattttagatctcatacaaacatgatatatcatttgtaatttagttttatttttagaacttagcatgcaagcaatataaaattaccatcttcacattatttaaacatatacacctatcatttttataatgtataacatacattcatccacatatcccgcagcaaagcgcggggtatcaactagtatcaaggaaaaggtggaccataggattattcgcgcgtacacccatccaagtaacagtgtttggctttgcaaagccaccggccggcaaaaagatcacaggcatgcatggcttctgttattgatatttgtccgagtgtctggaatctaattctaggtgtgtttagttcacgttaaaattggaagtttggttgaaattggaacgatgtgatggagaagttaaaagtttatgtgtaaaaaagttttgatgtgatggaaaagttggaagtttaaagaaaaaatttagatctaaactcggcctctatgtacgcgcacgaagtgcagtaaaaaaaacacatagctagtggctatggagattttattccgttatacccgctatatatgatatggagaattgcgcaagtcaagattcagagaattacgaagtgcaccaaaatgcttcaacgaagcggcagacattgaaaacgttctcaagctgcagtcactgaaaactcagaatatataattgcgagagtgcgagactttcatgcaatggacaagatcaagaacggggtgcctggatatataccgatcatcgttcgctgtagcctatccagatgccgtgtgatcgtgccaagacgtttctctgctttcgcaactttcaaacttcagtaccggcctagatttcgatcttgcatatagccatgcaactccagtgcgaaaaacaaaaagggagatctaattgcgacgccggaaagatcctctcccatcgaggccacggcaccgagagcgtttgcaagatcgcgggtgaaagagatggagatcgatcggtgacgcgcgacgcgccgtccatccccgctgactgaccagtcggccgatcgctcgcgccgctgcgcttcgtcatcctgtcgctgctgtgaaacagagacgacctgaagctacgtgccgtcgccattaattccacgatagcgatacgactacgaggcggcgaaagacccagcaaaattttacactccggtagctgaatcctcagcaaaattccacgatagctgaacacgtttggccggaatcaccattcaccagtaggcagtaattaactagctagagtaccaattttttggaagcatgagccgacctccattgctccacgcgtgggacgctcgaaacactgctgctttccagctcgcacgctgcggtgttgcgtgcatttcatggcgtatcagcgtggtgtatagcctagggaatctggggatgttaacgtcaccggacgagccgtagaaacgagatctgtttttgtttggtgcgttgtcggcaatgcgtagctgatggaatgttggattaaagtaaagtctctcaccttacatggactctgcttgttcaagtggacctccctgttagctgcatactagtgttgttttttcatcttattatactttgtctcatcaaaattggtcagtgtcaacaagtggacagttaatgacatttgcatatatactagagttctatgtttatcactagtgtgtagagactatagtagcccataaactaatcaaggacttctttcagagaccaagtcagaatttagactctcgtttcaaagaaatatttcaaataaatttcacaaaacaacatatatatttgaactaaattattacaaaatggaagatttaagacggtagatcacaattataaatttactagtaaagttatcactaaaactacaaatttcagacggagtatcacaaaactataaatttaatgaaaaagttgtcataaacctatatattctagaattcagatccatagaactattggattttagttacaaaagatatagtttgtgatgaaacttgatgtttaatcgatacaataccttaaacacatagtttcatgataaattaggtttgaatttatagtttttttatatatctttttaaaattttaataaactagcatggtggcccgcacagattgtgtggctagcatcattatatttttctctcatataatagtatatatatttttctaatttattgttaaaatatattaaaatgataatataattttaagagtatagtgtaccagcggttcttaaacttgtaggggtgtgtcatctaggtctttaaaatctcaaaatgcatatccaaatcccaaaatttgtcatagtgtgtcatctaggtcccaaatcgtcacaacctcttcaggatccta

SEQ ID NO: 11728 - DNA, 14094 bp, Oryza sativa
  unsure (1)..(14094): unsure at all n locations
tctgattttcgtccctgaaccacaaaaccgggggcaacccgtcccccaacttacgaaagaggtccctcagcgattttgatagcggttttggttgacgtggcgcttacgtggctcatttgactcagtctttatctgacatggtactgacgtggcgcttacgtggcaatttgatctggaaaacaaactcgtgggacccacatatcagttgcacatacaaaataataaaaataatgatgggccccatatgtcaccctatttctcccctcttactgtatctgttatctctatcctctctctcagtccctggtgggagaggaccacgtgaggtccgccgtgccaaggctcgggaaggccgaaggctgacggcgctcaggaggcggacctcgccgtcgacgccgccgcatgctccgtgcactgccacgcctacgccggggatggtcgccgccggcagcaaggagctcctccgcaacgaggactgattcaccacggaggacgccgtggccatggacttccccaacatcgtcgccctcgctgagacgccgacggccaggacatcgccgccgccgccgctgccgaccacctcaaggccatctgagcgagctagctgctctcctcaaggccatccgtgcagcgccggcgtgccgcccagagatccttggcgtcgaggcggctgcagcggagacggcttcccgctcccgctgccgccgcggctccttgtggtgctcggtggcgtacgcttgcgggtgaaggtggcagagcagcaccccggacgtgtccgcctccaccctggccgacagctgcctcaaccgcgactccacccagccctgtgagctttggcccagagaaacaacaaaacacacgcgaggtcacacacgcacgaaggaatacacaagtgatgcaaatacttcaggggacaaacacgagcttgcggcgaactagctacacttccactcttatttctcagactcagtgatttgttagtcaagctacaacacatgcagttaccgatcattaagactaagcagtacttaactaatcaccacccacatggcgccggccttgacgatctcctggcagacgtcgtcgccgacggcgagctgctcggtggtgacgcgcagggtggcgtctgaggccgagctcgccgtcgtcgtgctcgatggcgcgcagcatcaccgggctgggccacttctaccgcgcaaagacgcggaagaagcgcgggagcagcatgctggggaggtgttggggtagagctggcacacgcgcgccacgaggatagcccagccgatgccgccgaggaagcctgcgacgttggagtagacgccccgcgccttagcccagtgcttcacgcaccgcagcatggtgcggaacgccgcggtgtccgggacaagccgcaggatctcgtcggccacgcggatgccgtgaggctgcgcgccgtggcgaggtcgtcaaggccgcggagcaccgaccggtcgcgctgaggtccactccaggttgtcgggcaccacgggaggcacacgccggcgtacacgagatccacctgtacaccgcggaacctcatctggatcaccggcaagggatgtggcggtggcgggagcggcggcggagtccgtggtggtggcgctgctggagagaggagagagagaggaaatgggatagagatgaagatgccgagagaagaggaggaaatgaggagtgaggatgacatgtgggacccatgtgggtcccactattttttatattattttatgtgtgcaactgacatgtgggtcccacgggttttattatttacccggatcaaattgccacataagcgccacgtcagtgccacgtcatatgaagaccaagtcaaattagccacgtcagccaaaaccgctatcaaaaccgtcgagggatctcgtttgccggttttcgtaagttgggggacgggtcgtacccggttttgcggttagggacgaaaatcagactggtcaacaaatagagagacctaaagtgaacttattccgttttgcagcgggggccgcgtccgtaggagtcgcggtgcccacggcccacagcttcgtaatgccatccagagttttgccatgtgggcctcggtgaatacgggctttatttcgactgttccacggccgatcgaatgaacttttcggttttcaaccttgcgagttgcgaagttgcgatacaccagcttttgtgtgatgaaatgaaacccggatcagccgaaagtgaccgacaaatttatgaacaagtgtgttgctttattatcagctaggagaaggccatatatatgtagcaaaagcaaccaaacatctcgatcggggccctgcagctttgcgatccgaacaggacactggatgcggatggatttggtaatcaaaaggaaaaggggtacctgaccggcgccaatcttggagaggatgttcgtttcgtgcgtgcaccgtgcgcctttgtaaagtgcccgaggttgctgtaccattggaggatgaaggatgaggtttgttggaaatgccgtggcagtcgtcagataatatataagataacgaacggacgggccactctgacagtgcatttgcttgttcatttgggagtttattaggagtagtccgaatgtttggttgctcgagcgtctatttttggaaattgaatttcatgttcttcgtcccggtatgtttcgtaatctcttttaccaatcattatattctctcatggactagccttcataatttgctctgtagcctttgcatatcgtgacatttttttcccaacccaaacgcgcccgatttgccccgtccggccacttgggagtagtatatcgaatcgctttcgcaaaggagacaactctgcagcaacgtcgcgtcccatccattggcccgcccggcattttgcatgctgtagatcgcctgtagctgagcgattgggcaacggcatgctattcaccggcaattaccactttacaaccaactcaaagtcttttttgctaaaattaaagtaaaaaggttgcaaacggataaacgatactctgaaaatgcacggttagtctgaaacttttgtgtttctgaatataaatcagggttggatacagtatcttttacccccaataagaagctagagttcatacgcaatgggacttcgtgttttttatcgtcaaaaggaaccatggtttctctgttcgacgactttgtgtaacgaacgccgcatgcatttctagttttcagaaccttgttaattgtgttcttttgtccaaaattgtaccagcatttggagtctatacggagcaaaccacttgataacttgcacttgcagcttacggcgatgatgactagtgaagccttctgcggcaaagcggcagtagtgactgttacagtgtgcccttcattgtctggagtgcagaaaatgatatctgcagggttccaaagtactgaaaatagttcagaacattgcacccaaatttgatttgttttctctttccggtaatccacagccaccgttttaggtaggatgatccactgttaaatgagagccacacacattgcaaaagcaaaacactacgacaggaggacaaatcgggtttcagagaatnggggggggggggggggggatccctttcccctttgtttattagtggcctgatgatgcagccttgcgcccttgcatatatagtttgcatgttgcatgcaggttttatctgatctgatctgctgcactatactggaatgcgactggagagccacgcgcgcgataatgcatcctgactaggcttgcagatggggagttttcgttggtcgtgcgagagcttaagggctaagggtgcgctcgtttcagtagttaggataggctgattagccgtacgtaaaacgagaaatatgattaacatataattaattaagtattaatatataaatttttgatgaataaatttcttggatttttttaaataacttctttatagaaagttttcgtacgaaatataccgtttagcagtttgaaaaacgtgctaacggaaaacgaggagaatctaatcctataagctgaaatgagcgtaccctaaggcctgtgtattgtgtaaataatgctgccttttgccattttggaatttcaaaatccccttttttttaaaaaagtgtttgtaaatacagtaagaaaacacaaactaaccgtgccttgtagactttgtagtggattctgtgctcagacaactttggtcaaaatccatacttacctataatcttctaggacgtctgaatttcttgacatggatctagatctgtcgcgacaatgaaactgatcaagattctaacattgaccttctgatccaatacggattatctggttgggtccaaatgtgtactgtaacttcttttccagattcaaagaggatggcgcttgctgccgtcgaccaagccacctggctgcggacttgcatgtggctcgatcaatcgttcacagcgtcaacgaacgatcaaaccacaatgcaattcgtagcgtgcacaccacgaacaccaagatagaagattgacctgacccgatcgatcgattgattgaccatgtttgctgctgctctttgatgctctgctcccgcttgtggtgttatctccacgagggttgctttcttgtcggtaccaaaccgcagatcagtggtcaaggacgggttaggaaaataagaactgtacaatgaaatggcccatagtccagtgaactgggcagtccttcagacgagtcatgctacgacagcaatacaatatgctgatggttttatgcatttctgctggattttacggttagagagctcagaccaaaagtcacctttcatggaagacaaaattttctaagagtagatgcagcttgtctgactttgtgtaacttataatcgtgctactgatatatgtatcatagtaaagtataatctgtatattagtaatttaattatagactgcacaaagtcatatgatctaagtttcgaaaacaattgcacataagagcgcgtattgaatttgcaggaattggtaaatcttccatatatgtgtctcatgaaactctcacgtgaccttggtccttgtacaagaggtcaagagcatgcggcgttaggctttgagcacggataaaacgccgcacttcgccagagctatcacatgaccaaacctgcgcatttacaagctaagtgtttcaacactaggtgaaatggatcgtcgcatcactctcgcctaaaaatttcctctctcagagccgtgccaacccacatcggtcacgctcatccacgaatttacaacttacaacgggacgcgtactgtcacgtacttgacgtacatagtgcccctctttatcctcccccaacttccgcctcccctctataagtaaccgtcactctcgccgagagtctctcatcccaccacacgacacgacacgagcgcgcgcgaacaccgtttctactaagcacaaacgcgacgaacacgcgcccaagaggaggatatgcagctggagatttcgccgagacagaggagccagcagcagaaggaggaggaaggcgagcaccagcagcgcgccggcgaggaggcggtgggcgccgtcttcagcattgagccgtgggtggacgccgcggcggtgctggtgccgccgcttaacttcgccgaggtgaacgacggcatcttccgctccgggttccccgccgccgacaacttcgcgttcctcctctccctcaagctacgctcgatcgtgtgagtcctatacctaggatctctttctcggccacggcgaccgtggcggcgagctcgtcgattacgtgttctgacggcggcggcgacgccttggcgtggttgatcggtgcaggtacctgtgcccggagccgtacccggaggagaacacgcggtttctggagcagaacggcatcaagcttcaccagttcggtattgacggcagcaaggtaaatgaacaagtcaaaaatcatatgcgttgagtcctttgattttctgctttattttccacggatggcaaagtcgatcttcgcatcgaattgttttttggtttttcggtcgatttggtgcgttctgcttgtggagataaataatttgcacacataatttgcaccgagaaatagcaactggtatcgcattacagtggatgcgagggttactttaggtagaacgcgctgtttacctgtttgacatgagcacgcacttgcgttttctgcgcgttgcctcgtgtcgtatggccatgagctcgttcgactactttccgttaaaaaaacatgggaactgacaactgatattgctgcttgcttcggcaaaacacttgggggcaacgcaactagggcaaacaacaactcaactagaacaaacaaaagtccctttcttgctttatctttgcccctttcagttagggcatttgcttgagtctttcaggctgaaaatgtttatcgtttttgggttttgttaacctaaattgacaaggttacgtggtgcatggtgactataaaacaccctgtttgagcaaaatgcatctagtgcgctactatttttatgttcttatttcactaattcgttttcccttctcacaaaatagtgtagaaaatctcattatggtaggagttattttttttacaatgcaaaacaacagtgtcagttaagcgggttcttgcgtcagcccagcacccatagaagattagaagttgtttacaatgctgcaaaagcgtatcttgctactggcctactgccattagcaacagtaaagcttatctttgttatgattattctggtagcgttgtgctacttttctagaagctagttcaaactgattggtagactcatggctaaggaaaatattttctatttcagcatcacgcatttcagggttaggagatttttgtctgcattatgccagtctggttctgagttttactgaatactgcaagctttaagggtaaaaaaaaaaaaagaaaacaccttaagcttaagtgatcagtgatgcagtacagcacaagttctactccctctatcaaaaaaaaaactaatcctaaatttgaatctagaaagacggagggagtagctgagaaatgatgggcttgtggagtctcctctgtgaattgggtgcctaaacaaagatcaagttgacttatgcccattattttttttaagagaacttatgtgaaaaaaaaagaggatcaagttgacttatagtataatcgcacctgtcttttaactgtcgagtgacgtctgaccagcgtaattctttcataaatttgttggccatgactttaattccgttattaaccagccacccaagattaccatttctctgtgtgccatgccatatttattctcattttactagtccttcactgaaagccattagtacggttttgtcaagctgtccatattaaaagttcatttaggcatagacgcatagtagccttggagtatgtcggtatattactccatctcgcaactttagtactcgtgtcatcgcgtggtagcatccaccgcaagtctgcaacaatgagaacatattccactgtcagttctgggttcatgaaggcatgaactgccacggcaaatggtcaaagttggtcagcgtcggcgacttaaggctgaggtcgttgcttgggttaggtattcatccctagttcatgcaaaatgacataactcattaacgtatgattaattaagttttagtttttttaaaaaaataaaattaatatgaatataaaatttaaattaactttcatatagatttcatatagatttttgttaaaaaaaacaccgttcagtaattaaaaaaatgtgcatgtgaaaatcgagtgagttaagttgggaccttcaaacaaaaaaaaactttcatcgttcattggcgattgttgctgtcgatgataaacaacacagatgtgctgaccaactttagcattcccagcaaaaaagaaatatatcgctgagtgaaaagacactgatcaggtggctgaccttactacaagtgtgtgaatggaaattagtgctcactttgacattgtctggagatgatgcttctttttcgccggactcaagctaggtgtctgaaaccactgaattacgagggtcaccggtaataattgtgtcactgctagatggattctaggatggtcactgctagatggattgtacggtggtgtttggatcaaggactaaactttagctcctgtcatatcggatgaatttagagtattaaacatagactacttataaaactaattacataaatgagagctaattcgcgtgacaaaatttttaagcctaattaatccataattagcgcatgtttactgtagcatcacataggctaattatgaattaattaggtttaatagattcgtctcgcgaattagtccggggtcatataataggttttattaatagtctatgtttaatatttataattagtgtccaaacatacgatgtgatatggactaaaaagttttagtcccatctaaacagggtctaagcttgtttctttgttaactagaaccaataatgtagtacatacttgagtggcatgacgatatctttgcatctgaactttcgataaaggtgaaccttatcagttaccgcattagcctgaaactgtgaaacaaattaaaacatccttctattgctataccatatcatcagtaattcagtatgcatccaactgaccattctcttcaatcctgttgactcttaaagttgatgcatagcctgacaataatctgaaccttgctgttacaggagctgcttgtaaacatccctgaagaaaaaatccgagaagcactcaaagttattcttggtatctgcctctacaaagatatatccaatgtctcaaaatttcatcacactatctgtatctaactcttatcgttttgatcaattcagacgtaaggaatcaaccggtgctcatccactgcaagagaggcaaggtagctatatctatttagcattgcacatccctgatatcccattttcttgaaaccttttgctacatgggaattcgacggtttcctgatattccacatgtttcagcaccggactggctgcgtcgttgggtgcctgagaaagttgcagaaatggtgcctaacttcagttttcgacgagtaccagcattttgcagcggcgaaggcgagaagtactgatcagagattcatggagctgtttgacacatccagcttgatgcacctgacggcctcacagtgttaaccgaaccgaatgttttttcatatccggtcccgatctgtaaccatgctgtctacctagcaacatattgtaatgttgctattgaaacaattcatcagagaataatgttagaaccatcattatcctcataaaagtatccatcaaaatacaaggccttcctcttttttttttgtactgcagagatacagtagtcgcagtctcgcagattctgacaaaatttggaagctggatacgtgaaattactgcatcgctaacatattacttcctagatgctgaaatttaggatcttgtactcgttttgaaatctgacaggaatgtgcttatgtgcaacaacaaaagatcttcttttggtgcaaaaattacctgttaacaggatggattgcactgaatactcgctaccccagtctcctgtgtcctgacttctgagccctagccaaaaggagcatcaaatttaggaggagaaaaaaggaaaaattatccatcgagtccagatgaatcctggggaaatcttaacaagaaggaataaaaacatgaagtgaagggcatcattggactgcatcctcagacttcaagataagatcttcatggagttcaagtcgatagggcgacaaacaattcagattcaaatttgcagattatttggatcaaagcctgaacagagaataggcccaacggccacctgtctggttcgcgcgttctcccgtcggatcccgcgatcgtccacgccagggtttacgattccgatgaaatcctgtcggatttcgcgaaattgtgacgtttcgatgaggctcaaaagtagaaaccgtctgagatttcgaagagtttcatccaaatttaaatttgaattgataaaaaaggaaaaaatcaaataaaatcttataaataatatgatattcatagaacctattgggatataatttttttgaaaaaaaatgatatattgtgtgtatttactgaaacttacatcaggaaagaaaagaataaagaattaaaaaaggaaaacacttagatgggccggattacttatcgaaattttgatgatttcgatcggaatttcaccaaaaccgatcggttttcaagaacttgtcggcaaactcagggaatttgtattcaaattttggtttatgaaatttgttcggaatttaccagttttccaccggatttcgcgaaattccgaattccaccggtgcccgaaacggaagcgtctgtcggaattgtaaaccctggtccacacactcccagctcagaccatgtttagatgggctttaatcccggcccacgtacatgtgtaggcctcgattttgaactaaaatgccggcccataaatctttagcccataagccatccgatcacgatcaaaaatggacgatcggaaaatgaacggtggatgcgggctacgcaccgaaatccaacggtcgatgtaacccccaagaccccaacaagccctacaagctaatccaatatcacgccgcacggagaagtcccgagaccggcgccgccaggaccgccacccacctctgcctccgccctccaaaccctagctccggcgatggccccgaagcgccccactccgccgccgccgccgcctccggttgcctcctcagaggaaaccgcctccggctcggactcggacgagtcggaggaggaggaggaggagagtccccttgctcagcccgcacccgtggtctctaacaagggcgcggagtccgattcttccggggaggaggaatcggaggaggaggaggaggaggacttggtgcgctcctccgctaccaagagcagggatccaccgcaggagaatcgcgaggaggatgattcgtccgatgaggaagaggacgagtcgtccgaatccgagaaggcggaggcgccgccgccgccgccgccgaatccggctccgaagcagggggcggaggggaatggcccgaaggtctcgtcgcccaagaggcaggccttccaccgcatctggtcgaccgaggacgaggtgcgcatcctcgaggcgctcgcggcgcaccgccgggagcacgggtcgctgccacagaccgacgcgctcatcgccaccctcgccggcagcctcgacaacactggctacggccgcaaggagctccaggggaaggtcagcactctcaagcgccgttacgaatccaccgctaagaagaagggcgatctcccaagcaagggccatgaccgccggctctatgacctctccaagagcgtctggggcagcgaggcggcagcggcggcggtgaacggcaccaccaccgcgccgagggagttcggcgagatgtgcgagctgtacccgcacctcgctgaggaggtcaagttgctggaggcggcacaccctggcttgttcaagagggacttcgggaagctcgatgacgacaaggcgcatgcgctggacatgaagatcaagaagcagaggattgccgagatttcggtggtgctgcgccgtggcgacctgaccaaggaggtgaccaaggtgctcgctgagctggtcgagtgactaggtgagctgaactgaagtgaacagtagtagctcggcgttccttaccatggcataagaaagtgtacctggtcattacctgcaaactatatcgtgaacaggcattacctgcaaaattttgcttcttagtgatggagttggatgttctatgttcttgtctaggcaattcagtcagcgtctcttctcagttcagatagatcgataggatgtagtataaaacattgaaatttcgtttttggtttgtcttatcattccagacagtgatagaatgtagcaagactgaaatcggtcatcgaatcagtcctgaactcttgactcctttataaactgaaccccagtcctcgttaagtatgggttagtgctggcagtgtgttgccctagcctgaggtctctgatatggcaacttgtcgcgtgatcagtgatcgtctctgtctagctgacatctctcctggatgaaatcaatccaaaaaaaaagaaggctttgatcagatagattagggttcacacttcacaactctgacgtttcaacgcagcgcgaaagcaaattctgttggaatttttgaatcgtttcagaatttttcaaatttgaattgaaaatttatgaagaatattttaaaaataacttgtaaatagtcctacatttgtagtaaatacatgcatatgaaatgtcaaaaaatataggcgtagaatgaaaatgctctttggacaacaactgaattggtaaattgaaaaaagacatctagaagggtttacaatatgtgttgattgtgtatgcactttatattatggactttgtattgttgttatactatgttgtttatgcactttacagtatgtattgattgtgggtgtactttgtattgtgttgatgtactttatattatgcgtgttgatgttaatggcgtaacatatatttggttatgcatatttaattgtcaatgatatggacttcaaattatcttgtatttgtgttcatgaatatacattgcgcttattctcaatgtgaggttgtcaaattgtaggaaaggtcatgctgaatttctttattaatttcttacattttcccacgtttccacggtttccccattttgatatccttttagtttgcaatgttcctatcatctccatgaattttctcatatttcaaacattttcccctattatccaaatattcagaaaacacaattaattcccacgctactctttggcttttcagcaaatccaatgagttttagatgcttttgtttggtttccaaaacactggaacggtggtttcctgttcgaatcaactgaaatcctggtagttccggttggaattcggtgattttgatcatttttcattgacgggcaaatggaacttgagaatttggcttcttaattttgtttgaaatttgacggttttcgtgaaaaccgttatactgacagggtcaggagcgggacctcgattggaaatataaacccttgcctgtaatacggtacagccgtacagaattcgtgtggtggccacgggctcacgcaccgggtcagtgatagcatccagtggccaatttggccatggagatgatgcattttttacacggagaatgatcccagaaacacgcatgatcttctcttacaagaattttctaacagaacatccatttcaccacacccacttgttcaatgcagcgctgttttgtaacccacataacaaccggacccagcacgtctgaaactaaggttactcatcggttacctaaattaaagtactccctccgtattgtattttaatgtatggtgccgttgactttttttatcaatatttgactattcgttttattcaaattttttgtgataatgtgaaaatatttatgtcatgcttaaaaaacatttgatgatggatcaagtcacaataaaataaacgataattacataaactttgtgaataagacgaatgatcaaacgttagataaaaagtcaacagcgtcatatattaaaatatgaaggtagtagtaatttacagagatgttttagcgacctaaaattctcaagtttgaaattttaatttttggttttcatttatgaggacaattgggactctaaccactcccccggtcgcttcgcgacgcgtccgtcccgacctgccaaattcctcgcacggattaagcaaaccaaactactcggattaaatgcgcaaatcgaaagcacgcgttccattgggagaccggcaaacttcgttttttccttcgagaggaacggagacggagtttgccgtcgtcgtgtgcgtgcctcctcgcgtacgcacatttgcccgcagcgccgcggcgcgcgaggctaccccgaccccgacgtggtctcctcccacccatacacccttccgcttccacgcccacacacagaacccaattcccctccctcctcctccacccg

SEQ ID NO: 11729 - DNA, 4417 bp, Oryza sativa
  unsure (1)..(4417): unsure at all n locations
tgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtttgcttgctcgttctgcttacacagccgagatggataatggattggccgtggcttccatattccgccgatcgattgggaattttggatgcctatcctaatttcaaacgcagggctttgtaattgaaatgtcactgccccgcaaaaaaaaaaaattgaaatgtcactgaatgtacctttggatgtggcttgggataggtatccggtataaccaattttaacaaatgtagcaactattcaacagtatgcctttcgattcgtttgtagcaactattcaacagtattcagcgcttgagctgcgatttattgtactactgtttgtggtagcttctgaagtagtagcaggtgttctgattggatagctcagttttatttgacttgcacggtacattacagtttgttgttaatgtaagttttgtttagaatcaccagcagtggacagtattagttctatgtctgctctggttatcagtacctattatataatttgttcatcactagagttcttctctagttctgttaaaacttaaaacaagctgtaattactggttacttgatactgggattgtataaatgtatctctaagcatgtttatcacatttatgtctgcataggtcttgaagaaaatgtcagctcgccaaattgcgaagacagcatcaccgatagaccaatttcgatatgcactgcaacaggtcagtcacttcacatgttttacttttgaaaatgtctactttcaatagctccttaaacatagtggtatgttcctaaatggttttatgtactgtgaaaattttgcttccgtaccttagctgtgcttgtgatcttcagttcagaactaagtagtacagagtagtaattaagttctacactgaacatgcttatctcttgcatcaattgtagaatctaagctactgtgaccgatatcaaagtatcttttgttccttcgctcttacagccacatgatctctatcgtcctcttaactgttacaaggattgtccatatgataaaccaagtataccacagaagatagatttgcactaccttgctgactttatatctgtttcaaaattcaaacataaaactgacgttctctaaataagtaatagatgaatgatgaccaaacactatcatatgttttagtttaattcttctttctttttctagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgaggtttgtctatatgtatttttcagtatgcaggttttttttcttgctacctacaacaataaataatcttttactgatgtctattgttgttaatcatgttaacctcttttttacacagattcaaactgacctacagtacatcaaagaagatataagtgctgtggagagacataggttagaattatatcgaacaaaagaaaggtactcaatgaagctccgcatgcttttggatgaacctgctgcatcaaagatgtggccctcacctatggataaacctagtggtctctttcctcccaactctcggggaccacttagtacatcaaatccagggggtttacagaataagaagcttgacttgaaaggtcaaattagtcatcaaggatttcaaaggagagatgttctcacttgctcggatcctcctagtgcccctattcaatcaggcaacgttattgctcggaagaggcgagttcaagctcaggtttgtttctcccattgcgcgcttgatagtttggtactatcatattgcaagcatgtagacagcttagattaggaacttatatgtttattttgttttgatgtaagatgaaatgctaatgtgctatggggcatattgcagtttaacgagcttcaagaatactatcttcaaagacggcgtaccggagcacaatcacgtaggctggaggaaagagacatagtaacaataaataaagaaggttatcatgcaggacttgaggatttccagtctgtgctaacaacattcacacgatataggtccgctgattatttgtcctttttagcacattatgatcatggtagtggttatgcctattcatttggcttatcattcttttgttctctgtcatttatgcttcagtcgcttgcgtgtaattgcggagctaagacatggagatctgtttcactctgcaaatatcgtatcaaggttagtgcttttacaaaatatgtgccttatttcatgtgcatcaacatgctattggcaatgtggatgttgtcatagctgaatcctcaagccagcagtgagctgaggagaggttttggttggaggggggatggtctattgctcctatgagtcaaacttcaactatgttcaattagcaaacaaatccactaatcttgaatgctgatgtttatcatgtattataaggaacaaaatatgactataagtttgtgcctgtttttttggtgcataattttcatttccatgtctatctgtaatctcatatgtttttcagtcgcctaccttacatgagaatagggaatcacattgatatttcttaaatgcagtatcgaatttgaccgtgatgatgagctatttgctactgctggagtctcaaagcgcatcaaagtcttcgagttttctacagtaagttttttttcaggaatcttatgttggccatagctatatgcctgtatagtatttgaaaatactcaaatttggcctatcttatgtcgtaggttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccaggtatttcttgctctgttccacagttcattttgcacacttgtgttattttctgaacttggattcatgatatttatgtattcaatcttctttagagtgtgatggagtatgaagaacatgaaaagagagcatggagtgttgatttttctcgaacagaaccctcgatgctagtatctgggagtgatgattgcaaggtatttgcaaatttcaatggtacaactacttttgttattcccgaaagcaagaaaactttgcgtagttctcaaaatacagtaaaacataacttggatatatcgcatgttatgcaacatactaggattttattttatttatcagtttttcatgtccctttttctataatggtgcatttttctacctaggctatcccaacctcattgaatgcatagatggaagtatctgtattgcagtataccttatggaacctactgctgtttgtgctaggtcaaagtgtggtgcacaaagcaagaagcaagtgccatcaatattgatatgaaggccaatatttgctctgtcaaatataatcctgggtcgagccactatgttgcagtatgttcctttgattttcttggctcatatcaaatataagtttttttttccttaccagatgttacattattgcaggtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtatgtgtcattgagatttttcttgcactgcaattatgaaattatgtttttgccttttaagcagctatgacttattagtaaaaagtgatgttttaggatatactctatttcatatcgataaaaattggagctatagtgtttctttatttcctgggaaaaaactatttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11730 - DNA, 8701 bp, Oryza sativa
gaggaggacaacacggacgcggcaacagatgaggaagtagagtgcgaaggtgttgccctcaccaccgccgtcggcgcagagcacaacgagcacgtacttggctagctcgtcgaggtggggaaggacgtggccgtcggcgacaagctccgacgcggcgtggacggtggaggatgcggccgtctacgacgagctccgacgtgggacatggatgatgaaggacgcggtcgtcagcgacgagctccatcgtgggacgtggatgacgaaggaagcgtccgccggtgatgagctccgacgtggcgtggacagtgcaggatgcggccgtctacgacgagctccggcgtgggacatggatgacgaaggacacggctgtcggcgacgagctccatcgtgggacgtggatgacgaaggaagcggttgccggtgatgagctccaacgtggcgtagacggtggaggatgcggtcgtcgacgacgagctccggcatggggcgtggatgacggaggacgcggccgccggcgacaagctctgacatggcgtggacggtggaggatgtggctgccagcaacgagctctagcgtgggacatggacggtgggatatctggtaggtatcgtctgatacctcgcaagtatcacattctacgtggtaagaatcgcatgatatctgataggtatcatctgatacctcacaaatatcacctgatacgtggtagaatcacatgatacctgataagtatcacctgatacctgataggtaccatctgatacctcgcaagtatcatctgatacgtggtagaatcgcatgatacctgataggtatcacctgataccggttaggtatcaggatctgatacctcacaagtatcatctgatacgtggtagaatcgcatgatacctggtaggtatcacctgataccggttaggtattaggacatgatacctcgtaagtatcaccctctatgtgataagaatcgcatgatacatgatagatatcatctgatacttctcaagtatcacctgatacgtatgtgatagaaacgcatgatacaggttatgtatcaagacctgatacctaaccggtatcatcccgttcgaaaacgagattccgttatatagcagcccccgcttgaaaactaacccctcttaggacaaaaacacattgtttgaacatattttaagtcacaatatttttaacatatgaattgcatgtatgaaaaatcatatattttgatttgttggatatttagttatcttttatgaaaaaaaagcttcaattgaagactatatcgatgttgaaacgatattttttccaccaaaagtgagtactatttaggtgtccttggaagtaaatttagaggttttatttttttaagataaaggaaactttcttgatggatgtaaacaattataataaagtgatacaattaatctaagatcactcttggcaccagcatagtaggttgtccacaacctataattattttttagaaagaagaacgacatgataacaaatatcatgccatagtgagctacaaccacaagctttatactctatacacgcatcacttagaaaaccttaaaaacaacacctccaaaataaaaattgcattgtcattgccatgatccgatcaacaaaacccaaatcataggttttcatactagagaccaaattcttcgaattctagacaatgccttcaaccatgcgtaatgcgcatactgtagcggcaggaagccgagtctttcgatgatgcactagcactgagcccgaagtgtccacacttgcatagttggtccctctcaatttgcttgtgtttgtgttggagaagattatcgttatgtcttgctgaaagaatctatataaactttctacctatattaagggaaaaaaatcatgccttaccagtctacctaccaattagtaccaatttaagcaatacagtaatatatcgtcggagagtggattttgaactctcgagtgaatgacccatcgttgtttacatgtcactcaaatggttatgaaatttttttgagaagatgtattaacatgtgatatattactccacaaacatgcaagttaaatcaacttttataagttgtaaaaaaacaaactacagataattaaagtatattcatagtcaaatttattttttcgttacgatatgtagaagttaaatttgactttgtatgtttgtgaagtgatatatcacatattaatatattttctcaaattttttcataaccatttgagtaacatacaaacaacaaggagacatcccctcgagagtttaaaatagtttccccgtattacccagtttggaggaaaccagaaatattttaggccatagccatgatacaaggtgaaacggttttatttcagaatctggttacaagagacttgaatttcctttactacaacggaactaaattcaacacgaataaatctacagacaatttaatgaaacaatcaataactttccgacaccttgtaatcacatcaacccctgagcccaacgtccatcagcatgagcaactttattctccttaatatcgtgtgttgcagtctcagttaatcgctcgtctgaggtgatgagcagccgcagaggagctgccagatgctcttcttgacgttgttacgcttggacttccccattcttgctccaggaatatccgagctgcacaagctctaatgctccaaatgaaatgctcctgtaaacaaaggaaccaattgaaaatctcctacaaaattacgcgaagatgaaagaaatatacacagctaaatagcaaaaaggaaccagcagagtaaaaatagaatgctattgtaacctccagttaacttcttcaggaatcaggggatgtcaagcttggtgcatttggtgaatgagagaagctactcctatttataagtgttgcaagactgaactgtacactgcataccttggcttctgaatattgtcggactttgcaagtaaaagttcgcgagaatccacaagaatattcaatgaagaaggactgaatgagtccagaacttgaattctgtccacttgcacaaacttaattcggtggtatttgcccgggattagcttattcaacccttgtttaattgcacctcacctctgcttgttagagacaagtagaggtgaggtgcttgttagaacgagaaatactcaggggtctttcggctagctccacaagatggtgggctagacgacctgggttcaaaacctaaccccttctaattatttgatattaggtccttccctaatttttgagttttttttttttctgcttgttagaacgagtcctagacgtcccaaactgctttaatcactatattagatgcaagcgattagaatgcgcgtaattaatcggattaagtgaatggtttggaacttcatcgatctatgccatgtaaaaagaaaagcattgcgtattccctgggttgcttctactgttacataaagtgtgctgttcgtcgtcctgttgattgaatctttcatctaagaagaattcagacacagccacgggttgcgaaatggcccggatagactctgatgatttgatgggctgcgcgggcccaaaaccatgaaggtcgccatcccttgggcctagtggtagggctttgtctcgcgcggcccagctcgtcggtcgctgttggtctgctacgccaccgatcaaagaagttcacaagcacagttggtttgcagtagcgtactctcgatctgttctaaaataaacaaatctattactcttaatattataaataatatataatatatcttaatactataaatctgttctatcaaatattatgtttttgtttattttaatatgaagaaaagtaggaaactaggaatgtacgtaggggcttttcaactgaagttgaccgaagcatatgtgcataataatttgttgggattattgtattgagaggcattgagcgtttccatccagggcctatagctgtgaagaagaataaaatttgagcatacgattccgctcccgttttgtaaaccgccaacatgcccatggttttggacctttttttgtgccaaccttgcaatcttcaactacaaataaacttggatggaccagttctcaatacgaatgaacaaaacatagtactagtaaattacggcctgtttatagttccctaacaaaaattttgcaccctattgcattgagcgtttgaacacctttataaagtattaaatatagaaaaaaaattaattatacagattgcgactaatttgcgagacgaatcttttaagtctaatcgctccatgatttgataatgtagtgctacagtaaacatttactaataatatattaattagggttaataaattcatctcgctatttactgacggattctgtaattcgtttttttattagtgcttgaacactacatgtgacaccctatataatacccgatgtgacatgctaaaactttacacctctcatctaaacaccccctacagctgctaggcaagtgaaatatctctatgttctggaaccgtacttgtttccatgtcattggccaggaaaacaagaaactgcgtcagaattgagacctggaaacattattggctcctaattaacgcaattgacactgggccacagatcaaagccatacttgtactgagcttggacgaaaatattcttcgtctttccagatgattaaagagccttctggagagagaagcaccatcatggctgcctatctggcgaacggccgatcggccatgtaaaggagaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacgtatgtaggggcattgcattttttttttcttttgccttttcagtttcttctcttgttcagcaaattctggttcagaaaagattgacaggttttgcatctgatttaccgttggtttttgactttgtgtagctttgattcctctgctggagtttatggagatgaacgtgcaggcgaggtatgggatcaaccccgataaggaggtactggagatcctgcaagctgaatccaagtccaagcaggtaatgattctgcagccttctctgaattcttcatgaattacctgtgatgggactgtaaaaactagaagggaaggttgattcaaatgtaatcaaactaaaaagaaacgttgatccaaatgtaattcaaagcaaaacactgattccatattggctggatcaggttgaagtactggcaaaagtttactggggtgatgcaagggagaaactctgtgaggcagtagacgatctcaaggtgaatacctttgttcttggttgcaggggactaggacccttgaaaaggttagcatttaaacctttttcattctttgatctaaacctcttctcagttaaattgcgtgtgaatcaatggtttttacctcaatgcagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagcaaagataatagaaaaggtgcctggcagtacatcaaatgtatataaacctttatttccaaatggcagaaatatatgctttattctttaaatataacaaacagtgttttacattaaccatctgctttgaattttgtcgtacaaattgaggcgaatactctttttagacaatgagatgtctgaaacctctaacaacaatggaagcaattttggagcatagcaatcagaacatcttaccagttccatctttgcgtggaacagattcttcaagatccattctgcgccaactcccactcaaagatgataactcatcaaccttatcatacaaaccaagaagaccacctgtatgtacaaaaagaatttttcgcccttcccacttagctggattagcacccatgtctttcagcattccatatgctgcctttccactgcagaaatatgaagcatatatctttaggcaatgatatggccagtctatcatgaacttgtgatgaccttcaatattagtctaacagaacaaaactttttatacttttcgacaaatggcaagtatactggttgtaaaattagagttacatgcaaaaggtgtttcttgggattaatgtttcaacaaaaggaatatattgtacctgtagactggatcaaggacaatgcctgttgctgtagctatatctttaacaaacttaagctcctcagctgtgttcatggcataacctaagcccttagcctgtgaagcggcagttgcaggtaatcaagtcaaatgttcacaaaattctaccaatgcacattagcaggaaatatcatcaattagagttgcaccataaaattggaacaatgaaatgaataaactagtttcagaacaattatgttatatactgatacgcgcataacaatgtcataattagaggatgtaagtccactcttcaataccatttaaatatcaaatatagaactttaaaaatgtacttacattttcaatgttgactaaatcatgtgaacgcaaatcagaatgaagtccatcaatcaggtcttgaacataggaatggaaatatccaggatcatcacaaacagagaaagcatggacctatcctaaaaatggataattagtcgaacaatttcagcaggatagaaaacaatcaaagaaagtgcatacttttgcctttaagctactcaattttgatcctaaagcaagaccagcaatggttccaccgctgcataaatttaaaaatcattcaagtcataaagcagcaattgctactttcaggaactaggcatgacgcaataacaagtgagtacataagtaccccttaaaagtaaagaatggtgcgtattgacaaaatacctgccacatgcaacaacaatgtcgtcaaactgaacatcacctgatatctgaatttgatgttcaatctcccttattgcttctatatatcccctatcaagaaacaaaacaagttctgatttacaaaaagaaaaaggaaacaatacaagttacaaagataggtcaagtttcaacaatcgggtatcactttcacaaattctgagacctgtttgaactttgaagtgcaaaccttctctttacagtaatcttatattctattcaatgttgttgattaaatgtggatagaatacactacatttgtccttcagctatgctccacttgttagccaccacacaagatagaaccggatcttctagtgttgcatgagatccactagattcagagcctagggccttagacaattccaacattccaggtccaacatagtatattgaccaatagaaatttgccaaaaaaaagtgatgccctaatgtttattcaaatacaaactaatctcttcttttctgatagactgatggcaaacaccaatccatgaataataatagtccctgaggaatattcaaagtatgctataaacgcacaaagaaattgaaaatgcaaaaatggttcaatagttaggattgaacagaaaacaataccaagttcctagagagtttgatccaccaacaggaataacatatggttttcggccttcttccaaaagcttctttttcagcaagtccgctaaagcctgaaccaaataaatccatactaggcttagggacttttaagcaatatcaatatgaataaagaagttctaacaagaaaaagatcactcagatattttaataggcaatgccactttaccagtttatctacatacatattcaaagaataggcaatataatcatgatctttcctcagaatagggaaaaaatgaccatgctaattgtatgatgcagacatatactgcaggatgcattacttgattggacctttagcccctttaataactacttgagtatggatatcaagtatcagtataacaccaaaatataaaaagttcctttgctacacatggcccgatggaattatgaaaataataataaaagcaataatagcacatcatcgaaaagagcataccacactgccaatttttccatattcttcttttgaaacaagat

SEQ ID NO: 11731 - DNA, 1538 bp, Oryza sativa
tgtggaaaaacaaaagacaaaagagaggagcatgttgaaaaagaagtcaatattttggagactaccatactggaaggatcttgaagttcaccactgcatagatttgatgcatgtcgagaagaatgtatgcgagagtttaatgggattactgcttaacccaggtactacaaaggatggtctcaacgcccgacaagatctggaagatatgggtgttcgctcggagctacatcccataaccacggaatccggcagggtttaccttcctccagcctgctacactctctcgaaagaagagaagattgatttgctaacatgtttgagtggtataaaggttccatctggttactcatcaagaatcagtaggctcatttcactgcaagatcttaagttggtaggaatgaagtcgcatgattgccacgttcttatcacacagctgttgcccgttgcaataaggaatattttgcctcctaaggtgcgacacacgatccagcggttgtgttccttcttccatgcaattggccagaagatcattgatcccgagggactagatgaactacaggcagaacttgtgagaaccttatgtcatcttgagatgtactttcctccaactttctttgacataatggaacatcttccggtgcaccttgtgaggcaaacaaagtgctgtggtccagcattcatgacgcaaatgtatccttgcgaaaggtacctggggatccttaagggttatgtacggaaccgttcacaccccgagggagtatcatcgagagttacaccaccgaagaggtcatcgatttttgtgtggactacatgtcagaaacatcttcaattggattaccacgatctcatcacgaagggaggcttgatggtgttggtactgttggaagaaagactattaggttggatcggaaggtgtacgataaagctcatttcacagtattgcagcatatgactgaggtggtgccgtacgttgacgaacaccttgcagttctccgacgggagaacctaggccgatcagagagttgggtcagaaacaagcacatgtcttctttcaacgagtggctgaagaaccgaattgccaggttgcagaacttgtctagtgaaacacttaagtggttgtcacagggtcctgaatggagtgccaccacctggtaaggatatgacataaatggatacacctttcacacggtaaagcaagacagcaaatgcacagtgcagaacagtgggttacgcatcgagactgctagtgacggtggtcgtcgtgatcaatactatggtagagttgagcaaatattggagctagattacttgaagttcaaagtcccattgtttcgttgtcgataggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggaaaatattgc

SEQ ID NO: 11732 - DNA, 5474 bp, Oryza sativa
ccgccgcctcgcctctctctctctcgatccagatccgccgtcctcctctccaccgccgcctcgacctctccaccgtcctcctcaccgccgacctttccaccgccgctcgacctctccaccgccctcctcgccgccgccctctccaccgccgcctcgacctctccaccgcctcctcgccgccactctctcgaccgccgccgtctctctgccgccatctccgccctctccaccgccctctccaccgccgccctcaccgccggtcgtcctctccgccgtccgtccatcgacttccccgacctccccgaccccgacctcccggacgccgggatccacgacgccgggatccccgaccaccgccgaccacatcgacctcttcgccgctgcctctccgccgccgccttggacgactacggcctgcaccgccgtctccaagtatgccgcttctccaagtacgccgccaccctcccccattcctccttttttggtgcagtgaatcttagcatcaatagaggatcttacatgaattttgctgcagtggatcttagcatgaatcttagctagtttaatgtagctaaacttgttgatttatataccctttttgtctatgaataggtcaattgcatgaattgttgtttatatacatgatatatatacccttgctgctgctgccacataaatgattgtgggctgttttattatctacacttgcttgaattgaatggatgaattgctgtttacatgaagttagtagtactgtctccttttttatctacacccctgctactgctgttattgtgggctacttgttaatacacctgttccttgttttatgctgttgctgtccctgtggattatctttgcccctgcttctgctgcccaatgtattccttgttaaatggccagtgatgaattgctcaataaggacaaattatctacactctgtcatttttttatctattcttctttttgcccctgctgtggctcaataagtgatgaattgctcaataagaacagtttatctgtacccttattgtgggctgttttttaaatttgcatggttatatacctctacacttgttctttatggataagaacagagtatctacacttgttctttttttatgcataagaacagattttctgcacttgctcttttcttctggattgataagaggagactatctagacatgctgttttagttaatttgcccctgttgttgctgcccctgtggactatctttgccgtgctattggtcttactgtggctacttgttcaccctgctgtttatgtgaatttccccctgctgttgctacccctgtggtatatatactcctgctgctgctgttttatgtcaataacattctatctgtacccttgctgctgctgttttttaaatttgcatgattgattcagtggttatatacctctacacttgttctttatggataagaacagagtatctacacttgttctttttttatgcataagaacaaattttctgcacttgctcttttgatgttatgatttcctctttttatcccttcatgcaaatgattgtaattgatgcatatttctgagcaaaactgaggccatatctttcatagtataccccgtattacattggatctaatgctatttagtataatggtaggaaatttataagctttttcgcaaaaattagaccatggcaacgcccggcgcaaacccgcccaccccaacacctgcgaggatccaggaagaagcaaacccagccacggggacagttgccgaaggtcatccttcgacaacggcggtcgaacaacccgaaattcatggtaatttataggataaattttcaccacatgaccacataaattttagctagcaccccttagcaaatattgccttctgtttgtgctgcagaattgccgcaggaacaacatacgttgatgtcgggcgcgacaagtgcaagtaggtctagcagaaatccccggtcacaaaatatatggccgaccacagtgcaagttataagagagattgacgctagtggtaggcccacggcgcctaggactgtcattggaagatggtctaactgctgcgggctagcggcacgtgagaacttcgggatcctccataaagatatcgggaaggtcacagaagccgagaaagagcgagcttggacagcaatggagaaatggttcacatttccggctgaagcaaaggataggctcaagcggaaggcattccaaaagatgggcaaagcttggaagaattggaagtctaagctcttcaccgagtttgtcaacccgcccggcaatcatacgccgttcgatgaataccctcaaataaccgaagcggtgtgggaggaattctgctctctcaagaacacccaagagtttagagaatcaagcgaggcacatcgcctactgcaacagcggaatgagcacccgcatcggctgggcaccgcagggtacatcggcaaggaggcaatatgggcccatgaagatgcagccgctgcagcagcgaatgtccctgccccgttttcacacatccctgaacaaagagctcgcaactgggcgcgggcaaggggtaaggtcaacccggatggctctgtcacatttgagaacaaaagtgatgccgtcgtctatcaggaactggtgagttcactacttaacctaactaatttccgttcgtataaagtacaagttcgtataaacgactattttcttttctagttgggcttggttgctgaacaagcttcacaaagcgaggttgagtccgcgccgaagaggcgcgaagatgacatcctcacaaaggcgctcggaaccaaagaatatcctggtcggactcggggaattggtagcgatgtgccctggaagcatggactccctcagtacagctcccaatacaggaaacggaaagtctccaagcaagagagggacgctcgtttgaaggccgaacttaaggttgaggtcattcaagaactagaagctagcatgaatgcaagggtggaagaaagggttaataaggtcctcgccgacatgaatataccccgagtcacaacacctgttatgcatccaactcctcgtgcacaacacgacccgagtccgtcacagcataggagtagttgtgcatccacagaggtgccggcccctggtctcccgatcgcaccactagctgcagtggaccacatcgaggtaattgttgttatccgatccatatctaataaaaaaacctttacacgtttcaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctaggtatgccaaggtgtccatcgatacagtaaaggacacctggtcaggctatccactgcccgtgccccccaatgatgaaatcatgactttgggcgatgcacgcaagacgttcatacaatggcccaaagaagacatagttgtgaagatgactcctcgtccaagtcaaccgacggagcttacacctcccaagtctaagctatcaattgaggctccttgtggaccggcattatcagtacctcattctcctggtggagctgatatggacttggcagatataactcaaagcttggctccaataaagaccacaagaaaggccgatagctccccaccacttgtcaaagacaagaagcgtgaacgcggcaaggggaaggtcggggagttggcgccggagccaaaaaggggcaaggctgcgacgtcgatgccggtgagcaaagcggggaaggtcgtgagggcgccagcccaatttgagctaggcatgccattggtagaggacaatgtgttagccgtgatgggtattgcttgccgagagctacataagcaatacatagagctaagcaatgccaagcggaaaatgagggagtcatccatagttggacatcacgaccaccagccgttcctattgtcgcctgcctatataactatgggctttgatgacctcttcgaccttttcaggatccggaagttggacactggtcttctaaaatgctacaccttgtaagtgcataccttctatacttgtgatatgattggactatatctcctaattaaattagttctaatacgtaaatgttttaaggttgtgttggatcgagagtcgtcgccttggtaatcaggttggattccttgatccatccatggtgaacgaggttaatttacaacagagcttcactgagatggttgactatgtcaaccggtgtttatgggcccatcaagacaaggagtacatcatgtgcgcacacaaccaagagtaagaggccaatacccttcgtgtatactatttttgaagttaaggttcttagtactaacgctacataaccactgcgcaggcaacattggattctcctagtcatcgtacctaagtggagtagggttacctaccttaactccaataagtccaaagattatgatttcagtgaaatcaccaaggccttaaatatggcttgtggcccatatgtagaaaagggtggtagacacagggagggcaaggacgaactttatcatgacaccaagtttgcatgcgcacaacagatcggagaccaatgtggtttccacgtgtgccacaacatgtcaacacttctaagagaggtgaaagatttcgaccctgaggttgttgctaatagagaaaaagctcatttcaatacctacattgctattcaaaacatgctaattaacctcttatttattaaacagaaaggtagagctggcttcaagatctcacccatcaaccccccccccccccccccgctatcagaggcgaagtgtgcgccttcattcttgcagaaataatgaacaagaaaggacgttttcatgtcaaatagactcatgaacttggctagctaatttattgtgatgtaaaaaagatgtttttataattccttgcgatgtaaaaaattatgtttttatggagtgcaatgtaatttactttcatatgtgcaatatttatggtagtttactaaattgtcatcacatttgatcaactacgatttacgttgtactattcatctattttctcctttttttttccttattgacaagttgtggaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgtttgagatggatctgtgatgttatattggggggtgatgtatctgtgatggatctgtgactggaatatatctgtgatgtatctgtgtttcagagggcatggctagcaaatcctgaggctagctaatatttagcatttattttttttgttagaattaactcatcggtgacgggtcgccccaaaag

SEQ ID NO: 11733 - DNA, 17818 bp, Oryza sativa
ggccgtcacaggtagatcatctgtgacagcttctaactacggagaccacaacctctgacggcctttatttaaagggccgtcagagataagtcccctgtgacgggtcctaactcgccctaggctagtggagaaccaacacctctgacagccttctagtaacttgcccgtcaaaggtgggtgtcacctgtgacggccggccacccgtcaaaggtgattggactcaccagtgaccactgatcactgaccatgcgcgaagccgtcaaagatgaggatttgagcccgtcacaggtgaccttggccagtgtagtgacgggaaagtacatttaaatatcaatccaactactttttgttaataaaatttaatttacattagaataattgttggttaaatattttaagggttgaatatgaaaatatgtgcaacttatattattgagaaagaagcaatgctacttaacaggcttgtaaataataattttaattaattctgtttcggtcaaccaaggcttatgggcgaattacttctattaaacttggttacttagaagtgatgatcgaatttacggcctgaaatattcagtttctagcaattatgctcacccaggccgaaactgcaaactagcacaaacttagggtatatttaacagagctttaactccaccttttttttagttaaagtccaaccgaacaattttagttacacccaaaaagggggtcgagcgggcggaagtaccctcacaaaatgaaatgaaatgaaatgaagaattggatcggagcggggttaggctgctctataactacacttcaaacccaatccttgaagttaattttaggaattgaaacgttgtcagatagacccttataatcctctctcctatgtgtaccttaaaattaattcaaatgaggaatcatatcgacccgctattagtcgttaaatactaagtcaaatacatgtttacttgtctaagcacatgcaatttggtccattaaccagctgctaaacaaacatttataggcaagctgggagaatttatatagacctatagctagctagctacgggtggcaaatgcagttgtatattgtagtgagtggagaccgccgatatattaatcgatatgtagcgagctgattgatccaaccaaacaaaaagtaaggaaagtaaccacctttgctttaactagtggattggattagatctggtatattagtaagattatatacttgcccgacttgtaagagtacccacaatggttatctataggctctctacaagagatccatgtcagcatattttcctacttagaaggtattaaatgaagagagagagcaaagctatctattaacttagagatagtctatagagaaaaacgaggcaatgtatgagagagctatagataccaatgtggacatactattaaggtggtttactattaatcgagtctattgctgagatgtacatgttttatagagagcaccttactttatcattgcgggtgctctaagtgctacacacccggccaggttttgcagtttaatccggctcttaatgattaaagagtggacttttggcgctgccagtccaatcagtcgatcgatatccgaaaggcctagctagtctgcgtaattaagcaacgaaacttaatcatcatgtcatgtagatgcacacgggtggcttgtggtgtctttttctgtttggcaatcgagcagatccatcgagcaatagctcctacggagtattacggagcactactttcagcgtagttgttctactccgaccacttggccacgatcttctctactgtaaaattgcagcaaatagagtgattttaacatcctccgtgaagggaaaaaaaatgcgggttttcatatgtttgcaagcagagctccattattgtgggccactgttctgactgcccgtacatttgtctagtcatggactgcgataacctcacagattcggcgccaacccctagtagcagcgaagactttttcgctccctgcacacgatacagtctactagtattgacgtactcgtactactctcgatcgctagctctcgagagaagagaacacagctttcgtgtgtacgcgatgtgcgcgcgcgcacgcacgacggtgcgtggtttgcttggacgcgcgggcagcgagagttgccgacgatcgagcgatttccttgggaacgcgggaaccgatcggtcgatgcaacgcgagatccgatgaaatgtggtgcgcgcggccggcgaatccgattttgagcctcgctttcctaccaacgtgacttcccaggcttagcttcaacttggaagcccaggtgttagttttagtcctggtacatgtcaagttgctaacatatatcactcgcacgtacagcaatatccatatactccgtagtccgtactaagtgcttggaacaaaaacgatggaaagtactgaccagtttggccacctaaaaccttctcctcttacactagtgtacaatgtacaatactgtcaacaagtgagaggaaaaaaaaaagaggtggcgccgctcgactgaacaatccaaacggttggtaaacgcatctgtactgttcagagtatattgtattagaaacaaacatgagttagtgtttgattaatttgtaacatgtttgacgaattaattaaggccacttgcctaggactgtcttgcaccagcaagaacggctccttaatttgaaaatgttttgcaggttagccggagaatttgtagttgcaagcaacggggaaatgttgaatgggattctatatgctttgaaaaattatttctggcggtcagcttccttggtttaagggtattgcacggcagtaggtggcgaaggatcacgcttgtgtaattttattcatacatcctttagatatactataattcctaacacgtgcggttgcttcacagttttggtggatctacgcatgccatcatacgagagcgtatagtatacccaaaataaaactagaaaatacgtgaatatgtatctccttatttctcagttcgatctcagtgagttgcagtattgcagtgttaatttggtacatgcagatttgacagataaatatagcgatgattcttattcctccctaactgtaatttaataagattgtatatacgatactggttcattaaaacttggttaaaaaatgagggcagctgggagcagcaaaggccgatttctattgcatttttcgaacgttggaacggacggagcagagtatgtaacccaactgggaactatcttatgctaattctaatcgtgagtcaactgatgaatcaccggccagaatatatgtatttgagccttgaagcttaattaaccagttaagttcagcgcattaatgagatgatcaacaatgactttaatttttccccatatagtaacgtgactatggtgacatttccgatttaattagggccaattccctatatacccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgttatgaatttttgaaaataaaacattatttcattaaaataaaaaaagatttattgtaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaaaggattgagtaaattttcaggggtatatagggaattttctcatttaattatgtagcgacgagatcccatcagctattttcgtttcttcattaggcattactgactcagccctgtagtactatttcttgacgacattactaatccgttggaatcgaaatctatcgaccaactgacgcggaatagttgaccatgcacgagggagatcaccagatggccgttacacaacaggagttgactacttgcactgcaatttttgtttctcgtaaataaaaaaccggggccgcgaccaagatgtttcagcgaatcaaattccctttctgaacatgcatgcactactgaggcctggtttagttcccaactttttctttaaacttttaactttttcatcacattaaaactaatctacacacacaaacttctaacttttccgtcacatcgttccaatttcaattaaatttttaattttagtgtgaactaaacacaccctgattctagtgatattcggtaatccatggtactagtacacaaacttactagtacacaaacttgtaaaatgctcattatgaacttgtctagtgcgtctatgcggatcaagtctaaaacgatatattatgactaatcatactaatatagagtttgattaagatgtcacatgcataatcaaagaacacgagagatgttcatgtgtaaataacctttacatatagtttttttatttatttgcttttatccattatttttatacattgcatcttccttttattttatatactttttctctgtacacttaacataacttatccattgagtatatgttttttaaacaagcggtagctctactatttcaattggtagaaggagagaaaaattcaaacttacatagcattatcatacgccaaggcagacatgaacgaaatgaagggctaatatcctaaaaagaattggagctaaaatgaatcggatcggagccaacaaccaaaaacacgaactctattcattttaccgatctacggagccattttactgattaagcgtatgcataatatcctattcagaatgcaacttaattagagaaattagttataaagtgtttttcattgccttagtttgcacgtcgataagtttgtgcatcaaaacgagcaatttgcaagttcatatgctaaattacacctacctaaaaaaacacgaatattaataaatgacctaatatcaaataattagaaggggtgaggctttgaatccagatcatctaacccatcaccgattgtggagctagccaaaaaaccctgggcgtttctctaaataacacccacctaataagtttgtttactagcgatacaatttataatctagaaataccaaattccgtacgaactcgatcccctgctgagatcgatcggtgtcgtgctcgtgcacatgcagttgtaacgaactaataggattaaacaagccggtcgagaccgcgacaaaggcggcggcgctcgtggtgcgctatgtgcgcttcgcggtttctgaggccacgagacggatcaaacaaggacgcggacgaactctctgctctgcggtcctcgcggatcgtgtgagatacgcggccttggccagccagaggacggccatatcgcggggcggcggccttagttcaccccttgaagtttgaaccgtgcgcagcctcccctgcgcgcaagtcatcttcgatcggtttcggtatgcacagtcgcaccccggcacacggccggccgcatgctatggtgtctgatgcaaggccgacggaccgtagccggacacacatggggggcaactactgatgtgatagatctctccggtgtttcaattcaggtgtgtccttacacttttggacgcgggtcaatagcttgtttgcatatgtaacgtctcttttgcgggagaaattagaatgaccggtgtatatttttgtgcattgatctattctagacctgcaactaaacactatctggcgaataggtattactactgtgcttgtttagttcctaacttttttcttcaaacttctaacttttccatcacatcaaaactttcctatacacataaacttctaactttttttcttcaaacttccaattttagcgtggaactaattagcacatgcagtataccaatatacggtcagaaggaaaagttttacgggctccaaaagtcaacgaacggatcggaccggatttaaatacgagtacccagcttactacaaaataggagtagtggggtacccttgggtgcacgagttacatggacgatgggtacatgcatgtacgcatgcgcatgcatgcttactgtgcatgtctcagccagcagccaattgccgtcgcctttgccatgtacccaaaataaaactcacggagtcatggtcacgggtaaggtagccggatagggttgtagtatccgacaggactatatacgtttttttttttgaaaaaaataactcatggtccactcctatataggtagccagacgcccaaacttaactcatacctaaaaaagttgtccaatattctacccatccattttacaatgttgctataacaacatcttatattttaaaatagagggatttaagaatttctaatgaagatttaaggatttaaaatatatacacttgtttccaagagatgaccaaaattgatccctaaaataatagaaaaaagtgggcctccttctaagcgagatcgctcgctccccctcccgtgcgttatcgcttggccttcctctggtgctataatcagggtttccccaactgccagggacgtggttaccacaccccggcaataagcacggtaaccgtggaaaatcgtacgcaaccgtgcaaaatttatcaaaattttaaattattttttaaatttatttgaatttaaggaggttgccgcggtttttgttttaccgtatcccacggtaagcgagcgcggtaaccgcgcagttaccggcggttttgcaaaccctggctacaatctctctcgcccacacgtaggcggattgggagtactagccgtgcctgagatgttgagatgtgaagagcagtaaaaacagttgaggattcttttcttggtacctccaaaggaaaattttgaagcctattgttttaaaaaataaagcctaaatattacggattgtgtgtcatgtatttgatattgcagtgttaagaggtgtatagttttaaccctacggtctcgcgtttaattctcaacgcgtttattttatttctaattatttgataaccatctctctctctctctctttgatgacttgacttgcttgagataactttctccgtattttcaaccatttcctatggggacactccaccaaccttcggagatcgattaggcttgaaaaggtccccttgggaaccagatgatcagaccaaatatttctgtgtttctttcagcagcatgacatgtactgtatagtagtacgcaataaacatgatctgacagacaaacaacgacatcacaaaaaccatatggggtatggttaacacgaataaaaagtcatggccaatcgacccatgcaattattccgtgtacaccagagaggtgaccattttacatgaaccagtgcccctccacacccatccaaatatcactttgatccgggtgacttgacttcacaccaaaggctggtaatcctggtgcagatttgtttgtttctccgttgcaccatgcagcagtatctcagtaatgcaccctcaaaaaaggcttctggagccgcctagatctcatcctcacctggcccaagccgatacgcgtttcatgcaaaaaaaccaaacatgtcacgcgctgctgccgctccggctacaaacctacaacgacgcattgcacgatgcactagcgagccagcgagagtgagtggcgcacactgagaagacaccaccacgcattagcaacaaagatggccaatgcacgcatgcctgccttcttgcctgctcggctgctcgatcagtacctcgcctcatctgtggttagcgatctcgctacgtatgctttgcaagttgcaagctgcattcgatcggggcgcagcaatgccaatgccgacggccacataccatgatagtatcagcaatggcgagtgtgtacatacacgccaccagctccggccactaccatcgcctgtccccctcttgtctgcctctgggggatcccgatgctgccatggcctagaccatggatcattgcttgcactcaccggacaacaacatgtcacctccactgcatgccctggctggccactgccacctctagttgtatactccaaatctttctactacctgggtcgtctttgggtagcaccaatagtggctggtagggtataccgctacgccaaagtagtagtaaagtgacgagatcgatacgtgcccacacacgaaaactaaaccagctgctagctcgttgttggctccaccacaggtagggcgccgggcgatggacgcacggccggccagtcatcaggttgcatcaggccggtggctgtgctcgttttagggtgcaccggcgcaccaaagcagggggagataggccactccacgatcccctgcctctcgtatccgccggcgataatccggcggccatcatggcagggccgccgtgctggctggtgtgtgtgtcggcccatccttctttacagatcgcggtgaagatttactgatacgtgtgcgttacatgtgttggcatcattggctaagggcatgtacaacggtgtttattagtggtctctctttattgccatgcaagtaaatttggtgacatggaggaaagagaaaggagtatggttgttatgcatgacaacggctcagagtcgactcttagcatttactagagcaaattttgttgcatggtgatgaaagaaaggaaataaaagtaagaaaagttattttgatacattaatgattagagaccatattgtctctaactgttgtaggatgctagtctctaaataacgtagagcttatatacgactctatctttgtacgtgccctaattagcaactgggcagcgtgaaaacgcatttcctatcaatccacgaggcgatttgttttggagaaaagaggaggaatgaagaaaatgaaaggaaattagtgactggtagaagaatgtgccgaatattgggtcatcgtcgacgagaaaaactccaaatattcgcaacaaaagagagttcgatctcctaattattaacgtctcgcttgatgtggaagttgtcatccgtgggaaaactggaaaggttgaaaacactgtttttgcacggaagaaaataatttgcaaaagctgatggatgtttgtttgcctgctgccacgcctggataacaatagtggttatcatataacgtcccgaatcctccaaggtatctgatccctgcagctgattgagaaaatatttatgcccactgaagtctgaactcttaagctgtgaagcaacgcaattcagcgtgtagcccaaatcgagtacacttggatcatctgttcgcacgctacctccgtcttaaaacaagtacagcagtgaaaatccgtgtccaacgtttgaccgtctgtcttatttgaaaaatttataaattttttttaaaaaatagtcacacaaaaagtactattcatattttatcatctaataacaaataaaataataatcataaaaaattttcacataagacgaacggtcaaacgttggagataaatagtgtaaaactatacttattttgggacggacggagtatatgtcaagagcgggggatacatgccatggcctgtgtacagccaagtagcagcaggatttgattgaggagagtgagatatatcctgccatgagaaccaacccccaggaagcaagagctaatggggatccaaatgaagtgacagtgatcggggccgatgtatagaggagctttgggacttggtgtttggtatgacagcagcctaattttgacatttaacagccgctgtcaattcaatcacaaaattaacggagaatgttttgagcttttggtgcaagaatgggtgtggccccagttttttgttctctttttaccaagagcctcttcttagcggttgacaacactaactgggccgtcttatctgactcacattgtggcccgtttgttggagtactagcacagtagcaccagttcggcgatgtcatgatgtcagcgattgatgcagtaaaatgattcatacgcgtgactcatattgcttgttttcctcttattcttttcattgcagccatcaggttcagtcttcatctaccaacaagaccagtagtagtctttaagccgttccagtgggaaaagattccaaaagaggatgtgtcaatttttctgttagagcaagtcccaatctttagcttaaaagtgcgcctcgccaaaagatacaaggacatctggggccatgatgatcggctcagaaatatactccaactcactaattgggatgttatatcgcttcttagttaagaaatgacctagtcatgtactacaactactcctgaagaacgactgttaatcaagtaatttcactccagacaaggttcagcatgttctcaattagaagaattaggctagatttggcctactaatattattatcagtcctggtactttggactgatctaggcatgccatcttaagggagaccaataatcacaccccgaatcttttgactaacaaactattcacggataaacctatagtataatcaagggtttgaacacaatctcagacgcatctgtggactgccctaattgcaaatgactatacctaacaggtgtgctggactgagaataattacaaaagagtaggaaatgttgtagaaatcgtactagcagcagtagtgtaccaaaagcaagaaccaaaaaaatggtgtggttttgagtgtttggactccagggtttcagcgtcctttttccaggtacccaatgatggtgccggtagagaaacggggtagtatcaggtcagtcagcttaggggacacctgcccatgatgcacacggctccaaagggcaagcaccaacctagcactaatcatcaaatggcataggtccgggcttgcagatgcaggctgatgagctctccacgctgaattgccctggacccaaccatgcatgagtcgctaggcggtaggcgcgatttgatcgagtcatggacgggtaagacgaagacgagaacgaaattccaagcgccctggatggagtttcggtatgattaaacagagcaaaatctgccggattagaaggatcgaattaatacaggataaagggcccatcggtggataaggtttcccccgaccgtagctcgggctcaccttccagctttccgatcgagcggctcaaacgcaactggcgcctgacgtgaaagcagcagccagccaggacagttcagaggagaggagaggaggaggatccgtttcacgtgtggcatggggtccctgacagagcccctgcatccatgcgcccgctgcgtgcatggacaaacattcgtgtggtgtggtgggagcgcccggttccctcgtgccgttcacgcgggcgccacccgcccatgccgcccgcaacagcgaccgacggcttcgcgcgccgatcgggtgggtggtggcatcgaatcccgctcaccaatccagtggttttcgctgtggacgcgctattccgcgatggcttcgcttgcgcgcgcgagccgagccgcgccgcgccgcgcccacgccacgccgggcccaagaagcgctggccgcatgggcgctgggatcgcgaggtcgccaccaaccatacgccgcgacggcgaggctgcgcgtgcaaatgcattgccgctactaactggcatggggaactcgggagccatgccactgtgcccgttgaagcaagcgtacaaatctcgaaaaactagtacgaagtacgtagcaacgtgccaaacaagtgatcgggcgttcgagccaatcatgacgggcatgattatgggagagtttgtcaaggatagtggccgattctgctgctgaaccatcgcattcgcggtttgctactaataataagctaagctgtgctctcgatctttgttcttcggtgtagtataacgcgcacggtgcttaaagaaacgttcgttctggtgtggtgcgccactcagcctcggtaaacaaatgtgtggcattttgacctttgagttttttggatatttttcaccgggccttttttgcaaaaggaggagagatcatgccatcaggggcctccgtgcattttttttaagttttggaaaacctggaaaaggcgggtggttcaaaagcaaagctttgtccttttggaaaagcaacaaccatccacttcgctgcgttgtgaagaagagtttttgctactcgtagcatttttttttcttccagctatgtactctagtggggttcaagatctgtattgcgagagggtaagatatgatactgtatttctgtagctggggatcaatcaggatcacagtggccgtcatctccaattgaaggcgccgtaccacgtcaagctcgactaggcggaatcaaatgaatgaatctagctggtgatcatggcggtgatgatggtctcggccaatccaatccggtggtgggcctctttggaacttgcgacactgcgtcctgatgaaatggactggccgcatctattgctttccccatccacgcccaacttaaactagcgcacctgtggcttcttctattggctactagtatttccttttcgtctgtgcaaatttcacactaatatctagtccgtcggtcccaaaataaattaatctcatacgagatataaactcgtatatcgcatcatgtacgaggttaatttattttagaacagagtaagtatatcttataatatatctaaaatttagaacggaggtaatatattttatgacctaagttaaagacaccgattgttatgacttatattatatgacataatcataggttttatggcttatctttttcataaaaccttcacccttagtaaatcccaattaattccaacacatctggtacaatattttttttaatagtgaagactaaaactaatagccttaatcaagtaattaataatttaaaaaatatacttgtcttatattttgaatttttttttaaaaaaatcatcttcaatggggtcttgtaaaactatacagcaataatatatggattatgtgtcatcggttacaatactaaagttttatgctacttttatgggttttccataatttctttccgcccaagaatataaagcacatataatacgaggacttctcaatctacatgctcatctcaagtaattacaaccatctctaaccttaatataagcacatctaagttcaaagcttgttctaaaatacgaagacttctcaatgtacttgctcattccaagccattacaaccatccgtacctcaattttaatctcctaataaaaactttagatgtacatatcatatcctttatattctaaatcaatctattatccttatcctctatattatatttctctctccttcttgttacctatcccaagtctattttaatctccttcttgctatagtgttagaggatgccctaattggcctaccgagtctaggacaaatcgatacgtgttcaccctgactgggtccctcggagtgctcgttcggcatcatcttccttctcgtggcagcgcgtctctgggtgctgctgtagtttgcacataacgtgctcaaggtgtggcggcgtgattcagcatcaatagtacttatattcttgatcttggacggaggaagtattgttttgtgttatgaaatttgagaattttgcatgtgccacttaaaaaacctagcttcattagaatgccatcatttaaataggcttcgccagaaatgccacaattaaacaggtggttgtttgcttcgtgaacggaattacccttaaatattcttcttcctctctccaacgctagaagaggccaccaccggccgcatcatgctctggttgcgtcgacggcagcgacactcgatcttgctagcccatagctcgtgttcttctaggtcgtgttcatgttgttctccttgccttgcgtacttctcgcgtttgtatgaatagcggaagagctcgtcagaggtcaccatgctccatcgccgccgttaactgctcgccactgcgcacactgattcttggaccacgagaaatttcaaaaaccctacttcctcctcccgatctcctccattccaccaaacagatcgcctactcctgaaccctagccaccttttttaccagatcatcatggtggcgagaatggaggtggcatcggagacgcttgacacccttgtaaaatggtttacgcagttgctctctcccgacgcatcgcacgctgtgtgcctgtgtcactgagtagagcatcgagtcccccaagtgctccccaggtttgtgctccgccgccattggctaagttctccccggaggcccgaacggtgacggtgccaaccacatcccgacctctaactatgtagggatgaccggagggaagtatggtcctccaggcacagggaaatgggagaccaccccgcccctcgtccaagagtagctctctgaggcccttggcaccgccatggcctggagtgagcatggccaaaggccagagctaggatcttccgatgttatagtaagggtgaaaacggggcggtatttctcgtcgcccgtccggccacattatttcgggacaaattcgggtacccgagacttttcagggacatcggatccgagtacgggtctttttggcggatataggattgggttcgggaacgtagtatctgacggatacgaattatccggtaaaaaaaatcctggtattacccggataaatatacggatactacccgtattatgtttttgcaaggcaccttttggtactatgtattggttctactatgaggtactattgttatgatgaattggtgataacttaaatgatgtttattagtctatgcccctgtggtcctgaatgatgcctactgatagcttgtatgggatgatatactgatattgtgactcaactgtgagatatattgtgcttaatgacctaatattctcaactgtatgtcatatataaaatgattttcaattgtgaggtattgcaccctatttatttcctaaggtcctaatggcataatataatcgtatcgtggatatatgaaattattgaatggttattgtctatgtgatatataagattgttgcttcaacttgatatctgaataaatattcataaccgatagtgtacatatccattttggtacgtattcgttccgtatttttgcccgacattatccgagtttgtatctgtactcagcactatccgtgtctgaatcgattccgattataaaatgtgggtaggatatgggaagggtgagatccgaccgaactcgacccgttttcactcctatgttatagggaggatgaagaagatccaaagataatgtcgtccacgttggtattctagcaaacaacctctgtttgaccatgatattttatcaaaactaagtgatggtattctagtgaaacaatttttttactcatatatgcaaatttctctctgaaattcattgggacattttctagaaaaaaaaatctgtggaagaactcttgctgactgagtttggtacagtgattcgtcttgtgaggagaggagggggggccatgccatcctactcttgtaatagcccatcaactgtaattgcgatcgtactataacattgtcgtatatagtacagcattgtccaaaactcacccgtcccttggatgcctacatctacatcgtcaatgtccaggtaaaatcgatcacaaaaacccaaacttgcacacatcacgtatagcccggtcgacattcgccagctctgtcctcttctctagttctcaccccaccaccgttctatcacagtacgtcatcgttggcctgtagacagcgccggtgctgacgtctccactacaagggctctggcaaagctacgaacagctatagatcatgggcgaatatactccaatgatatttatttctttataattttttcttcattaatatggtaagaattggggttatagcaataaataaggcatcagctacacaatctgttcaccacctattcacccaactttgacatccttgtatgcttgtgttgttttggctattggattaattgttttgttagtttcatgtacggtaatcttgcaagcactaacatcccacatcaaacgtacgggggcgtgatcttaagtacttctacatacgtgttactatccactgataatatttcacagttgtatttaccagatggtataatatgttttgctataaatacacgaatgaataaatgtatgataaatatcataaaaatgatagataaatatatgttaaaatattatgaaatgatggggctgttcagattgataatattttcaaccatacccttttttttacaaagttaaataaaaatgtctacatttagtttgttgccaaatttggtaaatacataagaatgccaaattttggtaaggtttattttggttacaatctgaacagacctgatgatttaatatgcttatatgttgagccctataacatactgttgatagaaaacacgatgcctgggagatctgcttaactccagtgcaggtccaaagctcgccttcgaatgtatgagcgtgccagttgatttgatcatgtaatcaacaagaaatagagacagaattcgtggttaaatctataaatgatagccgatcggctaggtaccgatgacatatcatttatctttgagccgatgtcatatatgaatcgatcggcggttataataggtggtaaggaactaaatctattcgatcggctgtagatattaatgatatatagttcttatattaatatatacttaaatcaagtgattgggatagatcggtcaccatgccaagacagtataaatcacttagatcgaaatatatattaataacaggattatatatgtttatagcatagccgatcagatagatctagcgtgtatcggctaatactctgatactcctttatatcaagatattaaaacaggtataatgtattaaacagaagcttaatatatttagattgcgacgatatcttgacacaaaggacggatttaacatgtcattgaagcatatagatcgaatatggttaaatcaaataagatcggctgaaactccgatactaccctaatcggcaaccagagtacaggctagagattgatattctaagcacgacttaatagatcaaactcaactgatgcagcattaagtatgaaaagaagagcaatatctagacaatcaagccgctggatgttttataaagtggtagatatcttatataatctaagacaacgtcgctatttaacctaatcggctgccttctatcaacagatgttaaccgattgtaggttagatgacgatattgccaaagattatataagatatataataacttgacgaattatacagacaagattagtgtcataaagatggaagcactaatcccgagaacacaagccgtcataacaagttttacctcttgtcga

SEQ ID NO: 11734 - DNA, 439 bp, Oryza sativa
cgcgcggtatcagctagaacgataaggctggaccacctttgggcgggctcctaacgtgagactctattgatgggggcaggggcgcaccgaagctgggcacgggcactgacctaaggtgactgggctaagctaacctatcttgcggactatactgccgagctgcggccacactccacaggagagggggggggggggtgattcaagtacatgatgtagcgaactgatgttatttcgcgggattttaactgctgatgttagaaacggccttgaccaggtcgcggcatgggcttcagcaagcagagaactgtatcaactcactgtggtctttggacgaagaaacaagaggctttgcgagataccgattattatgggtgccaggtgtgattaaatctggggagctgaaaagcaaatgctatatgtatgcgttgggtgggttaag

SEQ ID NO: 11735 - DNA, 475 bp, Oryza sativa
tgcgtgtatggattgtattgttgttcctatgaattcctattgatctcgagctgtgtttggaggaagcaagccaagctctagctagggagagggagaagagcagagagaggaggaatcagagcggtttgcattgagtcttgtgcgcttctaagctatggggaattggggatatggtgggaagagagagagagaaagtgaccatggaattggatgtagatcggtggttcttactggttatactactgacactgtcatcgaatacgtcactccgtcattttctttctccattttttttgttcccaaatacaaggcattcataagttcaaatacttcgatgccattttcatccgtacaaatgatcccaggaaatgtctgcacgtgcatatgttagtaagatattggaaactattttgatatgattatttctcgatgggttgtcctctcatttgcttaagaaccatccaaatagttatga

SEQ ID NO: 11736 - DNA, 5458 bp, Oryza sativa
tgcagcccgaatgaaagtgggtcaagatgtcaaataatcgaaacacattttaagaagtgttaaattatcaaatctctcccaaaatttattggtgatttctgtgttttgttcccattttttaaaattggttggttatttcggtcatgaccaaagaacgaaccaaaatgaccaaaaccgaaaagcctgctctgaccgtatgccctactgccagtatttggatcttagtttaaccgtgtttttaaaatatatttttaaaaaaattcaatttaaaacaagtcttataaaagtacagtaggtacacgaattgaagttgtttgaaggtccggatcctaactgtcgtaggtacacgaaggtagtactaattccttgggtagctgtagctcgagtggtacacgtaggactaatcatcacacaattattatttgctatatatctatctattatattattagaacaactttgaaaggaggcaccacgttcgctgtggggactaaaaattcccacactaatcagagaaaaagaaaaaaaaaagaaaaggagagtccaagtagaaatacaatctaaaaatagctgaaatttagaattaaaaataagcaatattaaaaaaagtttccatataagaacccaatacgagattaatcaaaattcgaaataaaaataaaataaaatccaaaattaggaaaaaaaaagagagtccaagtagaaatacaatttaaaaatagatgaaattcggaattaaaaataatcaatattgaaagaagtttccatgtaagaacccaatacgagattaatcaaaattggaaataaaaataaaataaaatccaaaattagaaaaggaaataagagtccaagtaggaatacaatttaaaaataactgaaattcagtattaaaaataagaaacattaaaagaagagttcatataagaacccaatacgagattaattaaaatttggaataaaaataaattaagtaacaggcctataaaagagtagagtggtggcggttgatacgacatataaaaattgttaataaaacatcaaatagaatcctactgacgattaaaaaggagggacgtcaggcaggccgtgaagcaaacgagtaaggcggttgccggaacttcttagacagtaaaaaaacaaatcgtattgataatcgtattcgatttttaaaatctcaatgataataaaaaggagaagcagcgagcggggtgtataagagtatagttgcagagccaccgacggttgacgggacttctagaaaataaaaaatgaattccaacgatagttatgttcgatttttagaatcacaatgacaataaaaaagtaggtggcgaacatgctgtagaggggcatagtggcatcgtttgataggacttctaaaaattataaaaaatgaaactataagttatgttcgattttaaaatctcaatgacaataaagaatgaattccaacgatagttatgttcgattttaaaatctcaatgacaataaagaaggtaggcagcaggcgagccgtagaggaggacaatggcaaagctactgacggtttggcaggacttctagaaagtaaaaatgaacccaaacgataattatgttcgatttttaaaatctcaataacaataaagggtagagacaatggatggcccgtagaggagtataatggcaacgtttgacgggacatctagaaattataaaaataaaacccaacatgacaataaactctaaaaactacaaaatccaatttttaaaggttccaagaagaatgaataaaaatagtggtagatcaagcaagcaaataaagaaggagatgatataaggggtagcaactggtgtgacttttaaaaaatatataattagaaacacaaggatgataaggtttagtctttcaaagtcttaagacaatgagatagctattaataaattttaagtaaaatcatactaaaaaaatatatgattttgtttgggtgctagccacccagctagttcttattatttcctcgaaaaaaatattgttagttatttagcgcaggaggatttgacttctgaaatcccggaagattctatggtttgcacccatgcattcgttttggtttccccctgaaaataaactcgagataaacacacacacagattttaaaataccggtaagctgggcgcatacgcacacgggggctctaaagaagacgcacaaacgcgacaaatcccgtatgggcaggggcccgtgcgtggcgttacggagcatggcttcacatatcggggacctgcatgccgtccggcggccacttctcccatgccggcaacgaccacacaagcaaagcaaagccattatccgtcatcgcccaattaaagcgttttttggatgtggttttgtcttagattcctacaatctgtccgccagattaggcttcaggttttgtgcttatctatcgatcccttattaatataccctgattaattaagtgcagtactttgacgaccaaggaatgatatgtatgcaattttgtggtgatatacatgtatgctgagatcggtgcccatgtcaccgggtgatcccggcagctagctgcgtactgtggatgcgcgtatagtatatagtatcaccaacgtttgcatggtggatgcgcgtcgttttccgcttggaagtgagggcgaaagtgcgatctaggagggatcgatcgaaccggttcggaggaaagactgcgatcgatcgagccgtaggatggaaaactagggaggatctgatcgaaccaaatctcgaatctgggaagagaaaggttaaatcttgttcatcacatattgaagggagaggcccctaagttaatactccctccgttccataatagaagagattttgagtttttgtttgcactatttgaccactcgttttattaaaaaaaattagaattatttttttacttactttattatccaaagtactttaaacataacttttcgtattttatatttgcacaaattttttaaataagatgagtggtcaaacagtacaagcaagaactaaaaatcccttatattatgagacggatagagtatatgtgggagacaagtgggattgataatgcgaaggatgatatgagatcgatcacctgcgattctctagattgggaatgttgggaatattaccccaacttaaatataaagatcagatggtgatggaaatctctgatgggatataaaagctgaatgggtaggggggagctatgatgttagtgtgagtggtcaatttagggtctacagtctccccttgttggccatagaaaatggaaagttgtgtctcaaaaatgaataacacaagagaatctactacacattctaaatgtcagagcacttacatattgcggtgggaaagaatgaataatctataacctcatcagtattttttggaggtgtataaccttattgttcaaaacataccatgtgatttttacatcaaacacgtaattcactttttatttacacgagcaattgataaatgtttacacatattaactaattatgaattttaactcatataaaataatgatttttagaaagctaactaaaaagagaacaatgcatggaaaacattaacatttcaaaattcagtgagcaagacaaaaaaaagtagaatgacacaggtggtgtgatagcatatttgtcaccacgaccattatattccttttaaagtagcatatagttttttcttcgaagaagtctgctccatcatttgcttattattttatcagccgcaactgaaatttaaattttaaaacataactttaaagttaatttttttcatcgtagtttttttaacattttcttttaaacatctatgaacatggatatgaaagttctttactcacaaatcacttttggttagttgtttcatttttttcatggtttatgagccacacaagtatacaacaaatgatgagaagcactagtatttctattgaaaacacacattgtatatgttatatttatgggcaccagtatttgaatcggataggtaaagccaagaagaatctacaactccaccaccggactacctgattggctcaataatatataatttatttataaatgtagtttttcccctatggagaatttcttaataaaaatatcaaacatatcttggaagcaaataatatctggtgatacttttcttgtgaaattatgcttttcagtcactgtccttattttattttttttattccttcatctatttggataagtacggagtacctaacatagttttagggagacattatttaccaaaactaaagttgccaaactcgaaatatactcaaatggcattgggtccagccagcccttaactaaaaattactaggcctactttcttaaaaaagggaaggatagctagccggcctaaacgagccaagcatttcctttattccacaaaggaggaggaaagaacatcttcgatcgatcgagcactcgatgataccttgaataaacctagccaaggagtgaatgattagcgtgctaatcctctcatttccgcctatccttcattcctcaacctcttgctggtctcgctggccccatatattaaataaggacgggtctttaagcctcctatctaatcatgattattatagtgtcgccgggatcaatttaccaccttactccatccgtcaaaaaaaaaaaaaaagacaaaccctgattttcgtgtccaacgttggaccatccatcttatttaaaaaaatatgaaaaaaaaataaaaagacaagtcacgtataaaatattaatcatgttttatcatctaacaacaataaaaatacgaattataaaaaaatatcatataagacggacagtcaaagttggacatgaaaacctagggtttgtcttttttttggacggagggagtatatatatccgtctaatcaattacctaaatccacactcccttttggaaattcgaatggaatcaagagccttttttgcattggcatggcgacctttgctccggagcaagcgctgctgctccaattctttttgctgggaattacgcgcgccaccaacctcagcttctacctccatcattctctgctttagttgtgaaagggcaaattaccttaaatataagtgcgagagtccctcacctcaatggttagtttttgggggtaggaaaggcccttttacgatcctacaattcgtatcagagtctggctagtttaacatctctgacccgatagacagtgtgtgaaggactgatggaccgtgggtgcctgcgggacccgtatacctgagggaccgtgatgaaatgatgaagtactgagggacaccaatgtatgaagggggagattgttgaatagtcccatatttggtgattgtggaccgtggtgaaacggtgaagtaaggactgagggacaccaatatatgaagaggaagattgtaaatagttatatattgattgtgaaagggtaaatgacctaag

SEQ ID NO: 11737 - DNA, 6718 bp, Oryza sativa
ttttaatgtgatgaaaaatttagaagtttaaaaataagtttggaactaaaccagggctttatggcttaggctcaccccgaggaccgagtttgagcaatctctccccggaagtgtagaggcgtaattgctttattcaaaataaattcatttttcatttgtcctatagagtactccctctctaaaataacgaatcgaacctaatctaaacaaatatgtactaataattatgatgtgttatactctagtactatatcggtttttcttacgaggcagtacataccaatgtaaaactaaaagatcatattgttctcattttatcaaatctcaatgccattattttttacttaatctatttctattacatttattcattaattttacgaactccgatgtaataattagccaaaaaaacttattttaggataaatcggagaagctaaaaataaacttattttgagacaaatagagtagattttaccttgatttttcgttagcacgtttttcaaacggttaaacggtgtatttcattaaaaaactttctatatataagttgttttaaaaaattaataaatcaatttttaaatttgcaataattaaaaccgactagtaattaatcgtgtgctaatggctttcttgttctgcgtgtgctaacttaatcttcatccaaatgtatctcaaacgggacctagctgctttcgggagagaaggctaagaatttttctcccatgcaagtaaaatgggatagtttatgagcatatggttaagtaaatattagcttaaaaattaaaaaaatagattaatatacttcttaaagaaaacatatatatacatataaattttaaaaacttatcatttagttgtttagaaaacatgtggatgaaaaaacagagaatagaagttcacgtcatagtcacacagacttcatttcctacttcgcccgagtttagttccaaaatttttttcaaacttccaacttttccatcatattaaaactttcctaaacaaataaactttcaactttttcatcacatcgttccaaattttaccaaactttaaattttgacgtgaactaaacacacccttcgttaaaaaatgtcaagtttatttttagtcaatcaaactaagaaatacatatttaattggagcctacgaaatacaactaaagtacgaataaggggcatagttatttctcttcactgatagtttgtctgaaagttgctagaaacaaaatctttatagcacctgataaacatatactgtactaataattacttcctccctccttaaatgtaaaagattctgactatgaattacatgtttaaattatgaatctggatatgcacaatctgcatatgcacatagatagatttatagatatggtccataacatttagagtcgaagaaaatagtacactatggccctttttgaatcaatgagttattttttagcccgcccttaaataaccccaaatagcctaaaagttccaaacacgtgagctatttcagggctatttggaaataacccattaaaaaaactatctccctcaagggctattttaggtgggacttactgaaaaagtgtcttttctctccctctctcttcatgggaaagtgcattaaaggccaaatagttctcaaaataacccttagatacaaacaacttacagctattttcttatgctaaaaaaatatttctcaaaacctggcctacagagagaagatgaaaacgtaaaaaaaaaaaaaaaactgaaaggtctttgcctcttgcctcctggaaggccagtccaggccgctgagccgaggcggagtgttcgttattataaagccgcaagcgtttccatttccctccccatcttcctcttccctcccctctctctccatcaccagctcatccctctctagcgctcgttcgcccgcccctcccccctacggccctacgagcgccgcgcttctctttctagccccctcttccgcattactccctcataaaggaggaacagaggaaagactgggcagaggagaggacctatagctgagaagaagcagagcaagtgaaggagaaagccccgtaatcttggccatcctcctcctcctgctgctgctgcaactccggctctgcctttaaacagtgcagcccgggcggcgccggccacgacgctcgtactcctagctagcagcggagaacgaacagcgtgcagggactcgcctcgatagcacagtaaattccattccatatcatataccattccagccatcactctccaccggcaccctgcatttactgctcccccatcactcgccccggcttccttgagcgcgatctccagatcatcttttgtgtagcgagaaaggttggtgctcttcttcttcttcttcttgctgctgcagctggtggtgttgttttttttattggcggggtcggtttcctgctctgttttgttaagtcatattgtgctgtcctggatcttgatccgacgtccgtccgtacgcactcacgcagctgacgacggggaagggcggcgtggtcagcatggtgccgcgcgagcaggcggaggaggccatcgtggctgacagcaacggcaaggaggaggaggtcggggtgatgggcgtcagcgccggggagcacggcgccgacgaccaccacggcggcggcggcaagttcagcatgaagaacctgctctggcacggcggctccgtctgggacgcctggttcagctgcgcctctaaccaggtataactcatcctgctccgccatggccgccatcgcggccatgcagctcgctcgatgaaggaatcatatcgagacgaatccgaaaggcagcgtgactgaatttctgaatttcctggtggtgggtttctgcaggtcgcgcaggtgctcctgacgctgccgtactccttctcgcagctcgggatgctctcgggcgtgctgctgcagctgttctacggtttcatgggcagctggaccgcctacctaatcagcgtcctctacgtcgagtaccgctcccgcaaggagaaggaaggcgtcagcttcaagaaccacgtcatccaggtacccgccccgccttgtcatgccatggccgtgctggccttgtcgcttcttcgtatcctcctcctcatcagtaacggattgttacagcttcttatccccgtctttatgtggcataatcgaaaacacatttttctcgagcacgcattttttccccttccgtttggtcgttttcgatccttactggcttgaaaaatgcctccttttcttttgtgaaaatggcagggggtattggatcccctgcctcccatggctctcttctggttgcttgccgaaatgaaagccgagcctgaatcgagctcatccttaatccttgttcaattaatcacttattactgcaaattttgcataactacacaactatagttactatactaacaactggggctaatgggagaagcttgtgacgttgactggtggcagtggttcgaggtgctggatgggctactgggcccgtactggaaggcggccggactcgccttcaactgcacgttcctcctcttcggctccgtcatccagctgatcgcctgcgcgaggtcaaattcctttcctccccaactcaaccaaccaaccatcactctcccactgtcacttcgcagcgccagtgtaaatatgtagccgtgctgctgcgcaacagtgtgtcgtggtgacagattgggtttgtgcggatgggctgaaaacctgaccgataatttggtggtgttttcttcagtaacatctactacatcaacgaccggctggacaagcggacgtggacgtacatcttcggcgcgtgctgcgccaccacggtgttcatcccgtcgttccacaactaccggatctggtccttcctgggcctcggcatgaccacctataccgcttggtacctcgccatcgccgccctcctcaacggccaggtgagataagaagagggaaactgtccttgtcactttctcgatcatccatcgcgtctactacatgtccatttagcttgggtttgcagtgactgatgatcgtttgcgtcgcaggccgaaggcatcacccacaccggtccaaccaagctggtgctgtacttcaccggcgccaccaacatcctctacaccttcggcggccacgccgtcacagtgtaagcaaagcagaacttgctctgtttgtccagttgttaatactgtacagtagtattagtactaggactacaagctaatcctcctgaggaagtgaagtgagggagaacttttcactagctgcagcttttgcctgccaatgtggaggacatgtcccgattggaaatcaggttctggtttccattccattggtccccctccatggtactggtactcgcacctcactggtcacagtgtagtatagtgagtactactactactactaagcttaattaaaacacacgtagctgtagctttgcagctagttagctctatggcgtacagatcccaatggatggataggggcacttaaaaattccaagcctgtgcgcggtgggaaacagctgcgttagcttgcgaccattagtcggctgatcgattgatatcggtcgataaaaatttataaagatcgatccagctgctaaagctcggtgcgttcatgtgcatgtgcgatgtgctgaactggtgatgcatccaaaaggtcccctgctagtacacgcgatggtttaggggagaaaagaatgggccactatgcattagaatagactccttgagcccctttattcccattgctcgtttatgtgcctaatctattgcttggattattgagtgtgtttttgctttggcatgattagaggcccatgcgaggaataattagcgtttcagtgcgctgttccttcaaaatgcgatggtcgttagtgccttagtggtcgcatgcagttcggattggagatttgatgatcttatagtagtatatatagtatctcctagcttcaaaaatttaatgtagtgctaccagtacttgttccatagttgtgaaaattgaaaatgcttttgatgggttggaaatggaatggaatgataaggggggccagcttcattcaattcagctagtgcggagttcacatcaagctatgcaattccgtgctagttgccctaatccaacggggtgaaatgatttccatcatggattgggacatcttggtgccaaatcatccaatgatgattccatttatatcttactactactattatgctgctaggcttgcatgggaaagtttagcttagtggggcgaaggggacacagacctgctttgagaattgcttcccaattgaagaatgtgagtgtctttgtccatcttgacaatgcccctcaccacttctggtctcaggctaattcaaagcccagtttggtagcgacatgagaccattagcataacatgcatgggatgggatcttcgctagctgtggagcagagtttttaggtgattagtactcgtatttagtggtataaattattattggcaacggccttatttggccgtatttgtcggctcctccatcatttgaccggtggcggatacatgtgttggtgaaagaaagaaagcaattgcgagattccccctgccgccgcgatccttgcatgtatcctgcctgcgtgactaggagaagcagcagctgtagtagtagtcctactttttggccgtatcatttgatcaagctgattaaagtctcagcatcattgactcgcatgtgccgaggccgttttgtccgttgatttgttgattaataacctgcaagaaaagaaaataatgactgattgggggtggctgttttggattggtgcagggagatcatgcacgcgatgtggaaaccggccaagttcaagtacatctacctgctggcgacgctgtacgtgttcacgctgacgctgccgtcggcgtcggccatgtactgggcgttcggggacgagctgctgacccactccaacgccttctcgctgctgcccaagaccgggtggcgcgacgcggcggtgatactgatgctgatccaccagttcatcacgttcgggttcgcgtgcacgccgctctacttcgtgtgggagaaggtgatcggcatgcacgacaccaagagcatctgcctcagggcgctcgcgcggctccccatcgtcgtccccatctggttcctcgccatcatcttccccttcttcggccccatcaactccgccgtcggcgcgctcctcgtcagcttcaccgtctacatcatcccggcactcgcccacatcctcacctaccgtacggcctccgcgcgcatggtaacctcaagaacctctctgcacatgccctaactatgccccatcatcatcgctgcatgcatgtttttgttccggtacaccgcctcgtccatccatccacgcattcaatggcaggtactagtgcaagctagggcgaatgcaacgtgacggccaacttatactaacaactgggtccgatggatttcatcgacgcttcctccgtgttgctatagctgagcagcggatcggtcgagccatcatcaacagtggcgagactggaacacacaggcaatagaatagacagtggagatctgtgcgcaggcagcagaagcaagcagcagttcgtgttgaatgcaaaagcacagccgggccgtgcccggggcccacctcatacatgggcaaatccccaatcattgaatccagccaacaaccacattaattccaagcagcgccccc

SEQ ID NO: 11738 - DNA, 5443 bp, Oryza sativa
ggtttagtgaccgtgcccagttctggtgcgctactgctcccatgtatagtgtctcagattaggagcccaaccaaaggtggtccctgcttatctggctggctgctgccgcgcggctcggtacagcggacgaatccacccgtagactctctgtgcaccgtgcgcgacgacgcgagaaacgcgcggaaagcaacggttgacgccgcggtggatgaggtgggacggacgcgctgctgatgttttcgcgccggcgctgctatcgcgggtgggacatatgtaagacttccgcttggcgcgtagccggaggcgatggcgcggtggtcgccgtcgcgcccgtcaggtcagggggcgcgcgcggctagcttagcttttttcgcgcgtggggggaggggtttgggagatttttgtgcgtgggtagcctttccctctcgatccccttcctttttccgcgcctttccgaaaggcgatcgaccgaacgtgcgtggtagtacggacgcggcacggcgaataaaaccagcaagcaccaaccatgttttatgttgagaatctacaatacgcatctcttttttgacgagggtttatgttgttgtttgcaacagaacgcggcggagaagccaccgttcttcctgccgagctggacggggatgttcgtgctcaacatgttcatcgtggtgtgggtgctcgtggtgggcttcgggctcggcggctgggccagcatggtcaacttcatcaggcagatcgacacgttcgggctcttcgccaagtgctaccagtgtcccaagcccgccccggcgttggcgcagtcgccggtgccattgccgcaccactagcgcgcgcccgttccgcaccaccgccgccgccgcggcggaccgtgacaacgtgcaccgccgagcccggagcaaggaacctcgctctcctggccggcacggctgcaaaaattcagtgttgcttaggttttggtcgccttgtaatatacaaagcctctcctcctgtgctagggtgtcacaccaaaatggtagaagaagaagagggcatgggtccctacgatcttgccccgggccgtccgctgccgcgttgctttcccccgatcctcgatggtgtccttgtgtttgtttggcttgcccctccctctggcgatatatatgtgatggtcgtcatggcttataaagattttcagctcatgtcacattttcatatgatatgatgtagcatatcactatagggttatttgttttctacctggatggagcttggtccatgttgtctagcgcgagcaattgtaatcggcgattcctcgtgctagctaaaggcaaaacacggaggcctttgtttattgcgttccgctttggatgttcttattgtaaatgtagagcgattgctcgcttttttttttcttctcttccgtatgtgttacctttgcgccaagcgattaaagtttcttgagaaattttatgggcttctttgaaaggaccacaaagcaagggagaaagatatggagcaaaaaaaaagatgtgctcgtagtaatgaatggtggtcgagtggggttgtgatgcgggtgcggcgcgggtcggcgcaagctataatgactcgcactctgaaacttgcttgtgaggctcaaatgctcatccagagttctaaagatggaggctaccactactggctacactggctttgcatagttgacacagcgtgtcacgcagcagacggccctgattagcagcccatcttatcacaccagcatactgatacaccggcggttgaggctaactttataaggattagactccactacttgtactggtactagtagtagtacaattcatggatgcattattgttggcttgtgcttcacagcatcgatacggactttggttagagagaagattgtgctttaattcgcccatgtgggactcctaggctctccccaagccgttgcaaatgggattctctctaatccctcactccctcgggcatcagccttcacatggagggggcatgtgcttctattgacaggtttctctttccagatttccttttgctggtatctgtgttccttccaaccatccatgagagggggggagcgaggtgctaactgggggagcatgtgctttcgacttcacagcatatagatgttttaatctgacagcaactggccgttgatgatagtttttgtttgatttgatccctgtgttcttaagtttgaagtgtatatggtatagtacaatatacttacctctgctcgagtcccatcttgcacatggtaatgccacttgccgttgaatggaatcccaagtggaaaagaacatcaactgatgatctaaagaactatgcttagtgcttacttctatttgcaagggaattgttggcgatgctaagatacgcctcaaccatgtggagcatatgcctaattttccgataactttcgctatctgacaggctacatgtaccaagctatgagtttaggtaaagaattatattatctttcttgtataggcgcaatcttgatctgataatggcagatcatgaacacgcgccatgcacaagtagttaggcgaacatatagcatgtagtttagaaatgcaaatcgtgcaatcttacaggaccccgaagctttctagtgcaactggaggacagcgatttgagattacaggatcgcaagaaaaggctcaagatatccgctggtccctggtaaacagctcataaggcgtagctcaattgatgcaggtagccaggtacttagcccacccaacgcatcatatagcatctacttttcagctcaacagatctgaacacacctggaaccaataatgaacggtatctcgcaaagcctcttgtttcctcgtccaaagaccaaagtgagttgaaacagttcactgattgctgaagccaatgtacgcgactgttacaaggcattgttaacatcagcagttaaaatcccaacgaataacatcagttcggtacatcatgtacttgaatgagaggaacagtgaaacttttgctggggggcaacacatccaccgaaaaatagcatgtttactggcttcgatcagaacaagatgcaaatgtccatccaggattggatcatcagcttaaccaaaaccttggcattccagagtcacgttcagctgcagcactgttgttaggtagcctctgtattctacttgagaactcattagcctatgaaaaatggacaaagggtcaattacagactttgcaaaaaaagactgaaaactaattccaccaaataatcactatgcaaaacatgtggcattgatacaccaaatatcacttaaaggaagaaaaaaacaattgggatcaagtttctctggttttgcacttttgctcaaagcaaaggtaagattcaccaaaccatgcgaaaagtagagcataggtaaaaaaaaacaagattcaacaggacagtatataaaagcagaaggatatgctttcattatttggtcaaaggcaagattctatgtaacagtgcaataaaaggggatcaagttcctaagccgaaaggattctactaaagcctagcataaaatctggaaatatcattctgcgtcaaatcaatattattgcttgcagcctagcacagtagcacaaataccctcacaaactgtgaggctgtaagcctgcgataagtaactaaagccacctcaaaaatatgagcataaagtggtatacttgagttaccaaccttctcatcgatccacattaaagaacgcagttgattatccagtatccggacagcaacatcaaatggtgtcatactatcagcagtctcaaactcagcaccctggattggaggaggctgatgtctaagacacaagtcatcactagacaagtactgcaaccagaatacttacctgagtagcattcaatgtctgaatgatggacttcacttgttctgtcatatgttgcaattcattctccacagtttcagattgctcaaaccttggcattgcaaaattattctgttaagctgatgatgtatattatgatataataaaacattaacataatcatttgtcctcacaaacaaaaaaaaacagctttgtcagccaatttggcaattcctcaaaaaaagaaaaaccaagctaagcaactgagtggggcagaatagattatgcacatatttcgagtaataacaccactattgagacaggccactcatgaaacaaagaatatcgtatgttattcgattcaggaataattttaagcaatgcacagcgtttacttagcttaagctgcaattattttagatcatgtgcagaatattcatgccacgtttccaaaaggaacttctccaataacatgtcgcgttcagaattgttaaaatgcctaggctgtgttcgtttgttatctttcccaactcacctccctcgttttccgcatgcactcttttcaaattgctaaacggtgcgttttttgcaaaaaaaaattatatacggaagttgctttaaaaaatcatattaatccatttttcaaaaataaaaatagctaatacttaattaatcatgtgctaatgagttacaccattttgcgtgcacaggagattagttcccaactgcaacaaacgaattcagccctagacaacttgttctaagccatttgttatctttacaatatataatatttaaattcatcccgataagcaatcatccataatctgtccaatcaaacatttcaatgcatcctaaatcgttttaaagcaattgtcttaatttttgttcccgaagtgtggtgcactatttatttgcattactgttactaaatacaaacagatggaagtagctgaatccaaatggtgactaacattgtatctcttgcagaagcagcctcatcttcacgaagcaacagccgttcatcctggaatacccgctctgcttcctcctccatgctctgcagagccttgtcaacctgcaattatataacgagttgttcactagccagtacctggtggttaatatcggaatagtcacagtttagccaagtaccaaattatggaacaccaaaattttgattgatagttcagtttgtagcaatgaagttcaaacagcatatgcgattaatttttttcccacttaaagaggtcagaccaaagcatcatagtatggaactatggaagcaaacaacaaacatattactacaggctacagcagaacttttaaatggcaactgcaatcatcactgggtaaacaaccaaaacataactctgttagcactgcaacaaattattctcgaagaaatttctttgcacattaaaccatagtcagaatttagtcttaagcaaaaacaaaaaagcatcacatgtcatgtacaaggtttacattgcccccaaaaggccatacggacagaaatttaaaaaaactcaaccagtgggggaatgactgcccccatgggccacagcttttcattaagaagaaacctcaattcgtggatttcc

SEQ ID NO: 11739 - DNA, 15615 bp, Oryza sativa
aaaaggcattccatattaatgcattctaaaatgcagcttggcagttgaaagcttgtcatccttaaaaaaaaaatcagtcaacctatcttcattaaccatattgtgcgcaattgtgtaaaaaaggagatgacagccgaaatatgatgcatccctggcagcatagcatataaataatgagcttacaggaaagcaattcactagtcaatattatgatgtcatccatggggatcagcaaatgaaagagcaaacaagcatgcaacaaaaacaaaagtcataactagagtatgcagaagacatgaaatatatgcatccatacccacctctttctggtgagtttctattaactcaagttgcctctccaagcttgtttgtgtttcaacaactttagccacctcagcctgcaagggacataaaatttattttaaatcacagcaaatgatctaattatataaagttcttttgagtaatataaacatgtatgcatgctaacacacatctatccagaaaagcaccagctcaagaggtgataatggtgggaagacaacatcagcactaacttaattagtactaaacgaagaaattcatgaaatgaacatatcttctcgcattaatctaatgtgaacgataggcagctgagagggagatcatcatagctatcaatatttaccaagagcatcctagaaaaaactataggagatatcacatgtgaagtatttgaatcaagttaggggagctgaaacaagttatttggatcagaggtagcattgcacatgtatttcgcaaaggcagaatattggcatagtttttacatcttcaatcacagtctgactagtgatagggcattgatatacacatttccctgctttacattcgactgataaagctcaccagtgaacagcaaggaaaaagcagttcgttcactttcagacttcctagtttttcattttcctaatttctcattccatcaataatcaaaactaaattacataaaatatatgcaaaagggtgaggataaataaaaaaaatcatgtacacttttaaaagcaacaatacatcggctttacatgaataagtcaaatcaacatgcattgcgcaagacaatcatctactagataatcaaataattattcatgtttcatgttcaatttaaaactactgctaagaatgaaacctccaagtctttgtaagtttgcattaccagtgataaattctagagtccatagggtaagcatggctattcaaatccaaccaggcttccttctaccctgctttcaactaattgtaatcatttttcataaatattgtctttatgcaaatgactttgcaaaaccaaatcagcaataaagaagtaaatatataaccatcaaatcttctgatattgatctagctgcaaaagttcatatgaacagaactagaaaagaagagctgtaaaatgtaaaaataagaacatacctcaagccttataagaacagtcctgttctgcagaattctcctgtcccattcagatattgcagtggcatgcttccggaacttcgcagtgcgatcttgaagttcattattccagtccctaataatctacaatatagataagttcgtcggtaaaatattactgtgttgctcaaggtaattaacaagacaatgcaaagtcaaactagaaagtaagtgttgcagtagaaaacaacaccttataaccgcaaagaataggtgcagtacctgctcaacatttttcccaacaatttctgatggtagcttaggtgcctgtgatgctactggagtgatagcagtagttgtaggactgcaccaaaagaacagggaggccatgaacaaggtcaatatcttgtagcccagaccctttaataagtatgctagagataaatcgacgggatttgtacaaacccagtgctgctagcttgaacagctgaggaagttgcctgactagtgcttgtgatggtggttgaagtacttgcagctacagtagaaacacctgttgaaaatacccgcttaacataaatctggacatcatcaaaatagactgaaaagtgataatcaaaatagactgaaaagtgatcacctcaagatttaggaaacagattgcaaggtaatgattatagtcaaaacagtgcgttacaacaacaatttcctgtattgcataggaaaggcaaatgcacaatgatcgggtcctcaaatgatgatacaaataagttatttgcgatgttatgagctaaatggttacttgcatgagggtgacatttaattgttcactgccggtaaatcaaggtatgtaaatggtatggtcaaattagactgaaaataaaacaatagttttaacaagaacatgagcactcaccgaatgacaatattgactgtgtctgtgttgatggagctgaggcagaagctggtgtagttctctgctggctaaatagtgtagcagttgttgttgctgaaggagccggcgttgtcatggctgcagatgtcgatgcacttgtgactgttgtggtagtagctgtagtagccgcagctgatgatgacgatggtactactgtgaaactgaaaccaccagcagaagaagcaggtgctggcactgagaacaatgaccctgatgtcgcgggggaagcagtagctgctgacggtgtggatgcgctcgttgcagaagcagaagcaaatgccggtgcagaagcagaagatgagccaaacggaaagctgagagaagtggcagacgagcttgctgctgcactggtgttagagaacaatgagggagcaggtgctgccggcgaagtggccaaggagaagccagtagatggagcagacgctggcgtggtgggagcagcagagctactcttcgtgaaggagaaggcgggagcggaagatgcagaagagaacaaggcaggggcggtgctcgcggtcgtggtggttgccgatgacggtgtgaagccgaacgacggagcagaggcggcggtcgctggcgacgatgagaagccaaaggacgccgtggtcgtggccgtggtcgctggggacgaggcggtggtggtgctgaagagtggtgcagaggtagtggatccaaacagcgccgagccggtgcctgctccaaaccctagagccggagaggaagccgaagtagtggtggtactcgatgcagcggccccggtgttcaacccgaagccgaaagacggtgtcgaggcagcagcggtcgcggcagtggtggtgcccgacgcagctgagccaaagccaaagcccgtggcggcgccagagaaaaggcttggcgcggaagcagcggacgcggcggccccgaacagaccgggtgcggcggcggcggcggaggtggcgccgaaaggactgggtgcggtagccgcggaggaagcaccgccgaataagctcggggtggtcgccggggaggaggtggcgccgccgaagatgttgggggtggatgccgcggatgatgcggcgccgaatacgctaggggtggtcgcggtggcgggggtggaggacgcgccgaagatggatggggcggacgcggcggcggcggtggattggccgaacgagaagccggtggatccgaagccaaacggagatggggatgaggaggtggcaggggcggcggcggaggcggcgggggcggacccgaatagggaggagccaaaagtgggagcggcggcggaggaggaggaggagaagagggaggagccgaaggctggggcggaggcgggggcaggggaggaggcggcggcggcggcggcggcggcggcgggctgagagaaggagaaggctgatggggcggtgccggtggagaaggagaatggggaggagccggtggatcccgacgcggcggaagagccgaaagagaaggaggtcgccatggctgcgccggcgtgagcgcggtggcggatttgggggatcttcttttggcagattttttgcgtggttttgccgcgggctcgtcggccgcgccggcttgagaggaaggggaaggaggggtttggggcttggttccttcgtgggtaaccgcttttttgaagtagggtttaggagggggaaaggggatttgggaggaaatgttggttgttcacttgttcttgtgccttcctggtacgtatacctaagcatgatgtgtgtgttatccaccaaatttgaactagagaatggttcgttctcacttatacgaacctatcgtagtaggcaaaatttgttataggacacccgaaaatcgtgtaattggttgtgagacaccataaaattttggttttgcccatggacactatgaaatttgtgaaattggctgtgagacaccagaggcaatattttatagtttccgaggcaaaagaggtcaaatattttttaaaaaagaccaatctaccccctgcacccagctgtccatctccctccccaacccgatttcccagtctcgaaccctaaccctaggcgacggtggggccggcggcggtggcggcgccggcggagacagtttcgacaccggcgaaggtgttgaggacggcaacgggatcgagatcacctgcagttgcaatggtgactgcaactttagcagtccttgtgtgaccgttagatcaaagaaaaacagctcagatttgaccagaacactgtagcacgcacacatagtcctgtagcgcactgtagcatgtactgtagcattggcaccttggttgtgacgtggcataactatctgtcgttgatcagtttgatccgacggttgcgaatggatgtgactgcctaacttgcagtcaccgttgcaactgcaggtgatctcgatccacggcgacgacggcggccgctggagctgtgatgatgacgcagtaaatcgatccttgtggcaaacccgacgagtcctggcggcaagtgcacggtgcggcggtttcaagccgatagcggtggacggcggagctcagtttccaaatggaggacacgttctctgcacagccgtcagttaattaactaattaagttgtcctttggtgacaaatatttcctggtgccatagaccaattagcatctgagtggattataacagcaggtgcatcgtcgccgtgcaggattgaggaggaagaagcagccaaaggcaataatggcgcaggcggagaagacgagcgagagattttctctgtatgcggaatctcctgctcgcttgatgtcaggatcgcgccaggcaaggccctattcgcgtctgtgcgcggcgcggcgcggcgcgcacacgccatgccagcatgccatggcatgccaattgcgtaggggtagattggtcttttagaaaattatctgacctcttttatctcagaaattataaaatattgcctccggtgtctcacagccaatttcacaaacttttatagtgtccgtgggcaaagccaagattttgcagtgtctcacagccaattacacgatttttgggtgtcctgtagcaaattttgccgtagtagtaaaagtcagggccgtctctagaaatttagggtcccggagtgaaatgcaaagtagggccctataatttaaaaatcatgtacaacataaataaaatatattttcacttaattatatagatgcaatatgtgttctaatattatgaatttactatatatatcatctactcaatcactgtctaatcttacccgtctaaacctccgaggtcgagttatcgagggttgagtcgacgatgaatagcggatgaggaggaggacggcatgagctagcagacgagacaaggtagcaaggcaaagccgtcgccgctgccgctcggagcgttggaatcgcaagtagcaagttgtatcgctatcgccgccacctcaatcgccgtgaatggaattgggatcgtcgtctcggtctctgaaatcggcacgtagaattagatcgctcagcaaccaacaacaggacgaaatcaacgatcgcacaacatcctcttgattttgggcaaggcctagcattgttgatctatccattgggctattgcctattagatgatgttgtattgcattgctatatttaaagtgggccttcatgtttatatgggccccctaaaaatgggggccttgtgcgggtgcctatttggcacatggccatcgatggccctagtaaaagtttcaaatgtttgttaatctctttgcatatgcattgaactatcgtcatatgttccctgcaaaccatttgaaatatttatgcgacaaagtaaaagtctcaaatcatatttgtgaaatctcacatacttaggaaatacatatatttttcattcattacatcactttttttgtccatcatccatatttagttgcatccagatcgttcatccgtaaaacacaaacacaatgctacgattgttggtaataaaaaggtgacccaaatcgcaatgtacttaaattcaaaacataccatcaaggtttgcggatacatttagaaggcaaaactatatgttgtcatatcaaacacacatagagtttttgcctttttattttcacttttcttgagtggcatatatcgaaccagtaaagaaaacattgaaaacacaaaatcagtaagaaattctaaggtgtgtcattgataggaatctaatttatcaagttgcgattaatgaagttacaataaataccatcttataagacaatttgtataagaatgttattgacgtgacgttccatcgatttaactttgttagctcatgtggagtgaacattttaccactatataacaattaagctccttaacgtgaaaagaacaatgatatcgctgcaacaaatcacgctctagcaaacatctccaagcccttcactcttataaatccgttgtcgctggaaagataaaaaccacaaccatcaaaaggagatcaccggtgagagtgctagcaaactttttcatgggtggtgtggcggcggtagtagccaagataggggtcatgtcgggaatcctgtgctgtcgcttcacgccaccgccaccgcttgaaatgcacgttaatgttgttttagcctataactatcttcgtcctcacctagaagcgatgtgttactaggctttccttacttgcaaccgtcctaactatattacgtacatggtaccatctattttttaaaataaattgatataatgatttattatagacagaagaatgtgaaactaaatatacattaagagtacaacttaaaattatttctctcctcgtagaaacgattatccgtctataagaaagttaacggggaaattccggtgatcaatgtcgagataacgttccatctcaaagaaaaaaaactgagaaaaccataatactatggaaaagtctatacgtactaactttttcttactaaatttttactaacactgacatgccatgctataagtgtatctagatttttttataactttcatctacttgaatcaaacggttgagatgattgttagtataaatttagtaagaaaaatttagtacgtgtagcggtgctctaatccttttaccgagtagcaacaggctaacagattcagagtaggcagttggatctcaatcccatcccgtcctctaaaaataaaacaaaatcgggaacaggaaacccacgcacgaatcgattcccatctaggcatctcttcccagagagaagaaaaagaactctcccgcagccgatccccaaatccccacgcatctcatggcggcgagcctgtggcgggcggtgatgggcgccggcgcctcgtcggcggacaccgacaccacgggcggggtggagttctggcgttcgccggagcgcgcggggtggctgaccaagcagggggagtacatcaagacgtggcggcggcggtggttcgtgctcaagcaagggaggctcttctggttcaaggactcgggcgtcacgcgcgcgtcggtgccccgcggcgtcatccccgtcgccacctgcctcaccgtcaagggcgccgaggacacgctcaaccggcagttcgccttcgagctctccaccccggcggagaccatgtacttcatcgccgactccgagaaggagaaggaggagtggatcaactccatcggccgctccatcgtccagcactcccgctccgtcaccgacgccgaggtcgtcgactacgacagcggccgtcctgccgcctcagtcaccgcagacggcgacaagtgatcgatttcatcgattgattggtgagcaaaaggacctgtggttcctgtaatactgcagcatatccatggtacttacttaggttttgcgattatggttcatgtttcttgatttgcgaacgtaagtgtgcatttgtatattactgatgcttatcggggaataaatttgggagtttagtgtataggatgcgctctgatactatccaccagttcactccatgtaactttctttaataaggtacgatttgtttggtcaattggtctgtgtttagttgtctaaattcttagatcaagtgtgttggtgaaaccgtagcaaatctttcaaggttagtcctgactaactctgcactcttgcccgtaaatagccaactggctttgatctatggaattataattcaattgtatatctttattcatgatcttggtttgctatagcaactgtatttgattgacagtggtgaacttataccagtgcttagtgcttatgcacagtaaaagcgggctacctcacttttgccttcatcagaagatgcaatccattccagaattcctttcctgtgaaatagatatatactttgttgtttaacagattcaaggtgcaaggagtgattttcaagtatagctgtatgattatgtgcataaagcacctaactgattatgaaaacagttgcaaccagtgatgttataacttacagtatagctctattggtcacaactattaagtcaatcaaatacctccatcatattgtcgaaacaccaaggctgtgggtttatgataatgaatattctaagctatagatattatttctaattggctggcctgattcataagtcccaacaactgttggccttcatggaatacatgatgagcaatattcagtatagacttatggagctaatccgttcatggttcattttggtgacacttgttgatatctttgtagtaaatattgttatttctctttcgttttatcatgacatgtgagtgctatctgttatgtttgtttaaaggaatcattctttgtatgcctagaaagatgcttcctgtcacaggttgtattatgtaactttttcattgtaacatgaagttaaaactctgataaactcatgctgacataaacttgccatcagtttatcatgctgacataaacttgccatcagttagatgtggtctttggagaagaaactttgtacttcctccgtttcacaatgtaagactttctagcattgcccacattcatttagatgttaatgaatctagacatatatatctgtttagattcattaacatctatatgtatgtgggcaatgctagaaagtcttatattgtgaaacggagggagtactttgaaatgggtaaacgaacatagtctgagatgcaaaataaatatctgaaaccaatcctggttatgaattatgaagcctatatgggtaaatttgtcaagaacacatgtttatattcaagtattttgttgttttgaataattactttttgtgttgaaaatccaaaattctattaagtttcagtaatatttttgtgtagtagataagtagaagcttattgctttattttactcaacctgtcaacataatttaaatctctagtgttcctttcttaagatgtctgtcgtctataaagttagtctgtgcttgctgttgtgtcatgtttttcaattacacaaccattattacctgccactttgggtttaactaaaaggtagcttgtggcagatgtgggaggaggctaatctcatgagattgttgaacactagaacttgatgtcgccattatcaactcaaaaaattatttccatgtcagttaaaagcgtgtagggtagaaagatgtactgtgaatgttacacatgcataatgtactgagccttgtggggtatatatagattacaaatgcaagagtgtagggtagagagatgtactgcgaatgtcacatatgcataatgtactgagccttgtggacggtatatatagagtacaaatgcttggatctcaaagaatcatagagacaaaaatcaatcacatcctaccataacaaccggatcatttccgttcatatccatatactcttaacatcggtgatacatgggccgtttaacactggtgcatagtaatatacctaacctttcggttttgcttgcaactatagtacatttttgtttgttttgagaaaggtatcgtctgattctccttctattgattcttttccgatcaagatgtatggattcatatgtctacatacctagattttggtcatgaattaacggaaatgtgcgagagctttatttgcctttgccattctatgagtcagctcatacctagattttattcatgaattaacgaaaatgtgcaagagctctatttgcctttgccattctattctatgggtcagcttgcattttgcgtatgacacccccaccctctttagcagcatctactaactcggaacttaatttaaaagccatattttgacccagacgcttttgggatgcttctaataaccaacgaatggcaaatgatctcccttatctatatcctattcaatcagaactttccgcatcgatcctttttattacgtcttgtttttactcctatattcttgtctagatcctattcaatcggaactttccgcgtcgatcctttttattacgtcttgttttcactcctatattgggatttaccagtaatagtccttcctttagtttcagatccttcaaggcttcaatcctccctcctagaaccctgttccctgcatttgtatgtcaatgaaatgaatgttcgggtgaactgtatgtctatcgttttatctactcccatcatacgtgtattgttggctgtatatatccacctatggatatagaggctggatttctatccattatcttaaaaaaaagatcatacgtgcattgttgtcaatgtctgcagtgcacactttcatttgctagagcaaataactcacgcggtcatgccctcgttccctccggtttgtttgcacttcagttccagctagcatccttttcttctgttgcattgatgccgaagcgagaaggcaagaaaccatttgccatggtgctcgaaggcttgtaagaaaacacgggcatttgttgtgacttgtacggttgattagacgagccgtacgactaggatgttgctgcctctttttttttttctcaacacgttacagtttcctacatacaatatagcacttcatcttgtaaatactttttcctcccctacttaatataacaccagctttgttggcttcatttttttaaaaaaaatatatactcactccatttctaaatgtttaacaccgttaactttttagcatatgtttgactgttcatcttattcaaaaacttttgtgaaatatgtaaaactatatatatatatatatatatacacacgaatcaaatgataggaaaaagattaataattacgtaattttttttaaataagacgaacgatcaaacataattaaaaaagtcaacggcgtcaaatatttagaaacgaagggagtatataacttttttttaacatatatagcacttcatcatctattaacccaccacaagtccacacctgtgcagtgctgtgcagagctagtctcagttggcactcccggacggcccggtcgcccgcacggcttcgctgccgtggcggatccagtccacggcagcgggcgtcgcaagtcgcaacgcaacgaacggcaggggcagacggatgcgaaacactcggcgcgcgcggatccgacgcgagaccagggcagctaggagaacggggacaggagggccccgcgggcgctaaccgccttgtcaccacggccacacacactgccgtgcgcgcgattccctcgtcccaccctgctgaaaaaggcccgcccggagcgcgaatgcatccgtgccgcgtcaagcaactctcggtggtgtggtgtccactgtgcagctcccgtgcaggcgttccgctttgatggaaaccgccgcggccgtggtgtgccgaggcggcgggctgcgcgcgccggcgcgtcgcggtggcagtgacagcagcacgacgcgcgcgggtggcgttgctgcctccccggcgcccgccaccaccgcgcgacggaggccgctgctcgtcgcgtcgctcggggagcccctcatcacggcgcaacccttgtcgtcgtccctgggagatggcgccgcggtacacgagacgctggctcgctccgattcggtgatcccgtcgctgaagccgtctcactgcgttgatcactcggtccaggttgacgccgacgaggagaccggctccaccaagacactcccacctcctgatgacggtgagctccactcaaaaattacaaaatcacaagacgatgcgattctcttaaacagctcatgatatattctaccctccagttcctacgaagacagtgcacgtcaaattcgtgctgcaaaagcggtgcgcgttcgggcagcgcttcctcgtcgtcggcgacgtcgcggcgctcggtctctggaatccggcgaaggcggctgctctggattggtccgaagaccacgtgtggacagtgaagaaggtgaatcccatcacgcgaatccttccattctccgtgtataatctcgtaatgaatcatccccacttctgatctgtccaggaattgccagcagaaagatcgatcgagttcaagttcttgctgcaagatcgatcgggacatgtcgaatggcagcacggtcgtaacagaatactgcatgtagctgacacctcgaacaccttgattgtctgcgaggactgggacgaggcgaagaatcagcaagtatcagaagagattggtgacgcagatgggatattttcaggaagcgatggcgtcttccaggaagatgagcttcaactgggtgaagaacaagagaccaacaagggtgtgactgtaggtgtggatgatgcaaaatcggctttagtcacttatatttacagggaaatgatgggagcaaacgacgcgatccagccacaggtaagttgcctggtgacagtattgttctgtgtaaaagggcagcaaacatttatgtgcaacaatatactactccctcagtattttaatgtatgacgccgttgactttttgacaagtgttttacatttcgtcttatttaaaaaatttatgtaattataatttattttattgtgatttgatttatcatcaaatgttctttaagcatgacataagtatttttatatttgtataaaaattttaaataagatgagtggtcaaacgttagttaaaaagtcaacggcatcatacattgaaatagagggagtatttaagatcagcttcttgttaatttaatcgtccctttttcttttctaaatcagttagcattggacaaacaccacaagattccagatgagcttagtggggaggcaaacatggcagcacaagatggcaatcacactgctactgcagccgcagcttctggttttgctggaagcaacggtgaggatgccatcttgcacaaggagggcgatccagtagagaataataggctggggctggccagcattttcttcaatgacatggcctggaccaggaaagccctgcagcagttgctccgaagccttggtttccaaatcggcacgagaaaaacatgaagtaagcatcagagacgctgacctgcagttttggctgatcacacggtctcgcggtgccttcattcaaaactcgaaagcttctacatgctgcaaacctacaaggaacaagtgtattgagaactgcaacaaaaaaccctttacgttgctaaggtctgcaacaccagcagtacttgttagcagtgcaaaaagagcaggaaagctgttagcagtgcaagtatgtttaggaccagtaatgactaagctaccaaaaaactcaattagtgaaatgcatattgtggttaaatttatctgttcgataaattctgtagaatacatctagaataagagccaggaaaagctgaaagtctggagatttggcataacatgtgctccataaccacaacgtataagctcaaccacatgtactttaatccaccagatttacgttcatttctcaatcatttcagttgtaatgctaatatgctcttgttctggtgatctagtaaaaatgatgtccatgatttgcaatgctttctttaatttacataagaaagctggcagcatttaaaacatgtaaacgtgaaatatcagcgtggacattccactttaattaaactaacttgtttacaaataactgtatccgtcaaggaaacagtcaatattcatgacatacccctacccctacctgtttacagctatccaactacgccagtatcctgtgaagattacagctttggttgtatggagcaaacggtccaaggtcaacagaatccacgatgcaccatgcccaattctctataatttatcaccttctaaactcggagaggcaaaaaacactttgcatgaaaatcatggttcaagaggcagccagccaaccataattggagaagcgcttccagtaataaaccaatggattgccagaatgccacaattttgaaaatggcatgttatcaacagctggcctcacatttcaacattatcaaactcacctctgtgggatataaggggaaattcagctgttgcatctggaataaaaataataagaagagatgacaagctgtaagataagagagacataaggactgaataatgattaatttacatcttactatccagaatacaagatatttttaggaagagatactggcaaaaatactcaatgaagtccagaacaaaacattattcgtaaataaaaatagcattcatctgcaaattaagatatgttgacgtgcaaaaacggcaagcatcaaatagctaccttactggtctcaaatgcttcttgatttgtgggtccgtagttgttttcaaggtcttcagcgcctcttctgcagcctgaaacaaaatgtttagtggtgagtatcaggaaaccgcagcaataaagaggctataacagtgctgttgccccctcgagacagaaccagcacactttgcaccaggcagttattagtggttaatgcaagtaactggatagttaggcaagtcctgataaagtttttactggccaaaatatttccattcagttttgaagtttaaatgtatcaaagtcactagaagacctacttttgttcaaaatgatatcctaataatggtaatgtgtggaccaagtggacagcattcatgggttcgaatcctgagaaggatttaatttgttagaaatcccacaagcccttttggccaaattggtaatggtaaagatggcatttccaaattcccacaaactcttttggccataacatatcacgtgaacacaagctctggtgcactcactgtgcacaccaactgacatatacatactcataaaacagagagtttttttcttttctttttttttccttttggtaaccgctgatatttaatggatttgaattccaaaacttatatataggtggagtaagattagaagta

SEQ ID NO: 11740 - DNA, 2499 bp, Oryza sativa
gcaggtgcctcatttatcacatctgcgtgcaagtcagtgcaatgcctgatgcaaatataatttagaacgacagaactcaaaaaagtatttaaagtggcaatgcatcaacacataaaagctatgaacaaaaggcgagagcaatataaaatatagtacctgaagcttcgcaaaatctttgttcaaatcaatgcccctcccaagaatttgtcctcgtaattcagcctacaaaggataacaacagttgcaacattaattgcattaacaagctcatataagttaattttaaataggcaattagcaaatatccaatttagtttagtttctaaacacttgccagtataatacaggaatatttgtcataagctaaaaaaaactaggtagcaaccagccggctccctctggcaagtagtaaccagctagttcccttcttcaaacaaaaacccaataccagacaggtgagaactggtctgctccagaactgcaacacccgggtacactgtggtataagccagaaggcccacaactatgctaggagaattctagaacgatgcgactatgcaagttaattaacctggaaatggtattctccatttaatgctgagccagaatcccgtacttgatcgcgaaatactacatgttggtcctccaagcactagaaatagcaattgcaaattacaattcaattaagcaaagttaagaaaagaaataacacattaataaggacactaaaatggaatataagtgcagcagcagcatctcttacaagttctctaataagacttataacagaggacaacctatccaaagcttttgaatgatcctgttcttttaatgtacttccagatggctcttccatagaaatatcctctgagagagtaatatcttcgagaaagccatttccactcccaggaggcttgttcacatctttattaagaactccagcaacaggagccatgaatgacaagtaattgcctgcaagtcagccagataacaggatttaaggcacatggaatttctcatcagtgaatgctttagaaaaagaatgacacctgtaaacacggaattgtaaaacaaacgtaacttttcaagcttgcaataatcaagatgtaaaggattatactcactttccaaattctggagagctttttcagcagctagtacttgggcttcatctcttgtttttccaatgccgatcccgattttttcattactaaatagaacctggaacatcatatgtataggtaacatgaggatcacatgattaagtagagatatcacagcattgctatacaaatctggtaatgcacccgcaagcaaacagcttcagagcaaaagcactggactgatgctgaagttgagagttgagacgccaaaggaaatgtgtctcaacattctaaatatatatttttctcaattagaattcagcccaagctgttgccaagaccacatggaaacgaagtataatatgtaaaaattcaaaatgccaacctcaacagaaaattgcatgttttttccactgcttacagtagacctgaactccacctaatgaagaaagaacaggagattactctcagctcataagggcaatggcagaaaacaaatataatcttaaagatccaaataccctggattcgcacagccgtccaatttcttgcaacaccgtgacaaataatgagggggttgttgccaatgatcccccgttagattggatatttgtaccacctggaatgccacggagtgccactccgtcgtcatctacaaagattggtttatgttactcgaagcatcaaattacagatccaaaacaatatatgaattgtacttctttaataatagtgaggtacaattaggattttcaagcataatgttgatgctgctgcatttcatagtagagtactctttcctttacagggaaaaaatggtacagagaaaaccattccctcttttaatgtccgcaaggtaatattaaaaaatgactaaagtgatttataaatgcaagggttcaagaaagcccaggaagaagaaccaaaagaaagccaataaagataatggacatgaggtaagtacctgacaaacgggttgatgatggtatttgtttctggtctctaggatatgcctgaaataaggaacacactagcatgatcattatatactagtctattacaaactgataaagaaactagtgatgattttgctagctaagtgatagaactgtggacttaattttgatacaaggacaaatccaattgtaagccaaagaaggatcaatttgatacacctacatttcttctaaaatgaaataacacaaagtagatggttataaataattgaaatcaagctacatgacagcatttatattatgctgtataacagcgcttaccatagaaataggcatcattagctgatttgatctaggtgaaaaaaaaaatcaagtccctaaaaatcaaagcaaagcagaaacgaagatcagcactcaccagcccattcaacctcttccct

SEQ ID NO: 11741 - DNA, 2945 bp, Oryza sativa
aataaatacctcggcttgtggggcataatatggagtatatgctgggacaacatgaactcgaggttgatccttctcatcccaaacctgcagtcggtcatctaataccatggccatcttcggatggcatcctttgtctttaaaaacattctgcagacactttttcgaacctgccatgaaatagaataatgaataatattggtggttatgtccatgaaattatggcaggaacatagtccagagctgagactatagagatagtaaagcgaagatctatgttatgtattatccatataatgggcaatggcaaagcgcaatttctcattcacttaagcattctacacaaatattatattgtttaaactaagaataagttttatacaaatttaaacaatatttagtactacttatgcactatatttgaagttgtaaggataagaatgaaatacaatactaagggaatgaacgatacatgctagaaaaactatgggttttctctctgggacactaatctgcaataccgaacccattccttctcaataacttggaaacacaacataatttcattgtacatgaaaagatagatacacagaatattcgtgttcagtgttttaaagtagctactctgtgtttagtaacgatgtcaatataacaaaacatgttgagacaagaaagcaatgaaagatagcagaaaaaaaagcacctccaatttcttgaaaatttacctgactttacacatactacacgctctgcaaggttatgagagcttatcaagttggcttctggatcaagaagcctccacatctcaagagcataatctctctcagccattgtacatacatagacctcaaatcgtttgcgtcccttagcagtcaggtaacttctcaaatcctcccaagcaggccttagctttacaaaaacactagtatcgcgaacctgagcagagtattaaaatcagacaggggataaggtaatcacctcaaaaaagggaactaattacagaattctacaataattaaaaactctagttatctcaaaattttgaataactagacatatgagaattatactgagcccattttcagtccagaatgacttaatcagcttgattaatcgtctcagataagcattacaaaaataattactaaaatagaatctcttttttctaattggcagcaaacatatgagctgataataacacattgtgtgtaggttgtcaaactttgtgttaattgttatttcatcatttcccaaaccatcaggctacaagttcatttctgcatctgttttattcataaacatcacatgtacaaagcaaattatgtaactatgcagatcatacagacctgtaggtagaaacaatgagcctgaacaaatatgtcttatccgaggatcaaaactgcagcaattacaagtcatttatagaacttatttttgtaccatcgctaataaccaaatagacatacagcatgccttttgtgggcagcaaattggagcccagttctatttttccaacccaggaataggtccaactgatttcaaagtgtaattctagataaccccaggccaaaaacatgcacacaggcaaacgataacaacatttcatttaaatgaaatatatttatacatgatctatctgaattgtacctctggatttatgcgagttagaatcgcattcctttctggcagcctgataacaggccggagaacacgctcctgcccaccagagataggcagaacttcctccttttgggtcccaacgattctgccattatctgtaactgtatctgtgtcaatgaactccttgagcagctccctgtcctcaatataccgcttgatttctgcagacatccctgctatcctgacggggtcgtcttcaatatccatcctacgggaaagcatctcgatccggtcctcaaaggacttcattgtgttagcgacaataagggtttcatcgagatcaaatacgatagcaaggcaccgcaagttcagcatcccaacagatgctgcatagatcccagagcgtactgaacagcaccaaaagcatggcaccttctccaccttgctcggcattgccactaggtgtagctcctcatctccaactactaccactgcgctctacacaaacccaaggagacaaaaaattttataaatcctattatttcgtgcccctgatggaaatatcatcaatgggaaacatcatccgaacgaatcaaaccacatcaaacacacaacccatcgaagatccataatagaatgtgtaaaacgctttgattactggtgattgccccaaaatttagaagtggcgctaataccatttcccaagtagtcgctgtaaacaacttatttcgcttcgatttcgaatgggagtaccagctatactaatacaaagcgatggacatgagcgattgttgagaaattgcgtgggggcaaaccttgtactcgttgaagcaagtgaggtagaggcggtgtaggctcgggtggggaggcatcagcttggcctggagcttgcatcgcacggagaagggcgcgatggtctgcaggatggcgagcggcgggcaccgctcgctcgtcggcgagaggtggctgatgcggatctcgttgctcgggaacggcaggctcccctcggccccctgcttcatcgggaacacctccgcctcgccgaggaacacgtcgccgtggaacatccgcatggtgaccccaccggcggtggcaccggcccctcctccggggacggccgcctggggcggggcgcggggcgtcgccatcgcgggcgagagggaggaattggagagagagagaaggggggagagtgagagcgcgcgcggcgtggcgtgcgcgagcgagagaggcgccttttgcctctccttggctgcggcctgcggcctccgcctcccgcttcgacggacgcggattcgcgggttttggcaatttggggggaagaaaaa

SEQ ID NO: 11742 - DNA, 25357 bp, Oryza sativa
  unsure (1)..(25357): unsure at all n locations
aggcgtgagggtggagggttccgtttgtccggtccggtctccggtctggctgcggtcggtcggaccacgtcgcgtgccgaacccggctcggtgcgtcactgggttaggcaccccggcacggcatgtacggtcggtgtggtcagaacgagatcactgatattcaggtcccacttatttcaaaggctactttttcatccatccaatatggagatattgaattatacgctacttttagatgtggcaattgactatttgccactgaatccacatgtcattaagataggtgtgacaaatagttaattgtcaaatctaaaagtgacaaatagttaattgtcaaatctaaaagtgacaaatagttaattgtcaaatctaaaagtggcaaatagttaaatgccccaatatggggtacggagtacttgctactccctttcattttcatttaggcggctgtattgagttcctctgccaaaacttttttaagtatatggacaaacatttgaagtattaaatatagactaataacaaaacaaattatagattccacatgtaaactgcgagacgaatttattaagcctaagtaatccgttattagcaaatgtttactgtagcatcatattgtcaaatcatggcgtaattaggctcaaaagattcgtctcgcaatttacatacaaactgtgtaattggttttttttcccgtccacatttaatgctccatacatgtgtctaaacatttgatgtgttggaatttttgaaaatttaaaataaactaaacacggcctcactttgattgtcatatttcaaaaaatcagattttaaaatttgatcatcacattttaaagtgaatggagggagtaatacaaaatcaaaaaaagactaaaataccactatttttatcaaatctcaatttaattattcttccttttatttactcctagtgaatttatctcatactttcacaaactccgatttgagacaaaagagaagagcaaaaaataaataaatttactctaggacgaaagcagtacaatttattactacatccgtctaatatattagcaaaatcttttatattttaggatgggtatagtatcgtattgaagttgatcattgcaaaactgacatatggatctcactttttctagggtccatgcctgactcctacagtcctacgcaggagttgcatccggcgtggtttgcaccgggagactagtttttgttttctgcatattggggaatctccttttctgttgaattgtactactgcggaccagcttagaaccgtgtgggaaaataggaaatgcttgtggaacaatcaggttggattggatttatgggtggattgggatcaaggataaatactctgtgaataaattttggacaaaaaaattggtatcagcattagtaataaacaaccaagcatgtatgttaaacaactttccgttggctgcttcaactgatatgtacaaactactagtagcattcagtgggagtaagtatgtatgcatatatatatatatatagttcactcttatcatatttcataagatttctcatgagctgtaatcaggcatggggtactgatgattatatcttcgtaccccaacttctataaaaaaaaattacggttacatagacaactagacaagcacaacccgtgaacacattagtacttattcactcacctgaactggacaccctctacctcttttacatgatttatgtgctagtactacagagaccgcaacaatggtaccagcatttatcatgccatcgatcctgccattgatcataatggagcaatacaaggacatgatatgcttaaagtgtgaagaagatgcaaaggacaatgaataaacaagaattatagagttgtatgcactctagggttcaaaatctcggcgaaatttgagcatctagagccggctcaaaatgcgcatctcgaatggttttattcaaagtttattggagttcattgaaattttgctaaaattcgttcaaaattaacgaaaaatcacttgtagttggcattagattatttttatttttatagtttgtataaccggtgaataaatggtctccagtactaatcaaatattatgatcagaaagtgtagtgaaaaaagaagatgcaggaatatgtgagaaaaaggaactgaaaccaaataagttggccaatctcatgttacttggccgttaatactagtactactccgtcgagtacacaatgaatgattcactgctatctagtttgtggttctaataaatcgaatacattatactcttcatatgttccttgtataaacctgtttgtttgtggttctgtgaatcaaatgccatatacatgacattcgtgtttgtgctcctcatcttgcaatttcatagcaacatttttctactcagtatgcctagttgtcatggtgttttcacttgctgaattgcttttctacatatttttggctcttcttgtactgtatgttcagacttgcctttaacatggataattgaagtattgaactaacatgaaaaatgtgatgtcctatgcttcttgatcaacattcctgcagagaaccaagtcataagcattgactgatatttacctgccaactatcactgagcattttcagacacatacctttcatgcttcaacttttgtatgtttgtgctacaattttcttacaccaaatcgcctgtctctgctctggaaggagcaaagcgcttcgaggtaatcagcctccccgaaatcaggccacagcgtgttggtgaagaagagctccgagtacgctgactgccacagcaagaagttgctcagcctcagctcgccgctggtcctgatgagaaggtcggggtacgggaactcgtcggccgcgcagctcgtctcgagctcgtcggcgaacagcgcctcgtcgatgtcctccgccgcgagcgccttgctctgcaccttctgggcaagcttccggcacgcctgcacgatgtccctcctcccgctgtagctgattgccagtgtcagatcaagctgtgaattgttcctcgtggtctcctcggcttctctcgcaatcttctgtagagaaaccggtagccttgagctgtcaccgattacacgtagccgaattccttccctgtggaaaaaaaaaatcctcattttgttgtccacatcaccacatgacatgtacacattagactttggcaggaaattatactggctcctgtgaaaattgaatctttttcctatgaatcttgcaagaaattcctattacaagctggtaattgagttgctggtacgcccggagcactgtgggctttgagcatctattggcgaacttccagttccacaaagccaagtgttgtgaacgcgtgaggcattaactaattatttaatttgcaagtacggatgtttacctcagaaactcggcgacgctatcgtggatcacccgctcgaacagcctcatcaagaagtccacctccacctgcgaattccaacatggcgaggacgcgtcaagctcggcgaaggcagagatttcgaaggaatcggcggcgaggcgtgtgtaccttggggcggctccagttctcgttggagaaggcgaaggcagtgagcgcgcggatgccccaggcgcgggagagacgcaccgtctcctccagcgcgcgccgcccggcctcgtgcccggccgccgacgggagcccccgcgcccgcgcccaccgcgcgttcccgtccatcaccaccgccacgtgccggggcagcgactccgcccgaaggcatccagggaggagagactcggccgccggggctgcgccggcgcgcgggcatgggcatggtggtggcggcgcggggcgcgtgctgcggcgaggggaggtgggtagctgatgggtagcagctggagagtgggagggcagcatggtgttggcggcttggcgcattgcccccaaactccgacaaaaggatgaaaagctctgcatttattaaccttttagaattgtttttttcttttttttatgatgttgtgatttcctggggaattctaaacaaattgcaagaaattgatttacaagaatactacgggacgatatctcgttcgaacggtatcgtgaccttagggtacggacaaatttggggatagacggggaagtatagtttcccgcctatcctgagagtgagctcaaaagcaaagtgagtgaaaagtatttttctctattgaacttgtccctgcttacaggatctaggtcggcttaaatgactctcaaccatacacttgagattacaagtttgcccctgagggcctacatattatcatactacccttataaagtttacaatcctaagagcattttactatattttagtggtcttcaagtaacatccagtgagagtagttggagtgatccctgttaccttcttgagacatgttcttttgtagttggagtgatccccagttaccttcttgagacatgttcttttgtagttggagtgatcccctgttaccttcttgagacatgttcttttgctcaatgatactttcccttgacttcaatcatccgggtagagtaatgtctctctcgtgagggcttgaatacatttttcccatcttctggcttctcacctgctaagtgaagagaattgtccaaacacgttgtgttgttagtaatataccccatcagtccaaaaatataacaacctttaacactcagtatttgttccaaaatataacattttttttcaccaacattctcttcccaacaattcacaaccctccatcgttcacttttcctaactacctccacttcttaaccaatcacaacctttccctatttaattctaaagaaaacccctgtgtacccctgaaagttcacctaatcccttctataccctgaattttgctcaatcccttacatacccctaaattttagtatggatcccttccatgccctttccgctagttgaccgttaaattcttatgaaaaagtccattttgccatttggtataaagaagtatataaattaatagagtatattgttggagcatagaaatttattatatgagactattatgtttatgagatagttatgcaccatattatttgcgataaatatacttttagatatgacataaaaaattaatacttatttatttttttagcatatgtgttctgatagtaataaacaaatctgttgtattactatgaaaacacatgctacataaaagaacttttaataactaataaataagtattaaatttttatatcatatgtaaaagtaaatttgtcacaaataatatggtgcatcacagactcataaatataatagtctcatccaataaatttttacattccaacaatatacttcattaatttattatgtttcttcgtagcaaagggcaaaatggactttttttcaaaagaatttaacggttaactaacggtcaactagcggaaaaggcatggaagggatccaaactaaaattcagaggtatgtaagggattgagcaaaattcagggatatagaatggattaggtaaactttcatagatacataagggattttctcttaattctatctactttcttaataactgtgtctaactctaaaacttcttatattctgagatggagggaatactgatttgagcaagtgaaactactcaaacgcactttccttggaataaacatttcttgggcaaatgcaaatgatcgatcaagggttgttacaggtcaaaacttcattcgagcagattgcatggctcaaatacgatttccttattgtgtgtgtttttgccgaacatagggatggcgttcaccccctactacaacaaatgggatgatactagttaggtataaggtcctgatatccctaaggtattagataatacttgagatctgataactataaggtattatacctgatacccaaccggtttcatcccgttcgaacgggatttcgtcgtacaacaacccctttatattcctttgtgaaggtgtcaataaaactgaaaccattgacacgtaggcctttttcctcttttcaagaaagaaagctctgtagtttaataaaaattgaaaagagtaaattgtattggtggtacacaaacttattaggtgggtgcaatttagtacgtaaacttgtaaaatgcttatttcagtacacgaacttgtctagttcgtgcgaacgaggaccaaaataacttagcaatgttaatttatgatgttcattaggatgtgacgtgcatacgtatagtgagtatgcataagacacgtaatatttataaatttcgtcttaactttatccttcagaatggaaataacgaatctcatatgtttctaacccttatattagtgctaagttttttaatctttctgatttttattgaatagatatgtctaatggcaaccttcttagatatatgtttacatagtatcctaatcaacccctaaattaataagattaaccatgtagtgtacttttcggttttctccgcacgcacctagacaaattcatgcaccaaaatgagcattttacaagttcgtgcactagattgcacccatctgacaagttcgtgtaccggcgatgcaatttactcaattgaaaaccattgacgtatataaaacgctgaatagtgtatatcctgcattcttgctctgaacgttgccttggctttttgctccatttctgagaatacggacgggcagttaaaggggcgttcctagtatgtgcgtacgccgacgcggtagcctaactaactctgttagttaaggataatgatggtaattaacaatagattttttattttattaggagattctttttcctaatagattgaaaaattttaagttacatttgaaaacttttgacttaagatttaaactttaaactcaaattttgaaaactttcaactcgaactttgaaagttttcaatttgcaagaaaattttttaaaactttcaactcgagatttgaaaacttttaactcaaatttaaaaactttcaactcgagatttgaaaactttcagctcaaaatttgaaaactttcaactcgtatttgaaaactttcaactcgaatttgaaaactttcaactcgagatttgaaattttttaaattaagatttaaaaatttttaagtcaagatttaaaaactttttaaaaaataaaaacacttgctgctagaagattaaaaagtaatcaggaaaaaaagaaaaaaaaaggaaagcgaaaaaaatcagggaagaaaaaaaagtggaaaaaaaaaagagaaaacagcggtggttagatttcgcgggcgcacgccgagtgggccgtatggaaaaaaaaagagaaaacagccgggagtgcgcgctgccggcgcgcgcgaattaggtttctcgcagttaaagcacgtactgtgtgtgtatcgctagacagatgcagaacggctgaagagcagtctgtctcatgccaatgtgcaaacctgcacatatggtcgcacgcataatgaaacgcaaactgcgcatgtggttgcttactgagaaaccagaaacgggagaatactgtgaatacctatagctgatcgaatattctgccctccccacgggccaccggacaaaagaaaaccccgctgaaactgtatttagtcaaagtaaaagtcacgcatggcacgcctgataaatcatgaagttgttaggacatgcttttcaaacttttgcaaacctgattacaggggatcaaccaatacaagaaataaacaaagtcaaacaatcaattatcagccatactgataggagacgaagaactgcaagtctacaacagctgacccacatcacaagaaaatacaaaatgagaggggctccagtagaattcgtcagaaatgttagattgctaagaggagctaatggcctttaatttgatatttgtgtcatctgtcaccggcatgctaggagtacaagtttgttatgtgcatcagactgtacagagaaattcgtgagaccttatcttcctaataaagaggactcatacattgtcaacctgtccctgcaagttactagaagatgtcaatgttttaaatgtgactaccctgattttccatacttccatgtgcaagccttccatactaactactcgagaagctgtcgcatgtgtctgtttgggaaccaatagtgaacgggtggactaaattccatacacgattgacaactccatctgacataaaggaaaacgcatcttttgcggctctttgacatgcttccagagctctagaatcaccaagcagttgttttagtgcttccaaaagttcatattctcctttgacctgaaaaacatttgcattaatcctcatagaatgaaaggggctgtagctccttgcgatgtttaggtgtaaaaaaaaaaagaatcacccatccagtaaagcagcatacccccattgcaagcataatttattgaaagagcaagtagaaggcaattcatcctgttactgtccagactatttccagaagtagggacaaggccaagtcaataattaacaaaatacctcccctaagaaggccacgaaatagtagtaatcccactcttaatcgaacatagtgcacaaatgatgcggcattttttgtgtcagttagataaataacaaagtacaagacagattatcacctgcttgacagctaaaggatttatttgccacatttcgaccagcatatgatagaagtgcccaacactaggacctgaaagacaattaatgaaactctagacattccgattttgtagaaaaagtcattcaaaatagtcagatgtgtcttgcactcttgcgtaccagtcataacagcgcaaccaactgcagcagcctcagaaatattatgtccagctaagccgggcaaaaaagaacccccaataacagctattggagtaaccctgtagagcattcttaattcacctattttccatggtatttcattcattaactaacattcaaaagaatatacacagtccatactccatactgaaaaaatgtgcaaacttaaggcataagagatagcacaaacctaacgtatcaaccacatatatactggtgtttgaagacaccacttctcttgttgacctcagcacaaaattcactttctgtttcttcagggtctaaaagaagatgagtaaagaactaaagatgtggcccatacatattatactatcagcattgaagtgagaatcatatgctacatgctctagaaccataagaaatttcaagtaatcgtatacaaacagttataagcaattaatttcaagcttcatacagtgaactaagttagttccctttttttcattacaacaatgctacacctatagattacccaatatgataatgtattaaaaaaaactaaaagataagcagtacaacccaccaactacttcatcaactaaacaggaccagatataaaagggtaaggaagacaattgacatacttgagaaacattcttgctgtcctcaggatgccttgggacgagaattaaaagtagagtaggatacgccctggttaactcatcatgaacacggagaatgactgaaaaagagaggaagcttgtcaacattgtttttatgttgagaacataagcatagtaaggcaaggattcaattattcaggaaagcataaagaagtcagcaatgactttagggatatcaatggtgatcatcaccataggcaaaacagctacatatatacagttttagtcctgcacacagttccttggaagagcagataatactgatccaataaaaagaaaaggtgggtgtctgaggtgcttactttcatcttcccctttgtggatagaagctgccatccagatgggcctattgctgaactgctgctgaagatcttctattgcagctacctctttctccccagcagcaatgtcaccaacagctaggtaaatcacatgaatctctataaattattgagtttgtgaacctggttatctttcaagctcccaagataatccttgagaaatgcatcactcatatgtttatttcaaacatactctcatgaacataggaagccagagaaaaattggcatggcgcataccgtattttaaatcgccagcaaaatggatgatctgtggtggtgcatgaagtaattgaaaacgaacagcttgaatagtactctggaacagatagaaatgaatacaatggcaataattttacatcaaaataaggtttagaaccccaccactccataccaatgggataacaagtgatagtttggagagcatcaaagagactaactgcaaccctagaggcaaggaccaacggttgaaagacttcaatgacatgcgcgcatttaaaagaaccactgcaatctgaaaaataggaaggtcattcacagcagataattaaatagtgaaagaatgtactatggaccgaaaatatagctaatctgccattgcacatggaaaaaacaagggtaacaaagggaagcctaaccacttagtagaaaatagtcattatgagaaaaaaaaaacttacccctttctctgctgcagacaaaatgaggtttggccagagttcactttccataagaagtatcaaatttggtttccagtatccaatgaaactttctattgcatcaggacagtcaaggggtgcaaactacacacatatgtatttcagttatgtaaaacaacaataagctaccgtagatgtatatagggcatatcaaacatttaaactatccttctgttagcctattcgtgattcccttcatctaaacaagttccatctgttcccaaaactttgcttgatctgtgtctgtactatcgaatattaccaccttaaaggtttaatattacgaaaccttactatcatagttcaacgagtataatatgaccttagtttaagggatacatataatgaacagacaatatctatctgccttgacacagttcgaacctaaaatgtccttttttttcaagaacagtccatcagtaaaaatttgttgtgcatacgccatttctcagaaaactaaaccggccgtcacgacagggatctgaaagtacaagagcaatttccgagctcacctgatatatgacaccatccgggagcaagtctttcatcacttcgctgcattgaaatcaaaacaaccgaaatagaatatggccacattacacggaaatgagagagccaggcaactcgtatttgcggtaatgggggaagcttacaaggatgagagggtagtagtggtgaggaggatggggagaccagggtggaggcgggcgcagtggcgtacgaccgggagcgcggccatcccctcgccgagggatacggcgtggaaccacacgagcggcgagcccggacgaggccgcgccaccgacggcctgcccagccgctcgggccaacgcgacgggtgctccagtcctcgtagccgccgccatagaagcgccgccggcgccgccgcgcggctcgccgccctgtacagctcgtacagcgcccggccgccgcgcgccgccgacgccggcgtgcgggccgtccgcatcgagcctggcccgtccaacgactcacggcctgggtcgctttgggcttttgttagcggcgcgtgaggtcgcgtgctttcagtaccgagcccaacttacctctcgtttatacgccttcgatataagaaagcgtctccggtgttgagtctctccgtattcatagacagaacacacatttctgagcgaaactcaggctatatttctgcctcgattgatttatgcttatgcatataagataaaaattaaagtttaaaactcaattttggcgttgattttgttattttctcgttgtagtttattttacagtatttttttttaaatcactaaagacatgctataaattatttttagttgctaataaatgattaataaatataatataaacataagtgggaagatgacttcttttaaaaaaaagaaaaataaaaggaaaaaaaatcttcttcctgcattgatgttcctttgtcaagagttaaagcataataacatcacacgttcgcgaacagtttatagctattggcgtccagaatgatctgccggaccgcggcgactgacgcgacgacagcgagcgcggagaacacgacggcgatggtggtgttgagccagaacacggcgcccttcttggacggcttgaacgtcacgttgtagaacaccgccggcacagcgaagtcgagcgggaggaagccgaatgcgccgatgagcgcgttcatgtcgccgaagaagggcaccatggccgcgatggtggtgcccagcgcgacggcggcggtgcgggagagcacccgcggcgcgacgttcctcgcggcgtactgcccggccttggggtcggacaggaggccctccaggacctcgttggtcggctgcaggtacaccacggccaccgccgacagctgcagcagcgtgaagagctcgatgatgagcagcagccactccgggatgacggccctgccgcccaccatgaagttgctcaggagcgtgccctgcgactggttgccgaacgcccagtaccccgagatggccacgctgaagaacgtcgtcaccaccacggcgtagcacaggcacagccccttgaacatcttccccgtcaccggcgccgccaccgtcgcctgtatctcggggatgattccattgccgtacgtcgtggcgatgacggcgatggcgttgaacacgccgaacacgcggtcacgggtgttggcgccggcgatcgagtagtccttctcgggcgctccctttgagcttcctgcacaaaattcgtcagtccaattttaatccgtcgcgtcgacaggccaaattaaagcccaatagctaatctaaataatgggccgggtcgccgggaaacctaccaaggtagatgcaggcggcgacggcgcagaagctgtaggcgaggcacagcacgagggagatgaggttaacgtggcggagagagtggaacgacggcatctgcgccaggatcatcatgaagacgccgaagattgccacgaacacgtacagcttgatcgtgccgcccgggttggcaatcaggtagatagcctgcaacgcgatcgagtaagaaatgtggattcataccatgtgcaattgatgaacgcgatccgatccgatccgacacgaaatcagttcgtggactaagttctgatgaagataccttcatgctctgaccggctaggagagtgcacgcgacgactgccccgaagcagaccaggaactggatcggcccgatgtagaagcgtccccatccaggccctgcatgcatcaccgtggaaaaattaaccatgaatctcatctcagtgacagtgattttgtcgcggtgatgaagatgaatatccctttcgaaacattttttgtcagatgcgtgtgtaattaaactgtatgaatctgctgccagatggcactaaggacgattcctttttcccaacacgtacgttaaacctgtgcttatctgtccaatgtcgtatcagctaggatgctagtatatgactgattctactacacctggtacagtgctactccctccgtcccaatatataagaatctagaaccgatgggacattttctactactgtcctgtccagattcgtagtactaggaaatgtccaatccagttctaggttgttacatattgggacggagggtccagttctaggttgttacatattgggacggagggagtatttaagattgacatattgacaagaaacggcgcgcggtgctggtttttttccttcgcaagcagtatcaatcgatttagacaggcaatcaagtggaaagctggaatattaaattccacagcaaatacttgccgacaaattcgtcaaactcgaccaattgcatgatctgtagtactaatgtgggaatactatccctttcgaccaatcaagtttttctctatatatccgccaagcgctaactggagttttaattagtattatctaaccagtggggattctttccctcgtcgactcttgacagtgacaaaatacgagccctagcagctggacttttctaacctgtactgtaccgtgttacgattttattgaatgctgcttagtcagttactgaaatcaagcaacatgtcggcttcagacgctgcactcactccggttgaagagtttaccggtccgatatagtatggccatacccattgctcatgaatgctgcagacacgtacatgtcgcaaactcgcaaatgcgaaatgggacttgatttggccaaataatacagctgacttgttccgcacaagaaaagggggcgggcagctgactttcttgtgaataaaacaggacatcaatgatcagtcgctaaacctgtcacgtctacaagttggtgttccttcctcccttcctttcttttctgaaagaacactgcacttggcgtttctgcccctatattcaaggtgacgacataggtgttgatgtattgactcatcctcatgtctcgtttgaacgcaagaatatcacaaactatgtaaatgcttcgaaagaaatggtccattacagaaaaataaatcccgtgttataatcagaggttgttttctccaaattctcaattcgggcctttaggagccagggctaagtgaagacatgggcgagagaatcttacctgcctcgtgatggatactagtacccactactgacttgtacagttgtactgtattcgtttttttgggtgaaggctgaatgccacgtccgtccattgtgaacgcccttactattgtattgtaatgcttttggtattgcacgtagtatgagtttgcgagacagttgtcagccaatgcaattttatatgcagattctcctccatctaccaattagcttggagttgctacgtgccttccttttaatcacttatgtactcgagtttaatgagtatattagcatcaacctactacattatttccattttaatgggaacctaactagtaaatagtaatagggtgtgttcagtacctattcttgctatagcggttacggctgtagcagtactaaaaatggctgtagtttacagcagcgtttaggctgtgtttagttcagtgtaaagtttagattttggttgaaattgaaaatgatgtggctgaaaagttgtgtgtgtatgacaggttgatgtgatggagaaggactgaagtttggattcaaactttgaatctaaacacagtcttaattgtggctgaagcaacaatccctgtcgatcaatctcattgtttaactgtaattacggatagataggtatacgagtgattactgacctaaaatatcggtggccatgtccctgaagcggagctggcggcgtccttgctgcgcgtggtgctcgaggacgagggagatgaggttgtacgagtagaaggtcacggcggcgccgatgacgaggcagatgagccccgccgcccaccccagcgacgcgaacgcgaacggcaggctcagcagcggtggcgccacgatggacgtcgtcaggtggtacccgcagtgcagccatgaccctgcgcatttatacagcagcagcatgatcagtttttttctgttaaactagctaaaggtactgtgcattgcggcgaatatcataagagataaatataaaaataaaaattacaaacctactaacgtagttagttaattaggcatattatgtcatatcaagtgcaaaaatactcacatttgaggatcttatggtctaatatgttaacttatggtgatggggaaaactcagacaccctcactaatatcattcaaagtagtatatcatagatatagaaaaagaataacattactcctgctagtagttagctaatctgttaatcctactggtattttttctgtttgtattagtcgctggatgatgataagctgattgggagaggcttccgcagctccactcggtcaaaagttgtaggagatgaaggattggcaaaagaaagttcacaggttagctaaacgcttggaagttggaatatggcgagtaaacacgtttctatcagtcgtttcaaaaaaaaaaaacacgttgccatcggaagaaaccccatccctccatcaaacattgatcaatcctgcacaatgcccatacctactttccaaagctgtatgtcttacacatgtagtactcctcagtcactaaacttgctttgacaatcgaaagataaaaataaaagaaattttgcagtcattaaaaaaaagtacatcgagatacctaaattttacattaaaatttttggtacttctagatacatttttaaggatggtaaaattatcctaaaataaagttgttgatactagtatgtttcaggggtcagcaaatcaacagggaactatgaggcattgggggcagtgagcaatttgattttgttaagcctgcagtctcacacctaattcgattttcctttttccaaaatagaccaaatatgatttgattagtacattactcctaccatattcctcactccattccaaaataatcactacgatgagtttccgtgtacaattttaattgtccgtcttatttatttttttaaaaaaaaataaaaaaaatataagtcacgcacaaagtactattcatattttataagctaatagcaataaaaatactaattaaatttttttaataagacagacgattaaaattaaaaaaaaacttataactgcgcttattttgaaacggagagagttctagctaaccaacctcccgatgccatttataatttcctcgagtcaagagtatctgcgctagtgcgcatgataatcaacgagatggtgacctgtaccagttctcctatacgatacagacatcacgctaaagactgaacgattcatgcctaatttatttttttggaataaaaataacaatacatcgttattatacttttatagttcacttaggtccatatattaatatattttctgtctgcttcaacaagaccaaatagacgtgtaaccatttcatggagcccgaaaggttgactaatacgagtactgtatcgtgatatgggggatcggctgagctagcagcctagcagaacaataatatgaattgcccatgtttacaactttacatgcattgctattgataataggcttgatagccagggagcccatcatccctgaagtacattttctcttgtctcttctctgaatgttgaaaaagaatagatgtaggcgtgcaggcaacggatgtaggggaacggaaaaaagcgagcaaagaaagaagagagtttttgttactacatccaatcttcatagggtaaaactgtgaaaaagtagtgcaaaaggatagatgggcagggaccattcaaacatctacatctgtccaagaacttttaatcagagttcaggagacgcacccagtcattcaagtagaacagtaacgcagtacccctcacaatggctgccgggtacatgcgctgaggaaaattaaccgaaacaatttgtaaaccatcatttttttcccgttatcttggtagtttgtacagtttttgggtacgattattaacatgagccaaatcatttacatacggatcatatcaatcgggatggcatagccaaatcctgcacaacaacacttcatcaaaccatcttgatatagcagccagaacaatctattaactcgtacatgttagttggctagttgctactgattagttagccagctcttttgcttattaatagctggggacaatccatcaacagtctagaatatacggcctccgatgctcccagaacacaaacaggttacgcttatatgtgcagctagccaaacatgcttgctgcctgacatgcgccaaagaggaatcaagaaagaaataacgaaagaaagaaagaatagtgggtgatcagaagcgagtaagcgagaaacaagagagctcatgtcagacacgaacgcacctttggactgaaggacgaagagagccccggcgtcgagcttctggccgacggtgtcgccgccggcctccatcttcttcgcctcctcatcctccctgctcggcgcccccatgacgcctctgccgtcgaacgattcggtcgctagctcttttgtcttgcaggtaaaaccaagggagcgccaaactacgggttgatggcctgaaactcttgggggactcggacgatacgatctacagttctacacggccgtacgttgtttgtctctgcctctgcgcggtgtttctcagcaggtgagcgggctctggttttgccttttgcgcttctactgctgaagctgaactgcgtactccatatatagagaagaagaagcaagcgcgctcgcggaccgggtggacaccgtatgacgcgcgggcgaaagggacagtgcggcctgtgcgcacgcggcacgtcgcgcgtgccacggcgggagaatctcccgcgcgctcgctcccgcgaccaggccgggcagtcggcagagaatcgctaatacgttaagatcacgaaaaaagtcatactttggaaaccaaaaataaaaagaaaatccgtcgagaacccaaacgaggaaaatttttattgtacattgtaatgcaagtatgagaaagtccatctagtactactaggattttaagccaaaggccgtccagtatcgtaaacataaaaaattgtcaacggactcaaaacttcacaattttattcgtgtacaacctttttgacaggcatggatcctctgcattacggcaacagagaagagctagtgctacacacactaatttgtgcctgctacattctttggtagccttggcttcgcccactggccactaccctctccttgccaatgtcacgtggccaccgaaaaatagaaaacatgtcagggaggggataagtacatactccgtggctccgtcccacagtgtaggaacctctaagacctattctagaactacaaatatggacatgagttttatcataggttgctatattgtgggacagaggaagtactacatatttaggtatgcataatgcatgtactagtagatcctattgtgtatgtgtaagttgtagtgctaaaaaaccttggatttttttatggtataaacaaagccattgtaaatctcattttgcattagcataaatgctactccctccgtttcaggttataatatgttttgactttgatcaaaatcaaactacttcaaatttgactaaatttatagacaaatatagtaatatttataatactaaattagttttattaaattaataattaaatatatttttataataaatttattttgggtcgaaaatattactattttttctataaacttgtttaaatttgaagcagtttgactttgaccaaagtcaaaacatcttataacctgaaacggagggagtaatatttgtctttcctagccatgttgaagaccggcagtttaggccggttagctgtatatagcataggtgcagcagagctgcgagctataagaggctgttcaattggtggagcattgcggtggtgacgataagtgcgaagagggtgttgtaggcgaaaacctagcctgaggtttctctgagccatcaacgccgatgcctacggacattattatcctctcttagagcattgttaagccatcatcgacacctttccactcattaacatcattcttcatgtcaaaacccagtccgaatggatgggcggtggtggcgtctaagatgtcatgatctctttggtggtgttgtttgggaagtttttttcctcgctttaccgtcttttcttagctttttcttggcaaatttttggttgacgtcatctggttaatgtgagggacgagcggatcttcttctctctcgccctcttcctcaaccactctacatgaggatgattaggaactcatcgatgatttgtctgagtaggatcttgcaggtctagcagcgatcggtcaaacttagcggcggtcggtttgttcctagtgtcttctccttagttgtgtagggagctgttagcacgtggtggttgtgttttgtttttttttcattggtcacaattttttcgtcatgtaactttgtaatttttctatgccatatcataagaaatttcacgttgtcttgtgcgggatcgttaaaaaaaaatcctcgtggctgctaggagtcacttattatcatcgaaaggcggttgatgtcaattatcgttttctaatcatgaaaatgacgttgtttccctatttaatgttacaaaatttaaaataaaatacaaaaaataaattcagttaattaaacttttgattttgattacattattttttgtttacactgtgaacagtactttatatttcatattgctttcagtttataattttcaaaataatttcaacgttttgaattgcaacagattctcacagtaaaagatggcattaaaatatactccagttttctttgtttcgattacaaactccaaatatactttctacacgattatttactttgaactatcggttccatgtataacgatcatagtattttgattaatagtctgcatacatttagaagacaatatacataattaacttagaaaaagtaaatagatttatttataatacgacacaactatatccctttgaaaataaatcaacaaaaattagttgctgaattttgccatatctctatctctgcaaagatgctcatccaataagccagatcgaactgttcctagcctctcatctcatcgtctgtttgttggtttgtttcaatcgcaaccaaatttgagttccgaagtttaattttagagttgatcttttttctttcgtaagtttatttaaactgctaaaaataccgttatttttttttaaaaaataacatttttagttcatttattcgtttacgacttagccgaaactcaactaatcaaaggataacatacaaaacggttaaaaaaattccttcggattatcgtgtggtttgcaaggtgtcgaagtcgacggatcgagcggcgagaccgcgagatggacacggattaaatggtgcgcgcatgtagcgcggccgagaggcttgcacgagtccgtggcccatgaggccttgacgtacgagtggcttatatgctcgccaacttggccaccatatatagcacagaagtgctcgtagagctcagagtactcgttttccttaccgactgatgcacctaactaatccgccgattggtgtctcgttctcatctctactagtgctgtgaccgtgcacgtcggtcgtcggagggcgggcgccttcatatcgatcgtgatcctgacgggacgtcattcccgggggtcagtactgttcgttttcagaggagcaacagagtacttcctccatcccataaaaaataatctaatagtatgaaatatgacacacagagcctgcttaggccttgtttagttcgcgaaaaaaaaaatttaggtatcacatcggacgttcgaccggatgtcggaaggggtttttgacacgaataaaaaaactaatttcataactcatctggaaaccgcgagacgaatttattaagcttaattaatctggcattagtatatatgggttactgtagcgcttatggctaatcatggactaattaggctcaaaagattcgtctcgcgattttcacgcaaattatgtaattagttttttattttatctatatttaatactacatgcatgttgtcagggttatggataccgcatacctaatagtagtcgactaaatctcggcaggacccaccaaatatcatgtcttatacggaaacaacctccggatatagaaggagtttcgtataaggaaggatgaatagaattctacatgtaaacgacatgtactactcggattgtatccatattggttttcttagttctatttggacaaggggacacctatgggtataaatacaaggccccctagaaggacaggggacacgaaacaatagatcaagacacaagatcaacatacaagccaacacgcctccaaatatcaacatcaaaaattagcttagacaaaccctatctggtacctgcgggggccggcaagaggggtcaagcactatctctgatctcgacgagttcgtgctcgaggaagaagactaccctgtcatcgactacgagttagttatctagccgtcaagtcgacgacagccagatatgttatcccacatgttgtatttgtgttatccagatgaataaagagcaacaccggtttcggccaataggatgtagggttattacctgacaattcaggggcccgaacctgtataaaaatcctcacatccgtctcttttacctaagtctcgcatatatcctagtaccaacgatccccatactatgcaaataccggaatcgcgacatcaagcgtcgacacatgtgtacaaagattcaaattgacgtttttgggaaaaaaaatttaggaactaaacacggccttaggctctgtttagggtctgtttagttcgtgaaaagaaaatttttaagtgtcacatcagatgtttgaccggatgttggaaggggttttcggacacgaatgaaaaaactaatttcataactcgcctggaaaccgcgatacgaatcgtttgagcctagttaatctgtcattagcacgtgtaagttactgtagcacttatgactaatcatggactaattaggctcaaaatatttgcctcgtgatttcctcccaactgtgcaatttgttttttaatctatatataatgctccaagcatgtgtccaaagattcgatgtgatgtttttgggaaaaaaattttggggaactaaaccaggccttagtttccatgcaaaaacttttcactttcacatcgaatgtttggacacatgcatggagtattaaatatagacaaagaaaaaactaattacacagattatgtgtaaattgcgagacgaatcttttaagcctatttgcgccatgatttgacaatgtagtgctgcagtaaacatttgctaatgatgaattaatttggctcaataaattcatctcgcggtttacatgcggaatctgtaatttattttgttattagattacgtttaatacttcagtgtgtgtctgtgtatccgatgtgacacgccaaaacttttcacccctggaactaaactaggccttagttctcaaacaaagttttttacgctgtcacatcgaatgtttggacacatatatagagtattaaatgtagaaaaaaaaaccaattacataattcgccagaaaattacgagcctccaatctcattcctagcgtgtgttagggacgcgcacgcatgtgtgtcgtggtgtgagtgcagtgtgtgttagtgtgcgtcctgagttgttcccttcttaaaaaaaagaaaattacgagatgaatcttttaagcctaattgcaccatgatttgacaatgtggtgctacagtaatcatttgctaatgatggattaattatgcttaataaattcgtctcacagtttcatggcggaatctgtaatttgttttgttactaaactatgtttaatatttcaaatgtgtgttcgtatatccgatgcaacatgcaggggcaaattttttttgccaactaaataggctctattggggagatactgtactctctccgtccaagaaaaaacccaacctagaagaagatgtgatcccgtccagatttattgtactaggtgggatggagggagtatgcacgtagtactataatattagtattagaatgtgttgtattcagttctaatatttattttttatgggacgaagagagtacaacaacatatatgtacggtgcacagctacggccatgtatatggatgcaattaatacgtcggaatcagaaggccataggttgtaaaaaaaaaaaaacgaagcggcacaaaacaatatatggttaaactttatatatatgtctcattaatagtttgatgccaatacttaaaaatatacaaatagaaaaatagaaatcaacttttaggtttcgaaatttaaattttggatgtagctaattaagctactctatccggtttgataatactctacttgttattttggacaaaactcatatcaaactttaaaatctttaactatagataataaattctaatggagatcatacaatatagattagtcttacaaaatactttaacaaaatcatatatttattgatgttttatatatattattaaagcctaacgattaaagttgttttagatcacgtttttatcccaaacgataaatactatcacggaagtactctctccataaaaaaaaactaaacttaggaggagacgtgacatctttacaatgaatctggacaaccctttatccagattcgttctactagaaaacattacatacttgtatagtttaagtttttttttaaggatggagggagtatggttgctttttctttttttttttaggggggcggggtttgatcgggctgtcaatctgtcaccacctactatggcgcaacagcagttgagaagttgagaattgttcagatgaagcgagtatcacgagtatcggggtttgtgatgcttactacttatataatataaaactgtatttttgggtagcagacagataataaactctttagaaaaacaacacctgaattaattattgcagctgaagatgacagcatatctgagccaactcgctgattaattagaactcaggatccaaccaaggaaaggattattaatccagaatacatgaatgcaatcgcagaaactgcgatgcagtcactcattggcaagtggcaactgggcatatcattgtatatttgaagtttcatatgataagtttttttttaaaaaaaggggaaaacagtaatagattgtgccttttcattaaatatagggagaatagctaatttagtccctaaagtttctctgtaggatcagtttagtccttaaccttttaaatggtccaaagaaatccttaaactttgtcataaggtctagaatagtccttgggtccaccaaaatcattatataaatatgccatgtcatcattgatgcaaaatctatgatgaattgtccaatttacctttatgtatatcatagaaaaataaatataagggtgaattagacataaccatgggaaaaaatacttatcctttttttcacccttttgaggtatatttttgctcttacattttactttttgttttttatttttctatgatatatgtaagggtaaattggacaaatcatatagattttgcatggaaatgtgacatggcatatctatgtggcgattttggtaagatcaaggactatgtcaacccacgtgacaaaattaaaggatttgtttagacagtatgaaagattaaagactaaaatgtcccaggagcgaaattttaggaaccatattagctattctcccttaaatatagcagaagaaaaaacagcacaagtttcatatgataagttgatagcgctgtagttgctgacttcgtnnnnnnnnnnnnnnnnnnnnnnnnnnnnnnnnnnnnnnn

SEQ ID NO: 11743 - DNA, 774 bp, Oryza sativa
  unsure (1)..(774): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgttcgccttgggaacgacgaccgggttcgccagccactccggatggatgacctcacggatgaatccggcctccagaagtcgcgccacctcctcgcggatgaaggcttgacgttccggggcctgccgccgcactttctgtcggaccggccttgcgcccggccgcacggcgagacggtgctcaatcacctccctggggaccccgggcatgtcagaggtcacatcgaagtccacccgctccgtgcggaagttggcggaaccaccgaaggtgaacgggaggtcgatatgacccaacggccaggtgtgccccggaaaacccaaaatttgcgagtaccaatgatagtacattccccttgtcggtgacatggggccgggggtatcgtgactagaggcttgggtagccgcggtcacccacgtggcctgacccc

SEQ ID NO: 11744 - DNA, 4584 bp, Oryza sativa
ccacctaaccgcatttatagcaggttggacaagcgcgccacgccgcatttaatgcggcgcagcacacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggtagctggaggcccttgtggtgacccctgaccagataaaaaggaggcccaggcctaggagaggagaaaaaagagaaaggggttgggactctggcgaatgggttctagagcctgaactctctctggctctccggctctctgtattccttcactcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcctggtgaggagccccacgctccgtcacccctagaagggatataagggcaactaaaatatgcccagaagttaaccttagaattgaggaagttgacttcctagccaaaccgatagtcctagactcgcaaagcttggacatcatcctagggatggattggttggctaagcacaaaggacagatagattgtgccgaaaggtctatcaccttgcaaggacctggaggaaagcaagtctgctttacccctaacacccttatcgcaagtcggtctatcctaaccagtttgcaagccactcctttggaatcggtgcccatagtctgtgaatatcacgacatatttccagaagagttatcgagtatgccaccagaccgagagatcaagttctccatagaattagcaccaggtaccgcaccgattgcgaaaagaccctaccgaatggcagctaacgagttagcagaagtcaaaaggcagatcgaagaactggagagtaaaggttatgtgcgacctagctcatccccttggggagccccagtgctcctggttaagaaaaaggatggctctgagagaatggtaattgactatagagccctgaatgaagtaactataaagaacaagtacccgttgccacggattgacgatctgttcgatcaacttgaaggagcaaaagttttctctaaaattgacctaagatcaggttaccaccagttgaaaatcagatctgaagatatcccgaggaccgctttctcaacgcgctatggtctgtatgagttcacagtgatgtctttcggactcaccaatgctctagcattcttcatgaacctgatgaacaaaatcttcatggaatacctggaccagtttgttgtggtattcatcgatgacatcctgatatactccaagaatgaggaagaacatgttgaacacctgaggctgataatggaaaagctcagggatcatcaactattcgctaagttctcgaaatgcgaattttggttggaccgagtagcatttcttggacacgtgatctcctccaacggtgtcgaagtagaccccagcaagtttgaagccgtacttgcttggaatccgcccaagaatgtgtcagagatccgcagtttccttggcctagctggatattatcgaagattcatcgaagggttctctaagctagccagacctatgaccgagttgttaaaaaaggaaaagaagttggaatggtcaacaacctgtgaagatagctttcaagaaatgaagaaaaggttgaccactgccccggttctcaccttgccagatatacgaaaggatttcgaaatcttctgtgatgcatcaaggcaaggcttgggatgtgtcctaatgcaagagcgaaaggttatggcctatgcatccaggcagcttaggcctcatgaagtcaactatcccacccatgatcttgagttggcagccgtggttcatgctcttaagatctggcgacactacctaatcgggaacagatgtgaagtatacaccgatcataagagtcttaagtatatcttcactcacaccgagttaaatatgaggcagagaagatggttggaactaatcaaggattacgatcttggaattcattaccatcccagtaaagctaatgtggtcgctgatacgctaagtcgcaagacctattgcaatgcagttcaagtatggccagaccaagattgtctatgcagagaactagagaagttaaggctgacagtggtacagtcaggcgtccctgctaacctgaccgtgcaacctacactggaatcgcaaatccaagaagctcagaaagatgatgaaggtataaaagagttaataaaaagaatacacgagaagaaagacaccagtttcaccatagatgaccaaggcatagtgtggtacggatcacgcatctgtgtaccagccaagaaagaattaaaagatatcattttaaaagaagcccatgagtccgcctactccattcatccaggaagtacaaaaatgtaccaggacattaagggatatttctggtgggctggaatgaagcgagatgtcacggaatatgtggctctgtgtgatatttgccaaagagttaaagcaaagcatcaaaggccagctaccgatccccgaatggaaatgggaagagatcggaatggatttcatcaccggtttgccaagaacccctagcgggtacgactccatctgggtaatcgtggatcgactcacgaaatcggctcatttcgtgccagtgaaaactacctttgatggaaataaactggcagaactctacatgacccatgtcgtatgtagatttggttgtcccaagaagattgtgtcagatcgaggcacttagttcacctcaaggttctggaagcagttgcatgaagctctcggaaccgatttaaattttagtatagcttaccatccgcagaccgatggtcagacagaaagagtaaatcagatcctagaagacatgcttcgtgcgtgtgccctggatttcgaaggcacttgggatcgttgtttgccgtatgccgagttctcctacaacaatagttatcaggccagcattcagatgtcgctgaatgaggcaatgttcggaagaaagtgctgcacccccttgtgctggaatgaggtcggggaagcactagtgtttggccccgacatactcaaggcagcagaagagcaagttaagctgatccgagaacatttgaagacagctcagaaccgccagaaaagttacaccgacaatcggagacgtgatctcgagtttgaaaaaggagatcatgtgtacctgcgggtatcacctctccgtggtatgaggaggtttgggatgtccagcaagttagcaccccgctacatcggcccctacctcataaccgccagacgtggcgaagtggcttatcagcttgagttacctgaaggtctcgcagatgtgcacaacgtgtttcacgtgtctcagttgaagaaatgtcttcgtgttccagaagaacaagttcccctgggcaatatcgagctggaaaagaatctgacctacaaagaaataccgatcagagttcttgaagaggcagaacgtcagactcgacgaaagaccatcaagttctacaaggttcagtggagcaaccattccaaagatgaagcaacctgggaacgataagatcatctccgcgccgagtttccggagctgctcccttaggtgctgaatctcggggtcgagattcttgttaggggggttggtctgtagcgcccgttccgtcgtggcgcctagcgggaaaatttaaattctaaaaaccctaattgcgaaatctgtttctttgcttgttgtcagtctccgtgccaatccctgatctcgaatccccgatctatcgtcaaattcaaatcccgaatccaaatccttcccaaatcaaattcctccgcaaaagtctattttgcttccctcaggttcggtgggccgatttcctctcggcccatctctctcgctctctctctctctccctcagctctcccctcgctttgcccgtgcgccgcgtgcacgtgcgcatgcgcgtgagccgacaccgagccgagctctccctctctctctcgttctcccgctctctctgcccgctccatccccggcaagctccccgcgcgccgttaccttgcgcgcgcggtcgccgccgtcgtcagccgcctgctgcccgtgcctgcgctgtccggcccgcgccctaccgcgctgcgctgcctgcgccgcgccctgcccagcgagccagcgcgcgtccccgagccgcgccgcccgcatccgtccaaaaaccagaggcagcgcctcccgctcccatccctcttcctccccaaaccggcata

SEQ ID NO: 11745 - DNA, 1356 bp, Oryza sativa
agtgtcgcccaaggtcggtttccgaacagacattgctgccctataaacccgagcccctccccaaaccaatcttccccattttcgccctcgccattgccgcgccctgccctgttcgccgtcgccgttcgtcgtcgcgcgtgtcggaggagccggcacgagcgaggacgcgtgacgtggactccgggcgcaccctctccttcctcttccccggcccgaggccagagcgatcacgccccgcgccgtcggccatcgtcactgcgccccttcaccccgcacggtagtgcctcctccccgttccccctcctcgttcctcctcttccccttagctttcggtagaagcttgtaaagcctccccgtagctagctggcgccgccctgactgctgccgccgctcgctgtgtgctcgccgccgtcgccgcccgtgcttcgtagcgcccgcacgtcgccggcctctctcgtagtgtctccgtctaatccgacggtagaaacggacaccggtggccgcgtagatgctctagtccggaggaattgaaccctagtcgcgtcgttgccgttccttcttttctcgcagccggttgccgccgccgcaatccgccgccgtcgaactccctccggcgaatccgagccgttggctcgtctcccctcatctcgtgcaaccacccggtgtgctcgatttcgcctgtatcgccgtggttcgccccgccgttcgcagccgccgtccgccgtccgttccggccggcgccttcttcaaccttccgccggcccgtgtggcagccacgtaggtgccacgtcggcgccagctcggccaagaccgggtcaagccgaccccggtccgccgctcccctctgccccgctcgcgcgcgcggtccaccgcgagccgtgaggctgcgcgtgggcccgccgcatccgcatccaccgcaagccgcgcgcgtgcaccgcgccccgctccaaaccctagcgccgcatcacgtgctcctcgctcacggtgagtcgagccgccaacaagcgggtcccactcgggaccacgcgagatggacccggcccaccggctacctctttcctcccctcccgcacgtgccttgggccgccttctcgggccggccggcccattatgctcggccgagccgcccctttctctcaggccgtgccctagccgcccgagggaagtctgtttcccctccctctttcttttctttttcgaaagggtttaattaaatcctttttcctttagaccaaaaatccaataatcttataaattcaatatcttctcaacagtatgtccgtttgactccgttcaacttccaaaattcctcaaatctcgatatctatttaatggcatgtttagaggtcaataata

SEQ ID NO: 11746 - DNA, 1393 bp, Oryza sativa
cttttaattttattatgtttattttgaattttagttagttttaaattcctatatagactatgtactctacttctaatattccttattttttaattctgaatttctatttttttttcttaattgtatttctatatggactctatactctacttctaacattccttatttttaattccgaatttgtattatttcctaattgtatttctatatggactttatagtatacttctaatattccttatttttaattccgaatttcagttatttcctaattgtatttctatatggactctagtctcctcttctaatattccttattttttaattccgaatttcaactatttctaaattgtatttctatatggactctagtctcctcttctaatattccttattttttaattccgaatttcagctatttctaaattgtatttttatatggactctgccttttctttttctccgattaatgtgagaatttctagaccatgagagcgaatgtggaggcttctttttctattcctttaataatataactagctgggtggcccgcgcaattgcgcggctagcacccaaacaaaatcatatatttttttagtatgattttacttaaaatttattaatagctatctcattgtcttaagactttgaaagactaaaccttatcatccttgtgtttctaattatatattttttaaaagtcacaccagttgctaccccttatatcatctccttctttatttgcttgcttgatctaccactatttttattcattcttcttggaacctttaaaaattggattttgtagtttttagagtttattgtcatgttgggttttatttttataatttctagatgtcccgtcaaacgttgccattatactcctctacgggccatccattgtctctaccctttattgttattgagattttaaaaatcgaacataattatcgtttgggttcatttttactttctagaagtcctgccaaaccgtcagtagctttgccattgtcctcctctacggctcgcctgctgcctaccttctttattgtcattgagattttaaaatcgaacataactatcgttggaattcattctttattgtcattgagattttaaaatcgaacataacttatagtttcattttttataatttttagaagtcctatcaaacgatgccactatgcccctctacagcatgttcgccacctacttctttattgtcattgtgattctaaaaatcgaacataactatcgttggaattcattttttattttctagaagtcccgtcaaccgtcggtggctctgcaactatactcttatacaccccgctcgctgcttctcctttttattatcattgagattttaaaaatcgaatacgattatcaatac

SEQ ID NO: 11747 - DNA, 1190 bp, Oryza sativa
tttgcttcccccccgtcgctggtatcccctcacctgtggcgggccaaggcatttccagccctcacactgaggacgtatcccctctcctgcgatgggctgaaagcagtccccgtcacaggtataccagtgacgggccactgaattgaagcccgtcaaaggtatgaccaatacctttgacgggctttttttatctaacccgtttgaggtgtgttgggtctataaataccttccaaaccgccaactgctttccatcccgaccattttactattcacaaatcggttgggagggcaaggggggcgattttttgctaaaattcaagggaaaaaacacattattctccatttattctcaatatatcgatcatcatatatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgttcccatgtagggactgtaagaatgaacagatgatcgaagacaaggatgaagtgcatgctcatttgataatgaatggattcatgaagaaatatacctgctggaccaagcatggagagcaagaggcacctgatgtcgcagctgaagaagtgttggatcaggatgtagagaacaccgccgcagctcgagaaggcatgttcgtaccttctcctttaggtggagagaccatagatttggatactcaatgtctatctacaatgttgcatgacattgaagacgcagaggacaacgacaaagattttgagaagtttagtaagttggtggaagattgtcagatgccgttgtatgatggatgcaagtcgaagcacagcaagttgtcatgcgtgttggaattcatgaagcttaaggctagtaatggctggtcagacaagagttttacagaacttcttgaactgttaaaggatctgttgccagaggggaacaatttaccgcaaacgacatatgaagcgaagcaagtattatgtccgttgggcctggaggtcagaagaattcatgcatgtccgaacgactgcattttgtattacaaggaatacgctgacttggatgtctgtcctatctgtggggcatcaagatacaaacgagcaaagagtgaaggtgaaggaagtaagtcaaag

SEQ ID NO: 11748 - DNA, 27782 bp, Oryza sativa
tttaataatttacgcttatatatggggaggaattgtataaatatacgtgtgtcatagatcgatcacgcgggtgcgctcacaaatccgcaccgcggtgtgagcgtctccacttcaagtgtatatttctactattattttccatgcatgtatataaacatgaattattaaaaaaagtatattctaaaaaaataaactgcactactataattaggagtataaagaaagaaaaaatgtgatcatattgcacgcccatatatttctgagtcccttttttccgtgtaaaagatcctccattttgatgtccgcttgtagtgtaactgtgtaagccatattctgaactagaggtagtataattagagcagtaaacatgccaagaaactaggcgtcaaaaatgaagaaatgcaatatacagtgccgtctgcaatccggactgcatggggtctaacaaagactattgtcttcatcgaagcccctgttgagctgagctgtggtgctgtttctacaggaagaaatgcataacggaatgacggtcacagggggacacagaggactagaggagcttcctagaaatgtaactgtaaatgcagtagaacttcttaagaattcagtaaatcatcgtcatcggcgtgtgcccaatgcaagaaataattccttgtcgtctgccttctgtccacactccatccgtcgatgcctgatgatgtagagcattcgagccaccgaataaatggcttaatctctgataaattaatcagcatggatgctaactagtcatcagtgggtatgatctacaatgcgatgcaatgatgggcactaataccccacaaattaagccgagtcttttcagtactttttttgccatactggaattactctaccagagcatcaccggccgataatgaattgaagttgccagaattccatgggaaacgcggtgctaaggactacagagtttgaagagaaacttaaccatcgcaatcttccaccgaactgcttactcatattcgatcatcgatatgttttcctgtttgctgatcgatcagaacttcaaaagaccacattatatccgaagcctctgaatctgcaagggatgagtagccaaacccgacatggccatgctcacagctccatgaaaactacatctgctcgaatctactaactcatgtcgcttcagcaagcaactagatcagagaaagagatggttccgatcatgacatgtacggtggatgcaacctagctcgtcaaatgtacgcccaccgatcgagttgccggttatgtagcacgatcgatcgacgcgagctatcaatcaattcaaccgggcacatgctctgggccacctgcagagtgtaagattgtgcctgaacttattctaaactgctgttcttgatcaggcctcgacatgagcctcgccgtgttgctcgatctcgcatggcccctctgacggagctagggtccagagttttgagttatttccaagaggaaaaatccatggcgaagtgtgggggttcagaatattagtgtagcttagtacgcagcaatgggatgatgacaagcgccggaggagggagaggggtgctccatgatttcattctgcagcttagtagttgcttgctttatcgagattgatagaggcacgtggcagaataagcctatttgctttgggatttccgtcttttgaagctgattagctacgaattgtgcatgtattatcatcatcctgacatcctttgctacgctacgcatgattaccgatcacatcttcggtacttgatcaggaatatatgtaacagatattttcacgcgagtagcacaagctggttgagaagggatttgaaaattccaggatagttcagccattcttgacagaatcacagaatcacgctttgtatcgtgtactgtatagctgaagaatgaggacccgacccacatgtgagcagcttcgactgactcttttgccatgtctgattcagtgaactttggggcagtccacatccaatagatttggtcgaggctctggcggttctggactacattgcgtccaattcagactctcttttttttttttcgacatggtccaattaagacttctgcgtacataaaagctgattaaagaaaaacttgtatcaactttttaagagaaagcccatagcagttaaaaagcccgttgaacccaacacctaagcagcccatatgctcacaccaaggccttaaaacaatagtcccatattacaaagctgggtataagttcactttcactccctaaaatataggtttaatgtgtttcttatccctcaaccgtaataccatatatcttgaccctaactattaaaactagtataatttgactctctcaacaatattaacggcaattttcgatgaccaagacacccacatggcaacccaattatcaaatacacttttaaaagagtagggcccacatgtcatcccaacactctatcccttctctacccactctctctccccatatcgtcttctcagcagtagcaatgcgttagcggggaggcggggcattggcaatagagcggcggtgacggaggaactccagggaggtgtggcatggtgcgccggctaagggcgaagggagtcccctttgccacctccaacttcccattttccctcctctcttgccctcccgactcatgcgttcctaggcagtggccgacccatgcatagctctaggcggtggcggtgagtcgagacctggagccacctgggagtcaggaggtgtgacaccacgtggtggccatgagcgcagcttggcaagcacaccctgaacgccctgggagccaaatcctggatgatgacgacgcccaggagagcctcttcatcgagcatgtcgcggcggcgtgcgtgggagcatgagatggcgccacggggagagcccgatcggtgctcattgcaatcgtccctctctgacgtcatcgctaaggagaggagacaaaagtaccttccccacggcaaaagctggtgtgaaagggagcctacgtgttgcatgccagggtgggagagagaagaggagcgctcactgccagccgccgctgctcccgttcttcgtcccgccgttgatccttctcgtcgtcccgtcactgctcccgcttgtagtcccaccgcgaccgccgccgctgtggagaagagggacaagaggagacagccatgggaggaagggccaaagggggaagagagagagagagagaagggggaaagagaggaatggggaagaacggaaggggagtgagaatgatatgcgggtctcacatgctgactcagttggatagaccaagctaattagccacatcaatgaaagccaccgtcaatactgtcgagagaatcaaattgtacctgttttaatagttggagggagatgaatcatattagacatatattgaaggagttgaactggacttattcccaaagctggccaaccacatagtcctacgcaactaatgggcttaccgggccatcaattttatcaccctaaccatccccattttgcaatgtaaaaacgcaatgtcatatgctgtgctaggaatgaggaatctatccatcaataccttccactccgtattctatcccaataagtcgctctgataaattaagttcccacttcaaaaagatataacaattaattaaatggatcttattgtcatgacgatcgatcatactaagaatatatgttaattaaaacatgcctttggaaataccaatgactctttagtttttagctttggtttcccttaaaactaaataaagtcagtgttgtggataatgaaatacagttgtcggactgagaggatacaaacaatcaatggaataccgattaatcataattatatggaaatttggtcttgacagatatatggtttcccatttacttcacttgttaattgatttacatattaaataaattatataaataaattattaaatgatttttaaagttctaaaagaaaatcagggcgtgacacccatttatctacactactattgatgcaaaaaaaacacactggcctaggagatctgcttagctccagtgcatgtccaagattttaatgagatgcgggcgtgccagtcagtttgatcatgcagctgacaagatatgtaaacagcagatcggctgacaagccaatggagtaatatcagccgatagccgatattagtcgatgctgattctagccgatgtcgatagggttttaagcaatcagctatatgttcaatgtagacaatgatataaagacaatcgtctgatgataataagatataaaaataatataatccaatagaaatcaatcggctaataataatatgataggataagtactgatccgatggttaaagcatatacatcggctaaaagtccgatgccataaaatccaatcgatttagataaacagtgagacctttgttgcaatcggctaaatccaacttgtatgtaatctttgtaagccgatgcaacgtccagataacttatcggctagtaccgcgataaaacactaggtcggacctaaccgatgcagcatgagattatatatgataatctaatacttgatgagccgatagatctgtctaatgtgatggatataacaagtctatttataacagcattgtgattgtagagatatatcggctaagacagaagatcagacataaccaagacagtcccaactaaactgatgcttttctaaacacaatgcaattagagatagaattgagatataaggtaggcaaatatatcaaccaaactagagtgatccaagagatcgaagcgatacagctttgaacaacaccaatgtagctgatagattcaccagggccgatggaacgtaagacttaccccttcgtcggagatcgaactgaatcgatgcaggcccgcgtcaagtgccaaattccgccggttgataagtaaaacctcagaaaagaaggtagcgatgcgccgagagtagtattgatcgagagatcaattacaataaccccgggtgtatatatgtatacccatgggtagatactaatccttgtaggataagaaagaaactttcctaaagataaaaggaaaacataaagtccttatcgaacactaaacatacttccctaaagataaaaggaaactaatagactattcttaattaatagataaattgacatgccgcatcctccttgaactcggtcacttctagataaacttcatttagtagattaattttcataaccgaatctactaagaatccgactattggcgacttgataattcccatcggccgattccatggctctgaagtcgatactgactctaggccgatgatgactttggagcttaccaaatttcactattaacaactactacataaagtgtttttacattctcggccaaaacctattttcgcagtcgaatggcagcccgccttcccacaagtgtctacgaaaatagagattatcgtaggtccatccagccgcatgggtgaatcgattatccaacatgaccggttaagacggccaactgcgataatgttttttgggtgaaaaaataaaatcaaaatatccccaaatcccttctcctctcacaaaccctagctctagatccagatccaaaagttcatcacgacaacaacagaatccattaatccattacttgaaattgaaattgaaacagaaccaaaaaccaaatgcgaacaaacataaacttcatccacatccacaaacatgaactccatccacaaacaaacataaaacaaatgaagatctggccacctccaccgtcttcttcgccgccggatccggccgacgccaccaccatcgtgcggatgcgccacctccactgccatcgccgccaccgagacaggctgaagagagaggcacgatgcgaccctcttcactactccccgcccctcccaaggtcaccgcactagatctgttgatggcaacggggtgcctgatcttccgtcaagtagagaaaactatcaatttggtggaaacttgacacattatcgtgcttctgatcaacactatccgaaccctataattgcagcaccacgtcttctctggttatcaaccatgtcgaaaccgattgaccttgttgctgcaaattgaaaacataagcaagaacaagaaaggttgcaacacaaatgcagatgattgattaataactcgaagttggggttccacaaatcaatgaacgacgaaactggaatggtataaataatctaagtaaacccaaccctaacttgatagtggctacaatatatataggttctaaggtcgaccaaggaggcaaggacacctggatgcatccttatttgattccaacacgatacacggcccaacagcccaaaagacggtgatgcaacacccgtacatattctagacgccacgtgtttcaacaattccatttgactttgaaggaatgatgtgagaccaggtccattggaaaggcggtcttgttacctttccatacataggtagaacgtcgaagatggagtccgaatgtgacttgtgcgacattttttgcacagactgctcagggagcccgaggtagactcgaacatggtatgatttgggcctccatattgacttgaatgcccttgatgatcttgtccatcttctagcttctctccttgttcttctccatagttcctaatcataataaaattattaggtaacaatctttcctaaaaatcacatgaagaagtacttaggaacaagctcacctataaatgcaattgtcgggtgtgagctctagtgattggaccttgtacgaaaacatgagaagtattttgcgtatccaaaggagtaatgtcctcatcatccatcctcatgtggctgcgctcaacctccctgccgcctcctctttgccatgccatcgccggatccacccctctcaaggccagtcagcggtgggtctacaagagaggcaaagaaatcgtcgtcgatccgttgcctccatgctcagtcaccatcggagcggagggggaaaggtgatgggagagcaggagaaggaaggctgaccttcgccgccctctgccattgcacgctgagagagagagagagagagagagagagagagaggacgggatagctagagagagggaggtggagagagggtgtcagtggctcggtgcgggtcattgcacaataagaggtccacttgcgataatacattaccgcagactggccttgaaccgccccccaggggagcgattttttgcatgcggggtcagttatggtccatttatagcctgggggaggcctcgtatggaaaaatcaaatctgtagttgtgctaatacccgattaatttcaaggctctttttatccagcaaattgattccctgatcctttccataaagaaaatcgttttccattaccttatgatgaaaagaatccattttgatcatatttgttgctacctgctacgagtacatcaatagtacaatcatcaactacaaatgccacacatataaagttactcgctgactagttggcatccatgaagaaataaaatctgcacaaacattgaaactttttcaaattggacacccatgaatgaatgtatgattatggtgaccaaatactccaagtgacctttacaacaaatgagcttgttcatctcagtttggtcctcacttctcagctgagaatcccgtttatgtacctacacaagattagcacaattgcataaactagaagacaatcctctttaataaatattgacttcttccttatttgtggttccaaatgattgttagcctatgtggtgaaagctttctagctgaaattgtttaatcttgtacacgttttggcccttctaaaaggcttccgtgtactaagggcctgtttggcacagctccagctccagcttttttggagctaaagcccagccaaatagtttctgctccacctaaaatgggagcggagctaggtgaagcgctctcatagaatgaactagagaggtgtagttgggtttaggcagctccacaactccactccatactcaactcctgaagctaaattttgggagttggagctctacaaaacaggccctaagaaagcttgtgtaaaacgttatgttgtgtaacactgattacctagggttaatggtagttagtaagttaaagatgtcacggctcaagctgctactgtactaatcatttgtggtaagtagttaatcatatacgtttaagcattctccttggaaagtacaaggagcaaatgaagtaattggatgaagtaatcaggaggcgtgccattacggcgccccaacgtctagttttcttatatacttatcaatcagtctttgaacaaccgctcccatttggatatgactcatgaggaccaattagctccattggtcattcttcatccaatggctatggttcctttatctctattttgtctttttggtatcagatggctgccgctcaattgcttacatggatgaacctagctagtacgaattggtgttggcgtttcacttagagagaatgggacaatcgacatcaaaatgccaaaaatttaaggataaacccgttactttagagcatatatatgatgtattatcccatagatagtagttatcatgcaccatttatcatttgttttttcttcggtacctcgactaattaccggttattctgctagatatgtaacggcattgaatatatatccctatttagacatgtcggttttagtatgcagtttcactaatacgacaaatctttgtcgtatgtgaaatcaaaacgccagatttctaaaagcttaaatccgcgggtagttaacattcagtatttttatagtttaattcttgatacttctgaagataacaaattctaaatttgtgatgacaataagattaacctgtttaaatactttggtgaacattggccggactcttgaaacagccgtccatcctattgatgcattacagcattgcttatggtatcttgatcagtactactggattaaatgctcaaggactgtagccaaatcaaccatggtggtagacacacactcaacgttcatattcatgcctggcatgggatgtacactagagtgctttgcatggcatgcagatacagccatatacctttgctcaatgcctatcctactggcagctcattgccactactgatatgaattttatattgacaacacccttttgtctgccagctcacctcttcaaacgttgcatgcacttggtgtacacaacctcctgggctatacggacagcttaaaagagacctggaaggttataatctagctctatttgtgaccattggatcacttcacagatgaacggctgatgcattccctcttctcctatataaagagaggactcaggtctccatcacactattctatccccttattgactttctctcaatcgacctcattctgtctttcctagaaaatcctccacccacaatcaaaaatctatgcttccaacctcaaagaacaagttgatggcggctgcaggtaactccttcctcaaccaagatccgacgatgatgggatctgggatgccgcatatgtactttgcaagctctagccatggcaccggtgcccactaccaaagtcctggtggtgctcccatcaccatggcagtcccggacatggggtttcttgttgcagggataggcatagctccatctagctttgtgatgccagagggggccctagcagctagctatagcgccatggctaccgttccagtaggggttgttgttcctcaacagcagtcgtcacgatttgggggcaacaatggtaaccctgggtcgttcaaaggagcatggacaaggcaagaagatgagtaagtaatagatcaatcgacttctagtgagattttatttttctcactaacaagattttttatatctatgtgttaacttgttttcagagttctcaaacaaatggtgatactccatggagatcgtaagtgggcaacgattgcaaagagcctcccaggtcggatcgggaagcagtgtcgcgaaagatggaccaatcatttgcgcccagacatcaaggttttactcttaacttcttgattcctatattattatgtagatctaagggggtttcttcatccatgtgattttgaggggtgatttctttttagatttacattaaaatcatgctaagcagtattctagcatagggattatcgaaataattcattttgttgcggttgttgtgtatgctaatcttaatgttctaggcaccgagtaatccaaagcctccgttttatatgatgtttttaggactagaaaatcagtagatcttgggctacaagatcaaagattcagactcatcatgtccctgcaggaaaaaaaaacaaaggcaaatctgtccaaaattgtacctacttcaattaatgcgtattacattttataaggttaaatctcttcttgatttataactacggagtaaacaacaacagtgttatacaacaccctgcatgaatatggtagccgttaatgatcatatatagatatatttttctatccttaataaatgtactgcttagatttaaattattccaactatctaccgatcttagaaggttcgagggcatattttcttgtgttgtgtcgccgattgcgtggatgaaattagtattcaaaaactgtacaatttatactgcagaaggacgtctggactgaggaggacgacaggatgctgatcgaagcacacaagacttatgggaaccgttggtcagtaatcgcaagatgcctccctggccggtcggagaatgctgtcaagaaccattggaacgcgactaagcggagcctgaagtcgaagcgtcggatgaagaagaagagcgtgcaagtggtgaattcaccgccggggcagctctccccccttgaagagtacatccgcagccagtacccgtcggccgttgagaccacaccgccgccaccggccgtgcctgcaccgccttccgacgtcattgtgcacggtgccggatcggtcagcgcaggtccaaccgttgccacacaggagcccaccggcaccaacccatcggaaatggggatctaccttggcctgggtaacccggctggaccgaccacccagcagctagcggcgatgaacctgaacatgtcactggcgccggacctcaacgcctacaacgatcagcgagaggggtactacctcccgttcgtcccgcagggcaacctgcactatgggatgcatgtgccggcaccgccggtgcagcagcagcagcagcaagggattagcgttgatcagggcctgcattcttcttgcctgagcctgtaccacccgttcccgggaacccacccggttagcctggatttcggttgccaatccagcaaccatgccaacgcaggtggctactacagtgaagctggcccaagcagcggcagtggcagcggcgaccctgacgacgtcgacgtcatccagatggcctccaggcagttcctgatgccgtccgaggctgaggtcactctcgacctgaccaggttcaagtgaggttcgcagtgccagtgccaatgccatatcaccgctcggttaataaatttatcttttgttttagcagctcctgttacctttctccaagtacaatgcatacctgactgtatgactgcagtgcgcgtttaagcttttcttgtatttctgtttggtacattcggtgatcattcgagctttgcattgtccatgtggtgtactggtgtgggaactttaacttgttgtactagtaccttttatgcatggatcaatgtgtggatttcatagttttccccctaaaattagtactcctattcctcgaaaagatgcttttaattttgtagtttactactgttgaggtattggagcgtggaaagtggtagcacctggtacgtctactccatgtactacagtctttgcttgcttccgcggatggtgcgcagctatctgggctttaaatgttggctcgcagacaaaaagagcgcaagagtttgacgtgcagcaaagctgttcagttcctctccccgaaccactcaaacggctgcctgcgcgcgtgatgcgccagccaaggatgcatgcattgcatgcagctagctgcctcggcgtacttcactgctggaagtagcccgggaataaaggcgaataattgtagtaccttaattaactattattactactctgctactggagttaagttgtaacatttgtcgtattaacttcaagtgccaaatgtgtcattcagcatctttcacaccaatacaccatggtagtaaccagtaggcagtagccagccactccatagtccatgacaccgtctgattccgaactctgactgatatgacagatttttcctgagttcagtgcaatgtcctatgtgggaggcccaaaccacgtggggacggcccaatccttgccggaaagttggtttcacgggaaacgggcctcctgaatcggccctaaatgtatcttaactgggccgaagcccgatcctttagatcagatgcttcaatttcgaaacaagttcattctagatacctcaatttgtcgccaaatatgatccttagtcttgaaaaccggatacaacacatccttcaacttatcaaaccgtgcaatcgaggtccctcgatagtatttatctccggttttgactgacgtggtgcctatgtggatcgtttgaccaggtcttcgtccgacgtgcgctggcgtggcgcttacgtggcaatgtgatccaaatataataataaaaccatggggcccacatgtcagtttcacacaaaataataaaatatagtggatcccatgtgaccccacatatcatctctatcctctctgtttctccctacttatctgtttctcccttcttcggccggcagagcaggggcggtggtgccgttgtggtcggagcaagccggcggcaagaaggccccctctccctccttgcccaacgatgacgactacgagagccgcgcaccgccacctcatcaggagatgacgaggatggagatgagatagcggagagggaggatgcggggaggccgacgagtgtggcggagaggcctcccggcgctcaccgccaagctcaaggccgtcggcgccgccgtcgcgctcgagtaatcccgagcagaagaaggggttcgcccttttttttggttcctattcattatccttagatcgaagatgctacgcttgtggatgccttgatttgtttggattgaaattagatgcaattggggcaactgagctgggatgaaggtcttgattgcattgttgtagcttgcctagttactgatttatcatgttgcctagttaccgccttctgcagcagcgccgaggctggacagcatgcatccgcgcgccatgctaagcgccggcggcaagagcgggtttctcgtggcggccatcggagagaagggcgatgatcgacaggaaggagctaggcgacctcgtgtcccctcccgacatccttcctccctcctcgagctccttggcctaccagcgagcgcgcgtaagagagagatgtcttgtggccgctcttctctatctggggcccattcccagcgtaagggagacgaagagaggggagaggaggaagaagatgaggggtgagtagactagcatgtggggtccatgtggtccccatcattttttattagtttgtgtgtgaaactggcatgtgagtcccattggttttattattttttcggatcaaactgccacgtaagtgtcacgtcaacgccactttagatgaagaccgagtcaaactagccacgtcagccaaaaccgctgtaaaccaccgagggatctcatttgcaccggttttgatagttgaggatctgttatatctggttttctggttgaaggatgaaaatcggattcattgacaagttaagggacttcagatgaacttattccttcaatttcgtcggcatcgtgagtcatgatgttgctgttggacatgctggcatgtaggcccaataaattaggccttaccgtcagaaatggcccatatgcccttttgatctcctttccttcgtactaggcctttttggttcatcaaagatggcagggagatttctaaaagtaatactatatgacagagggatgaaaggtgcttcgttctacacacgtagatacgtttaaggttggcgacgacgcttgcggagagtttttgggagtaccttgaaatgaatgggcgcatgttgatggtgtgtttgcaagtgtgccttttatgcagtaattgagaaaagaaaaggttataatcctttgaatgttgatatagtgttttgctttttcttttttttttacgaccactacatgaatagacaactcatgttgtatttgtatgcccatttgcatgctgatggtgttcatctccctttccggctagtgcaatccgaggaattatacccagctgcgcagatacaatggatttgcgtgcaatcgcccactggtttagccatttgggtcgtcctaccgaggaactcagactgcctctgactgggaggcatgtgctggtgacgcggtctcgacgaatacatgttgcccagtgcacctgccgggatgatctggacaaaatggtggtctagctagttcatatctagttggacttggaccggttctttgaacgtaaggaacggcgaaattgtgtctaacacgtctagattctagaagcagcctacttaatttgaaccttccttaacccttcctgtagtagttggcatgttagtcagttagataagctgtaaaaatgcggttgtatagcttcagtacaatgatctttggctgaatgctgtttttttcctctatggtctaccttatcggttttgtgatgtccggattagtcgctggaatttcttcctttttttttctctgttgatgagggggtaattgattgttcttccaaatctgtcatgtgcaagtattacataaacagctcggtcgttacttttagttgcatactctaactcatgtccatatataccaagtccgctcaaatcttctattaggacatggtcagcttaagtctcaaaagatggcctgagccacatcctcttgatttgattcatcaccaggattacatttatagagcattgctgtaactaggtatataaacatatataaaaaatactactatctgattaggaaataatttttcctttgaaacaattcgtagtacatcaaacattatcaatatcggacacataatccattgaaacatatttacagagcattatatacatcatcagtactctaattgaaatatatgatcctagatcattttcccgttaccatctagtaatcaaatctaaaccaaaatgtctcccaataaaacatttactcgaactgaaagatgaacgcgaccactaccctacagaaataaatcataaatgtattaaatgtatcatcaaccttgaaagactgcaaaattcagggtccggcggcatccatccgccactatttccgccgctcagcttcgcctggacgaagcagagtcaccgtcaccggccatccgccgtacccagtagtcggccaagaacgtcttggcggcgtcgaggctggggaagtagggcggctcgaggaacatctgcgccagggggtccatctcctccgccggcgagaacagcgcgcggttggtcgacgactccgcggtgcccatcaccgccgccacgagctgccggtacgcgaagaagaacctcctcaccgccgcctccacggcctggaacgcctgcagcagctccaccttgccggcctcctcgccctcgccgcgccgccggctgtggaacagcctcatggctgcctcctgcaccctcggcccgccgttggggtccacctcgacgccaagcacacatggcacacgcttcttgaggtccctcgtggcgttagcgacgtgcagcagcgccctggagcggaagcaggaggacgcgtcggagcccggtgccgcccgtattgcgagctggctcttgagccgcaggaagtcgtccgggtccatcagcaggtgcaggtcctcgacgtcggcgagcagcttccagacgcgttccaggatccagcagtcgctcgccgcggcctcccagtttcttgcttcgatccggttgtttaggcgggtgagaagctgtgaggccgcgcacagccaggactcgagtatctggtggatagtgaacagcgcctcgttctccttgttgcggtagccggtcttgggctccggcgcgatcttcgccttgagggcgtgcagctcgtgcggcctcacgacgcggtcgtactcgagcaccggcttgccggcgaggttgggctcgccgaggccgagggtgaacacgcagccctgcatctggctctcgatggcgtacttgatcctggccgccacggtctcggacttgtcccaagcggcgagccgcgggagcaggctggcctcgctgacctggcacaccaccgcggcggcgctaccgggaatcttccacacctcagacgcgctccgctcccgcgggagcacgcctttggacgcgctcagctcggccagcggcgggcactgctcgccctcgcagagcgcggccaccagctccacctcccttgccgcgagcgcctccagccgccgcgcgagctcgcggcggctggcgtagccccgcgggtcggagagcgcgacggagatgaagcggaaggtgatctccagcgcctgcagcgccggcttgacgaggccctcgtcggcccactccggacagcacctatccttccacagccttgcgagctccggaagccgcaggtactgctcgtactcctcgaccgccgtatcgtcctgcaccctcagaggcgcagccaccgcccccgacgacgacgaggaggacgcgcgctgcttatcttccggccgcaccggcgatacaggggacagcttgggcgttgccatctccgcgctccagttgagttgaactctccctcgatatgatcagcgtctagtttgaattttccaactgtatactccctccagttatcgatcgctaatcctcgcttgtctttgagtttggcctcgagaattagcagatgagtcgtctttatatactgctgcgctaggtggaagtggagtattacagctgtacaaggggagcgtgccagcatggcgtgtgggccacgctgctgcagcgtgattcgaaattcaattttggaaaccgcgggtgggccgggccctgtgcctgtggctggcgttcgcagagaaaggcaataaataatcgtgcaaagtgagaaaagaaagagatcttgagcttatccggatgaaggagaggtgacctctagttgtgtgaactgtgaacggcggatgcgctcgtggcctcgtgatgtccaggtcgtcgtgaatcgcgatgttctcttgcgttggggcagctcacgccgacgttgtattcgatgtaatgcttaacgcggacatctctatccgttgcgcacttgcgttgcccaccctaggtaggccggcacgaacgaggttcgctgaatggataaacggcgtctctgtttctctcgctagtctcgtaaaagaatactatcaaatgaaaacttcgttcgcttgccctactttgcttgtggtttatacttgtggatgattctatattggaatactagttcccgaagcgaacggcgcagcatgtatgatgattttgggtcggcaatatcgtcaatgaacgacgtcgtagctctgttattttcctatatgttattccatatcgtgagcgtacgtaactttcatcgaaaggcttttgcagtttcgccccgcccggctttcggtagtgatagatatctaggataggcagttgacctcaactgagttttccctcttcggtttatttagcaccaaacgttcttgtcaaccaattttgtaatatgtagtgagcgtttaaagttgtctttctgagctttctccttatcttctcgggttgttgagcacgtaagaatacaaatacaaccaatctagactgcatgctatggccttctttacactatactcaaaacgactgtgtgataccacttatagacggggtcgacagttctaaaccataaattaagcacggtcggtggaaataatcccatatgcactacacaattactacttcacttactgtgaactttcggttatactgacgcctaagtatctctctcctaattatctcagcaaaaaagttgtcttgtcgtaacgcactaaaccaagcccaagtaggcagcagctcgtgtagtcgtgtgtctattggctagtgcgaaacaaccggatcaatttcagtagggcgtcgcaatgcaatgctgatacgacgtgcacctagcccatcacccacgctcaaattccaccgtcacccacgctcaaattccaccagcgggtcgatcgccgccgcgaccgaaaattcagcggtcgtggcgtggatttgccggacgaccgcccgcccggccgtccgcgagcgctgccgaactttgacggcgtacgcgccgagacaccgcgcggccctgctccccagcctcctactagtcagaaccggcagtagccgaagcaaccaagaaggttgggtggatatgcgtaatgcgttgatttgggagggaagcgccgtgttttgccatgtgtcgccttgctattcgcggtgcttatcgctcgagtggattttcatattggttgacctagtatattccacgacgacctgtgctgtttagttagtggcgtaaattaattcaattttggaggattggtattttcgcgataagtacgaatgcgtttttttttttaagttgaccggaggaatgggaggttgagaataggtttttgtgcatatccaggagagatggagatcgatacaggctagctggggacgggttgaggctttttagctgaagaagacgtgctcgtacgcgagatgaaaagcatgtaaggtcggcagattacctgcctaagttaccctgtgcgacagagcatatgacgtgcaccgactgattttgttcagttacgcaacgtttcagtatacataactgtgcatgcgagttcaaatgattacctcaaacgtatagagacatcatatggtatttgttttcaagggattagtttactcaatgaaggaaacgggcatgcgaaaaattcagatcggtttctctctgactccgagagtactcgcctctcaacccatgaaccgcgaacagccgctacaactgcattgtggataacattgacccctctttataccgagggtggtgcatgatcccaactggcaacgagcgtgctcgtgcatgtgcatgaacccgccattaaaacccgtcacggtcgtttcgtcgagggccataattcgtgcatcaacggctgggctccggcgcgtgagtcgtgacgtctgggaagggaggccgggtccatgccgatacggggccaagattatggccaccaataacatctcatcatgatttccggataagagcttacgaaggtagtagtagctgaccagccggcctccgacgcctcccttccttgccgcctgcgcgctagtacgaataacgaatggacaaggacgaccggccggtaaacgtccacgacccgatccgagtatctgaccaatccgtcaccaggattagctcgttaagtttctaggcggacaagactttcacgcaaacgcacgtccgtcgctgtcgtgaaaaagagctctcgatctcccaagaaaaccgatccgatcgcggccccggtgtcccgtacgtcgatcactcgatcaccgatcgagggcgacgtgtctaggctgaggggagacagggacgccccgccacgagcgaggaggcgcgcgcctcgccggttaacccgctgttgccggacgcgacgcacgccggcacacgcgggtgacagctagcggttggcgagcgttctcacgagtttaccccggtccgcgactccgagggtgcgtgctgtgcatgagccgatgcgcgtcggctgcacagcgcagcgtagtggtgcggtgtgaccgactggcgtacttgtgctggcgacggcggcaactggggttgggattggattgcgccggtgcaaacgcgacattcgttttctccgttccgtcccctagccgacgcgccttctcgtgatgcgggatctgggtcggacgaaggaaagaaggctaacgacagaagttcggcggtgtgtgtgtggggcacaagggctttcagttttcggcgttccagataaggggaggcctcgtcgcacatggcgtgccgcacgggccgcggcgcactacgggattagacgaggcccatcatgtgcgatgcccagctcggccatatgctgcgagggggcatcggtcatcggtgcgcgccggctgagatgaccaagccgacgagctggcaaccgtttcaccgtacatggcagctcatgatcttatctggtttgatttgaagactagtccaattcgcacggtactgtattgcgtagggtactatgaaaatcattggtttatgcttccaagcagacattacgtcgagtatctacccttagtttcagacatcactgaagccatttttactacaccaaggttcacaatttcgtttagggtcaaaatacaagcccattgatatgaagaatttcgataaaggattttataaaaccaagtggttccgggagcttcgaattacggaagaaattcaaatagaattgtgcaccctagctcaagctaaaaagtcaggtttgagcctagtcccaacctaaaagaccaagccgaagctaagtccaaacacctttttttttaataagttcactttgagtcccttaactagtgatcaaatctaattcgtatccttaaaccacaatatcttgacctccaactattaaaaccggtgtaacttgactccctcgacgattttggagggtggtttcgctgacgtggtgttgacatgatcttcgtcctacgtggtgttgacatgacgcttatgtggtcaccacatggcgctacgtatgacgaggaccaagtcaacaccgccatatagtcgccacgtcagtaaaaggtgattacctttgatgttgtatgccacatgctcacgtgactaaggcgttgtgtttgcacctaaatgacaaagtttgggacgtgcaatacaccctgcctctaaacatttttctaagaactttttttttctaaacctgtttatataggttggaagcatctaagattaatttaaacatcgagatttctaagtccaaacaaatagtcatgaaaatgtttgaaaatatttttgagctttagtaatagtgtcatcgttggcttaaaaaaatacaactcaaaaatcaacatgaaaagaagatacaaagagtaaaaaatctactaagcagtaaaatggatcatattttatagtttactggtaatgaggaaaaaacagtttataaatagataatttctcaaatcaaatagttcaagagagtaaaattaactattatttccttctatgaataactagcaaaactgcccgtgcattgccacggaaagaaaaaaaagagaaaattgaattacaacatattaaattataattaaatgaaatacaaattttctggaatattttgggtattttttaagtaggtaggtatataattaaattaatttacaagtaaaataagtgtgagaaataaaatgatatggttggatttaattttcattaaattctccatattaattacactttttgaaattttcttggaatttactgagcttaattgctaattttgataatacaaacatcatttaagcatttatttaaataaaaatcattctttctctatgagccattttcagcctatttttttcttcagcctgcaagcgaccaaagtctacataatatccccacactcctcacttgccgtgcgggccgtaaccaaaaatgtgttggaccatcggcccacgtgtggcccaaatggtgcggtccggtgatgtaggccagcccaacgctcgatcaatccgagccgtttgttttgatggatggctcagatcagttccaatcaatcaaaaccctaaccctaaccctccctctccccctccccgatcggctcagccatcccccatcccccctcccaccgccggccgcctccccgcacgacgcggcctctccccctcccctcaccgggccgactctcccttcacccctccagcggcgccgcttcccttcccctcccttctccactccggcggcgccactccctctccccctctccctcctgtctcgctggcaaggcgcggcgacagcggggtacggcggtgataacgcacggtgacactcgtccctccccctctccctttccctctcctcattgcctcaatgcccgtccctccctctcggtgatgacgccttctccaccctcaagatccggcgacgtcgacggcgacgacgatgtcgtcagcctccgcgggtggatctgtcggtggtggcggctaccgcttgcggatctggcagcgacagctccctccgtcgcctctcttcttcctctggcgacggtggtggcgtcggcggtggtcgtggatgaatccggcagtagtggcgacggccgaggggatccgacgacgccccgtggtcggattcggtggcgacgacggcgttggtggcttctcggtgatgtttttatttttcttccctttttttttctcaatcgcttgttgtccgattgaattttgtatgaattttttttttgctttttttttgccttattatgatgcaaccggatttgattttttttcaccttttttttttttttgccctttttcacggacggacgacggaaacaccttttaatttttagacgatggaaacaccttttaattttttaaatagtagagatgtagttgacagagttgccaggcctataaaaacacgattccaactggcccaacggtcttccctagccaactggcccacggcccacggcccactagcagcacatctgatgctcatctttgtaacctaggtcacatagccaacttgacagttgacactcgggcccgcgagcccccgactcgcccgccgccggccgccaggccgatgtccgacgacgctccagcctcctgcgctcctcacctcctgttcgtgcttgcttgacgtcgacgctggcctggcctcgctcggtcctgaccgagcctcgaggagacgtcgccgccgaccgccggggctgacctctcctccgattgcccgacgcccgctccagcgctcctactccatctccggcctccgactcccagccacaggggcgcaggcggctgatccccaggctgctatccgcggcggcggcggcgcgtgcggcacaactcgccatttcgaagggagtagccgctctttgatgagcgggcgaatgggtacaggtatgaacccgtacactgtaaccgtctcactgagaggagggagcgcatcgtctgccgtcgtaactataacggcacggtcatgccgttggcaaatcctgatcgttccttttctttggacgattaggatttagaaggatccaaataccaggcctgcaagttcattcaagcccactaaccaatcggctggtgcggcaatataggcgccgcaaccttctgacgcgagagaagtcccgatgcttttttttatcgatttcactttccccatcttcatctctcacctctgtctctctctccacgcatctctcaatcactgcaaagcaggagcgccgattcagtggcttcaaccataaatttttgctgccaataacagcaataagctccctgatattacccaggtttgcttcccatcatttttgtcaattaatttggctcctgttgctagcagcaatcagtcctggaagcattggcaacagtacgcagctatggttgctgtaatcagagaagtcaagcacgcatgcatgagcagaaaatggaagagacgaagctagagggtttgggactgattccagaatcatcggccaattcaatttcagtagcttgtgctttagaaatcttccgttgtgaagacattagatgacttgtctctggtagttggagcatgtggttgtgttcaatagataaatcatgcaaggtgtaaagaccagaatccctatctaaggtaattcccattcgggcatcacaacctgttcttgtctcagctcggggaagttttgtcaagtgatctctcttgtcctgtgctcggtagccctgattggaacatacaaatctacatgatgtaactaccttgtcaattttacttgtgttctcatacttcttcctagcattgaatcctacttgacctccatagaatacccaaaagttccaagcctcatcagcacaactaaaattcatgcctattcgaggtatccaagaaggtgtgttatttgtgctgcaaaacatggcatcgcttcttattttaccaaacatgattaatgtaagatatgaaatgaaatggtcggactggatttagatggtacatatggaactatgaatcagatcctgatatggcactcacaagtttgatgactcagaaggagcaggtttttcttgcagcgattgctttcgtactagcgtctgatctccctcaatctcattgcttcaatcaattgtaatattgttttaatcataggagaactaattatatgtattacagatgaagatgataatatgacttacttatttggagtctctgttgttgttggggtacctcgatcttcagaattatccagtgaagacatttctttaactcagatcttgcttgcatatactttggcctcttgaaactctcgatcaagagatggcatcagaccctttggagagaaaggtgaaaactgatttctataggtttctatcctctaaaatgaatgggtgaaattggcgccaagttatctgcttgccgcgcgccatttctctcgcgtcagaaggttgcaacgcctatattgccacaccagccgattggttagtgggctgaaatggacttgcaggcctggtatttggatccttctaaatcctaatcgtccaaagaaaaggaacgatcaggatttgccaacggcatggccgtgccgttatagttacgacggcagacgtgccgttatagttacgacggcagacgatgcgcttccgggggacccatacccgcgaagcattaagcggtccccaaaattttcaacgcgccctttcacactttcgtgtcgttcccgcgcgagggtgggaaaccctttggcgggcttggctctcgcgccactctccaccaccgcgccctttttcttgtcgcccacctctcgccccatcccccacaaacaattcctccccaatttccctcccaaatctctcccgcctccgatcccacagtctctctctctctctctctctctctctctcgatgccgacgcttcgcagcgccacagcgagcgcgtcaacggcgggcacggcctcgccgacggcaatcgccaccccacgaagcgccaagcggcgcctcacgagccctcgccgagccgcagggtcacccgacgcgtctcagttcacatccccccacaaatcccccaatgtcggaatcgtaagtcccccacctcccctcgatctctagtgcaggactatgcagatgctggcgtgctgctgctgctgctgcatattacctggtattctgttgcaatgaggagcaattgctcgatcttgcaggttggcaccccgaagctgctctcggcgtcgcccaggtcatctaggaagcggctttacggcgacttcgtcgcggccgagaagcccaagtggaatcctcgaggcaagtctccagaatcccatttcagtagggctcagagttctgattgggatctgacgaaagaattcatctgttctgcagatcccgctcagatgcaggtggtcaaggaggcgcttcacgtggctacggtgccctcttgcggattggtctgccgagatgatgagcagagtcgcgtgcttgagttctgcaagggttgcgtggagcaggagcgttcagggagcctgtatgtgtgcgggtgccctggtacagggaagaccttgtcgattaacaaggttaaggagagcgtggcgcgttgggcagacgaggtaaattcaatttctcatggttctgtaagattcctgaaataggagtgtgtagttgttgatatggttgtttgtcctcgtagaccggaatggagacacctgatgccttatcgatcaattgtacaagcctagcaaagacgcatgaaatttttagtaaggtatttactgttgcctaattattgactcgatatatctatgcaatgctgacaggcactgacaagttcttgatgcagatacttgcgaagtttcagactcggaagaaggcaacctgcaaactgtcaccacttcagcaacttcaaaccatgttttcccacaaggaatcagccccaagaaggatgttgtaaggactgcttgagcccagtacccatcctcacaacctggcctttttcgtgccatttagttcctggcatcacaattttcatattactgctcctctgtaggttggtcgttgtggatgagatggactacttaataacaagagaccgggctgtgctacatgatcttttcatgcttacgacttaccaattctcaagatgcatactgataggttagatgtcaaaggatgcttcttgtacttttgtaattatgttaatatcaaaatactgttttgccaatcgacaattggtgctattttttcaggtattgcaaatgctatagacctagcggatcggtttcttccaaagcttgagtccttaaattgtaagcatttaccaaatactagcaagaaaagtgttaacataaattgtatgaaagaaattaacatgtctttggcattataacactaatttacaggcaaaccacttgttgtgactttccgtgcttattccaaggatcaaatatctgacataattaagcataggctgaaggtaattcgtttatcatgtgaccaactgtggctcgtgcacatctgtgttcaattacttgacttaaataggttgcttaccttttgtgatactacacataggttctcgagtatgatgtttttgaaccactggcccttgaattttgtgctagggtaagtccaattactacccaagtactcatttgtagctagttcattttgaaatatgtcagttcacaaggcagcataggtattttttttgttaaggagaacatcatggtgcagttagcatgaaattgacgtgttcacttattaacaatgtttgcttaatattcttataccagaaagtcgctgcagcctctggagacatgagaaaagctcttggtgtttgcaggtaacccacttctcttgcagtgacaactattacgtttttgcactaacatgttgttccatcataaggtaagccagtccataacttaatttttatttattccaggagcgctgtagaggtttttgaagcaaggttacaagagtcttctgatcaagaatttggacttgtaagtcatgccgtcttttgatagcttttttttttcttttgagggaaatcatcttttgataggtaacatgtataaccaacaaagtggttcctgtaaaggaaatcacctttgttcatgtctacattgatgtaagtcaagttcacagtagttgcttcaactgtaaagcttccttgcggttgggtccatctgtgtctctttgcctgacttcttctggccggtagtcggtagaccactagaacatgattctagtgtagtacttaccaccaaacagaaatttgtatgtgcatgactgttgtactactaaacaagcgattgacagtgtatttcatgcttttagttgcctggatctaacgctggtcgccaaaataaatttatcttttgtttggatgatgaaacattgccacattgtatttctttcacaagatcagtaa

SEQ ID NO: 11749 - DNA, 5051 bp, Oryza sativa
tggtttatatatatatatatatatatataggtatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtacccgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgaatcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccctgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctttgtttgcatggcgtccatgctctgtgatcctacctgccccgttgaggcgcagctgctacggtttcctgacgggctcaccattgcaggaggaatggtcggctggggatcatgggaccgatgtgcggccatgcgtttatcaaccttccttggcacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctattgccagttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacatgcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctgattcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatgtatatatatatacatgtatatatatatatatattgcatttcacgttaacgttcgtcctcgttcgttcgctcgttcacgttccctagctcgttcacgttcgttcgatcgttgtcgttctcgttcacgttgtcgcggcaacgtacgttgacgtgttcgttctcgctctcgttcgttcgatcgttctcgttctcgttcgttaacggcggtgtggcggcatcggggcggcggttggcgcgtcggcgtggcgacggcggcggcggcgtggcgacggcggcggcggcgtggcgttgtg

SEQ ID NO: 11750 - DNA, 710 bp, Oryza sativa
catatgtaaatgccacatgcatgatttaaaccttttaaaaattgaaatagtcatatataagtagcataaaaaagatagtaaattaaattgtgaaaaactctaatatatgaatgatagttttataaatatattaaatttaatacttttaaaaattctccagtcaattataattagcatatgaatgatagtaaattaaatgttaaatactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgatagggtcaatcgtcactgtgaaagggggttgcccatccaactgatcgtaatcctcgtcagtattgtcctcaactccgacgattt

SEQ ID NO: 11751 - DNA, 928 bp, Oryza sativa
tgatcggtacaaaaacacattcagattctaattagagataaagccattgagtcccaccagtgtcctatataagaaagagtagagaaaatagaggtgacaactgaactctctctaaccctaaaaccctaaatcaattcgtccgatcgattttgaaccctaaaaccctaaatcaattcgtccgatcgattttgacattggaaggggttcgtgagagtttccttttcgtcaaccggagagcgtagcagaagaggagtgaaggagaaaagcaaaggaataacatcaaaaccacataccggtttcaatggcttcattctcaagccagttagatcgcccatgtaattaagcagaggtgattatgtttagactaagactcaaagtaattaagaagattaaactccaacagtaaccaactccatttcctcgcccctgtcgtcaaccctgccaataagcaggttagcacttaggccctgtttctttcggtttgagattattataatctagattattgagtcagattactataagctagattgttataatctgtagtagaataagcggttagttgtttctttcctagattattagagcctaaattattgggtttgcaagtctaaagagagagtggggtggtatggtgggtaatttttcactcaataatctggaaaaagctcacctaaatgagcttatcagattataataagttgggctccagattataataagctacttcaataagttgtatgtttctttcagtttactcttagtaatctggattataataatcccaaactgaaagaaaaaaggccttagcaccctcggctactatgcctcgtcgttgcaccgccaagaacagcaacaggtgatggagagagatgaacgttgaagaaaatacaagagacgttggatatcgaaccaatggtgagattca

SEQ ID NO: 11752 - DNA, 664 bp, Oryza sativa
ctgcagcccggaccgtctggatactccacgaatatcaagcgaataataagcacgaaggagaagaagttcataaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgttttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagcttcttacatctaggagcact

SEQ ID NO: 11753 - DNA, 950 bp, Oryza sativa
ctagcatttcccacatacatatagatgttaatgaatctaaacacatacatatgtctagattcattagcatctaaatgaatgtagacaatgctagaaagtcttacattgtgaaacggaggaagtaataaaatgtatttcaacttccttcatgcaaacaattttgcacttctcaagtcccagctatatgatgagttgtggatgatgaacttagcgcatataaaatgcataagaacgatcagtaggatttggcttaatttgttgaatgtagacatgtactggatatatttccacctatgaactatatagccactgttgcaaatacaacactaattgaaactaatactgtgaaaaacaaacaattccccccctaaaaaaacaattgtgcacagccagagttaggttttcattttccatgttggaggttgtgaagtacttcctccgcttcataatataagactttctagcattgcccacgttcacatagatgtcaatgaatctagacacatgtaagtgtatagatccattaacatctatatgaatgtaaacagtgctagaaagtcttacattatgaaacggagggagtactttgtaggctttacttgcatgggctcttttgagtttcttatttaccttttatgttcattcaagcaccacaaggaagtgtcttgcattgaatggttggattctaagatggtttctaattgcctacattctaataaccttcttaagctctccttcccaatatgttcacatcagactgaatattatcttatctacttgtctctcctgctgtctgtgtgcacacgtgcgtgctcgtacatgcgaaagaaagaaaccaaaacttactgttgccttcttgccacaggggtgtagccttcggaacacagagtacattgtgggggttgttatattcacaggtcatgagacaaaagtatgaacatttcactttt

SEQ ID NO: 11754 - DNA, 12179 bp, Oryza sativa
gtccatcaaattaaaattactttcatgcctcaaccctaatttttcatctatccatctaaccaaaccatccaaaaataacattaccacatatatggttcaaaaaatcgtgacaccaatgagtacattgcaaacatgtagcactacaacaagctaatcccaagaacaaatgctaaaaatcacaaaatttgggctaaaaagaggttctagggttaccctccgatctacaaattcaaccaataaaaacgaaaaaaaaagaggggggaatggaggagtctacctttctcttcgatttccacaaaaaatcccgcgaaaaacgagttcaaatcgagtggatttgaggtggagaggtgagggggagagagagggagaagaacagcaagcagcggctcaggctaggactcaggcgaaaatgggagtggggaggagaaaggtggtggggcccacggggtttaagggcgcggcccacagaagaggggcgcgccagccatgctagcgccgtcgtatgaggggcgtcgccagggtggctggcgcccccttctgctcagtcagcatcgccacgacagctctagtgtcacggtggcacgggcgcggcgccatggtggctggcaccaccatgttggaggacggcgccagccactctggcgccccaaaaaggaccattcctggtttaagttttccaggggtctatttgtaaaataaatttttaaaaatgatcaaaatgtaaaaattctacacgaggcagcaggacgtgacaaacggatcccgtgactccgtcggtgacgaggaaagccctcatggttactcttgtttttttatgctacacaaatcgttataagaggttgaagaaaaaaagatatcacaaacaaattatatctcaaatggtctacaaaagcttaactaattccaaaaacatgttttacaacatgatggtgtttcctaagaacattaatgttataaaaccagtcccaaaatcaacatcggtagctaaacgtgaaagaaacgccataggagatccaaacacgatgatgacaccgaggcatgatatttggtaaaggagttcagccgaggcctacatctccgaggcactgattacgggcgctcctcccggatccagcatattacagcgtatcagagttacaacgactcacggccggtcgccgctagcagctgctccctctcgctatgctaagtcaccatgcagttacaacaggtccacctctctatttaagagagatccaaggatagagtccgactcttactctattccaatttctaaactgtaaccgactatatacacatattcgacataaactctaacaattaaaataaaaaataagagtgaatggcaaattggactacatatcgtggactaaaaccacataaatttgcagtcttgcagattagaagggggcgagaaacattgcaccaaacccccaaattgacaactcaaatctacataatgtaaccaattcaatcaccatataagttagcaccccgttcctattctctatcttgtacttactatatttggcaactcaagccatataacacacataatttagaagaacaaatttgcatggtgttaagtgaaaaggatggttatgccctagttcaatgcgaaactatggttaaaatatctagcctaacgagcaaatcagtctaagaataaacaacttctccttttcacacaaacaacattttaaagtaattaatttcacgagaattaattaaactaacacgtatgaaaaaaccatgtgttctaaggccatggccaacgctccaagctagagcgtggtctagccctgcccgagggaaatattcatgccagctcggatgggaccgcaccctagcagaactacgcgacccacagcagagcgccgcgtttcgtcagagccgtagcgaggaaagcgtgaggaaccgcattgggaagaggcatcgccccgtgtcgttgccccacaccgggaaagaagatatggcgaggggatggatgggagagaatggcctacttgggaggctcaccgatccaccacctccgggcctgctacttggccaccctgagcaccgctacatcgatccgccgccacgttgatccccacctccgccgtcgattttctgtcgttatcacatcgatccccacctccagtacatctatctgtcgtccccgcatcgatcaacgccagggaggtagaggggagctcgagctcatcgccttcttggcggtggcgtcaaagagagggagggcagaagcggcgcagctgagaagggaaagctgacgggagaggtggtgtcgccgaggaaggggaagaggagaggcgaaagaagacagggagagggaaggtgtgggtctttatatatgtttgtgatatttaggggagcatactacaaatattgggcttatatgcgaatagaaaaacacaaggatttaaatgcaaaatatgaccgactaacaacgtccgaaacgcaaaagcaatatgaaactatggttggcactctattagggatatcacaagtgtggttttatcccatttttagcatcttctttcttatgggggctatggcttccaatggccaagcgaagctattcatacataaaaccttctcctgaagggatagcgaacgaggctttcttggcagataaccgcacaaaacctaccatcatacaacaggccactactgtcttgtgtcctcggaaaccggttcgtcccacggtacaccatcaccaactctttaattatttaggtatatacatctatcatttctataatatataacatgcattcattcacatatttcgtagcaaagcgcgggatatcaactagtctgcatatatggctcagacatgctaactagctaggcctggtccggaaagcccgtggccggtgcagttcaatatccagcctcatgttggccagctgcctctctctcatagcaaaccagctgatgaagagccttcaccaagcacaaaatgtggctgcctgtcctctccttgttggcatagaacaatgtctctatcttgctcaccctggaatctgcagaattattcgatcggcttctgataatattgcagtgaaagtcttgcacgtcgtcggcatcctccatcctggtccaaagaaacaaaataatgaagggatgttggacaagctatatctgccctttgtcttgcatgtattttgcatagtctaaactctattcagttttcatgcctaataggaagttggaatgccgtggaagaactgttattccttttttttgttttgctatttatcagttgccaggaaatttcttatttgtcagtcacctagaggtcctagaccaactgcagtttagacttgcacaaaatcttttaccaactttggtgcatcttttaatctggtatgttctttttttttaagagttcacccggatgcgtgtttttatatatgatgattttgctcactgtagttgcctgaattttttttcttggttgtcgttccactaaatttgtacggtgtgttgactaaacttgtatactcttggtacaacctttttgttcttttacagattaaattgctaatttgtgagttttggatgttgatctacttagaagagtgactaatgacaaaaaaaactgtcacttaacaaatactccctccgtcccaaattataagcctatattttttctacatggtcttcggtgacatactttgaccattaatttattccatgttatgtttccaacaaatataaaattagcatcagatgaaagtactttaaaatataaatctagtcccaaattataagcctatattttttctacatggtcttcagtgacatactttgaccattaatttattccatgttatgttcccaacaaatataaaattagcatcagatgaaaattagcatcagatgaaagtactttaaaatataaatctagtgatataacatacataatatttagcatatatatggttaatattattattcgtcaaaagttactgagcttgatttttttaaaaaagaagttgccctataatttgggactgagggagtagatggtcactctctaagtctatttgatgagcaccactgattggtggtatagccaccctaatcttgggctaattgaactgatggaagagacaagattaattcaaattaaatgattaaagctaaaccaaacaaagagttaaatgatgaacaacgaacttaagaaataaaaagaagtgaaactagttaggctataatgctctaccgtacctgttcatcgcctgttcgctagctccatcattgtaactaggtcgtaccccccgcggcctttgccgcggacccaataaaaagcataaaaaaactaaaggatgaagagacatcaacaaatacaatacaatattttggtaaaataagaattgtgtggataatctaaacattgcaaacgtataggagtaaaagatagcaaattagatgtgcctgaagccctgaacattgctaatagcatattagtttactaatgcatacggcgtgtcaataatattggcaaatgaacaggaactgcagcatctcaatacacacattaacaaatacggtacatcataggcataagaacatcatcaaagaccaagtgtgtgcatattggtggtagcatatacaacctaatgattttgcatagtgcattacatatagaggtacgcacaacaacaaacatggaaaagtttgtagcattgtaactgaatgaaggaaaggaaatgataatggtcagcctctgggtttggttgtcgtttgcaactttgcatcgatagtagactaccaggataacaacaaatagatggcaccaataaacaacttgatcaacctgcatgaacatatgagaaaagggaatcaagtagaatgccatgatattactgccaaataatcaaaaaagaatgtgttcggttgtgtttgaaaaaaaaaagtaatatgataaaattaaagttgcaagtcttggcaaagtaaaacaacagaagctgttttgaactatactgagctcagtatacatacataattatccgtaatctgtttcagtgagctgaaaataaaatgagtaaatagcacatactatagtgtgctttaagaagtaaaaaacaataggactaccttttttgtgtgtgtttgtgtatgtggagacacaactatttaactgaatgtattttttttttcatttacagcagtaagcaatttagaggaagggaaaaaatatatgcatcaatatttcctgtatttcgtgccatccaatgcagagtttgagaccatatgacatgagggtacacaaaaatgatgaacccatgtatatccaagggaagatcaacaaataataactttaaaagaaaattacctttgtatttaggtgaagaactgcacactacagtgggaacatacaaccacacggaagaagcataacacatcatatatctctcaatttgatgattttgggcaccatgcactacaatctggaaatagtgaaatatatagatgttagaccaatcgatgcaagatataaacatagaaacatagcgatgagaatacctggtaaaattaagcacgttgattcgcgatatcgctgaatatttcagtatacacgacattatgtgggatgaagcaatattatcgaattagtcctcaacgctgaattagtcctcaaagcaatattatcaaattagccctcaaccaccaattttgacatggaagccatcaccacatgtaattgcagatagtagcctcacatcacagctagcggcaactgcaggaaacagatcaagcaatcagggtcaggcagagcaaaaccacagagaaaaaaaaacagggaaaattagagtgggatgcttaatttcttaacctttacagatctctatgaattgaacagggattgggtactcaggtctgatatagggggcattcatggcggaaagacttcatggtacataaagaaaagtaacactacaaaatatagaacaaaggctaacaaatttatgacacattggttgttagctcacctcttatttgttttgcctaatatagcggcctttccctcacgttttgactcacaaagaatatattcgacaggacatggacatgatgttaaggctatgcactcacccaaatcgaactggttcttaacactattctcatgcactgatgtctggtctgacctagatggatttaaaggaaacatgaataattcaagagatagaaggaaatacatggatagtagcagcacacacagctagagtcatagaagctagcaggcagtacctctgaacccccaacccctgggaaaaaaagagcacaaattacagatgcaaccaatgggtggaaacgatcctcctaacacaccatcggatgttctatattttgtatcttgcttttgcagaacttccattgatagtctaatttaaattgggcaacaaaataatctgtcacaacattgatatataagtccattccaatttgagctaaattttatatgtaataatgaaaaacagcatatacaactattttgcatcataactcataaatttaggtgcagtccaaacatgaatttcttgatcttagtttagttctcttggaaactactgcacaatgtagccctcgagcttcggaggcctgaatctccaccaggtgtcctctaaaaaatgtgactactacataacattggtttaactaaatggaagcaggtcagcagcaggctgagtggaggagacgcagggaacctggtgtagcagcaacactacatgactgcaaacaacaatgacggggaagaactacatgactgcaaacaacaataacgggaagaaataggtcaggtgcaggaaggagaggattgaaggaggattaccacggattgggctctcctggaggagcctgagatagctggagctgcagcaatggctacgacgacccgatctttggatcggttgtggggggaatcgaacttgaagggacaataaaaatagcttggagggactatgaaggatcttctagaagtttcaatgtggggaggagcttcgagggtggccaggagtcgggctcagatcggcagcggcggcgaccatctcgtcccggtgacgaaggcagcttgcccagtatatcgtagctgttgcaaccgccaccgccgtcatcgccgtcagatccaccacgggaagccgttgccgcgggtggatcgggccgggggaaaccgccggcaccgtcgtcgccgtcggatccaccgcgggaagcggccggcgccatcggtgccgcggcactccacccctctctcttgttttccgctggtgccttcatcgtcttcgcgccgggtcggtgagacaggagggagaggaggagagggactggcgacgccggtgaggggaaggcgcggcgtgattacggctagggtttcgatggacggccaaaacaactcgcggaaggatcggacggccaaaattagagtgaacagtggaacagtgccaggctgcgcaacaccgagccgtacctcaccgaaaactagagttttttttttctatcaaaaaaaaagaaaactagagtttttatagatacaatctggtaatcacggagaacaaggaaaaggcttattgaccataccacccattttagaaaatactttgaggcaagtcaacaaatatatcagagcaagcaacgtagctgggataagattgttacgaaacgcattgtccaacaaaatcataattgtgatagaaatacaatacaattaacaacccttgttgtggcattgcttaatgttatttgtcattatgagtttggattgaggcataagtttttgtagacatttaagttttcagaaacatctgctactgaaataagaaattacaagttaattctccacgtgtcatgcattacttagttgacaaaacagtccatattgtcagtatggcagattctacattcattttctagatttctctatttgtattgtgttcttgtccatgtgtgtttgtcaccattagatgcaaattgaacagtacagattgagattgagatgatattctaatcatgtgctgatgcacctttatttttgctcatttatacaggatgaaggaggaactaataattcatatgaaaacatggctagatacatgtaatatttagaactctcttcctttgtacattctattatccactcgttcttgtacataaccttctatgcttcttaatttatatgatcatctttaatagttaatattaccttgtggattcagcaattggcacaagccattgcaacattctattcatttcagctctgacctcttcttcagatgtctacgataaaatattagtactgagatcaaatttgaaatagatgaatactgtatgatatttctcatgttgagttgttgtaaaagagagactaccttatctatggacaaaaacggcttcaactttctataaaatactaatttgatgcaaggaggaagcatttggtataatgcatctttagcttccttaggaacagacttcaagactgagggatcggttttctcaaaggccaatgcctgaaaacaatgaagtcataaaaaaatataggacaaggcataatctaaagaaagaacaatgtcaatatctgaccattaagtggtaatttaatatcatttttcatgttgaagatggcatagcaccagagaaacagtgatgtaccagtttatttatctgcaaaataacttttgaatattgcaaggcaagtccagtggaacctaacgtttccccaagcaggttgcccactgcctctacataatggtcttcaccagtatgcaaaaaaactttgttgatctccaaataaatgagcagcacaatgtctacaagtttttgtacaatctgcaacagaacatatggagcattattgtaagatatggatcagatagaacaaatattgatgacatatcaagatgttgcactacatcatccatcttcttggaccaaagtgacttcttctgcaggtttgccacagcaatcctttggttcttcactgaactaattgttatacctgcatacggcagcggttttattgaaaccggcaagagaatattcacattaaatttgtatcttatttggatgcctatgtcaaaaatttaatacaaagttacaaaccactttgtaccactgtaggtttcccctgttcgaacttgtccaacacacacatttccttatacagttcctggcaattaatagaatgagagaacagaaaaggcaacaagatttcaaaaagacaattatcatgaattagagagtatgaatcactgaccatggtgtattgtgcacgttttaatagatattgcattgcagaaactgcttcttctttgctgcatgccagttctgattccaaaataacgtattctcgagatttgtaaagtagctctaatctacattgacaagaagagcaaaaagggatacatgaatggagatgaatcaatgagctccactataaattagctggtaaaaattcatggtaaaaagttgtatttgcagggtcaaagtagcagaagaacattatgttttgtttacttgttaaaataaagatccaagttgcgccatacaggatctttgcacagctttccaagcctaataacatctaaagcaaatcttctcaactgttctctgcatagtttgcagtaaatatatatataagtaatcttggaaagttcatctacaaaacatccacatgaaaatgcatagcttaccttatgtcagcttgatgaataatgagcaattgatagtactgttctgaaatcagagtgcggacaccttcacactgaagcacaacttcattcagatgactcacactttcttcagagagggatttcataaggtttgatccactgacaattgtgttggccacctcaaaggccaggatacctatttttctttctccagaagcagcaccatcagatttcatcatatttgagcccctgaccagtattttggctactccaaaggccatgatctctatcatacttcttcttgcaggaacacaggacacggcggcggtgctttcggtgttcgaagtagatgatctagcccccagcatgctgtcaacataggttgcagcaatgacctgctttgcagtgtttgaggtcgatagtccagtccttgctatggttaaatcatctaataagtttgcagatttcatggtgaacatttgtagtgcctgtatgacaaagatgtgtcatcttagggatcatgatttttctatatgaagtataatgtgattggagaagagtaaatgacatgcatgaactccagttgggaatgcagattttatttgtatgttattgttcactatcaaggtgctggagtcattgaatgacagttgtacaggcacataggaaatttccaaaggaagtggaagaggcacttcaatccataaaatattacaaattaaataaatattttaattttacttttaaaatacttgctaatgcattagaatcttttgaccgatagaaagttatattgaccaaatggtgcatgcaccagcacaaaaaatttgcatatatattcactccaaatttcctatataatttattgatgtagattataccagcaatttgcacttccgaatttgtgtgaagatgataatatgtgtgtaaatataatagtatactgagacagactacattttatattatgatgccactgtctattttgtaatttacaggaaatatcatatatgacaaatttatagacattttaccatgtgttctaacatatcctctattgaaaaattcgatggaaatcgttatgtgttaagtgtaaactatagataccgatgcatgacactcgcattataaaattttatagtttattttacaattgcacattactttttatagtgctctagtaactaacatattctaatggtcaaactcctatgttcaaataatctgcgataacaagtactccctacccaaaataaatcaacttttgtacacaaatctgggcatagctatagttttgtacactatgtaatcaacttttgtacatgaatctggacatagctatgtccagattcgtttacaaaagttgatttattttgggacagggcatattatacaaaatatgagcgccaaaaaccatattgtttctattttcatataaactaaaagaacatccaatcctaccatatgattagtttgatttggagttcctgtggacattctatctttacagaaactgaaattataatcatccattcccaacataatatgatgagctctgttctgtgcagagttcctgtggatagtctcttatgtttccatgggctctaaaactagctctatgtaacaaaaagaacgcttgttctacacctaaatgtttttgtagataatggaagataacatccaggatctgcatcacacaaccattctatacctagttttagcacaaggaattatgatagagcatgggatgagtaatcttacctggcctacatgtgaccaatttttacactctgtttcgttaagcttttggattacatttcaagcactaggccttttctttgggtcaggatcaacacaagcgagtcctatctccatgcatgtgtatatttgttggcaacaagtcttcattgatgtgcatcccactgttcgttccaaccaatccctccaattcttaactacctaacaaattttcatagtgagaaattatgaaaacactagcttaaaattaaattcatcttacatcctctatgaaatgctggaaagattctctggtgcatatccgaggataattcctgtgtcctgttataacctcgatgattatcactcccaaactgaatatatcagatttggttgagattaatccattggccaagtattccggtgccatatatccactacatcataacatggaagttaattagaaatgatacaagaactaaacattgcagtatgtacttgacaaacttatgtagcagtagcttacagtgttccctcacgacttccagtgataatccgtgattgttcatggccgaaaagccttgacataccaaaatccgcaatttttgggcccatatcgtcatccatcaatatattttcaggtttaagatccaaatgaataataggcattcctcatgaatgtattgcaagccctaggaaattcccctgattattttgtccctcacgtgccacccaagtccataggattcagctataaaagta

SEQ ID NO: 11755 - DNA, 730 bp, Oryza sativa
caggggctacagataatatgtctgaaaccatgtgtttcacacatataacacatccaaatgaatccctattcaagataattgatgagatgacggaataccctgtcatggttcgacttgagctgcagacttatctcgcgacccatgagaatatagctgccatgttgaagggtaggccactggattctattaaggaatatgtgacccaatggataatacaaaactatccagctgctatgtaatttctttgctgagatgtttgaataattactatgcattcaagctaaatagtttaagaatgaaacatgcactttagatattatttaaataattgatatgctttggttcgaacttgtaataaagtagttcaaaaagatgtttgattgtttcaaggaattcttttagcatatagctttgccctttttactacttctatccgtattattcttgtggccaagttaactgtggaagaatctgtagtgttcttgtgacaaagccataagttaaaaaaatttgatctgtgtgcaatattatttttctcaatatgaaaagaagcggcacaaaatactctaaagagaaagatgattcgttttggaaagccaaccccaaaaaccggggcccttttaaagggccccccccaacccccttttaaaaaaattcttgcatagaagcacaccaaccaaacaagggtatatggcaagcctggcaagctggcaacgagttggcttgccct

SEQ ID NO: 11756 - DNA, 1061 bp, Oryza sativa
acatctattatatatcaaattccaatatagagtgcataggattacaagcatttacaccaaattggtatagggatattaagtctaaaaaggatatagaaaaaattgttcaaagattagaggatatccaaattataggagaaattcctatgaaatattgggagaaaaatgctatcgagtgtaaaattaatataataaacccagaatatattattaagaccagcccaatagaagcaactccgaaagatatagaagaatttaagatgcatatagaagaactgctgaaactaggagcaataagagagagtagaagtccacataggtctgcagcatttatagtaagaaatcatgcggaagaagttagaggtaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacctgtccccagggacactatgaatggctagtaatgccactaggattaaaaaatgcacctgccctatttcaaagaaaaatgcaaaacatttttaacgataatcaagaatttgtgttagtatatatagatgacttgttaatattttcaaaaacttataaggatcatattgctcacctagaattattttttagaaaggttgagcaaaatggtttaatcctatcaaaaaagaagatggagatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatacactaaattaagaaaaaatggtcagaaatattttaattctgaagacattaaattagtaagattaataaaagaaaaa

SEQ ID NO: 11757 - DNA, 6531 bp, Oryza sativa
tgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacagttaaagaaggaattgaaggaagaaatacttaaagaattaaaacaagaaatggatcagaaatttgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactctggagacacacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatcttgttaagttgcttctaaaaagatagataggtgaggcttacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtatattgtctgaagcataggtttgtctgaagcataggtgtggtgtattttgtctgaagcataagtgtctgaagcataagtgtggtatcagagcctggtaatcatagagaagctaaatttagaagctaatattggaaagttaataaataccaaagataatatcaacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaatggacatatctaggagtctctttagaagaatagcaagcagagatgataactgttctgataaacaaaaaggcaaatatgatgacatagatgagctgaaagatgttgcacaagtagataagcagctcgaaagatatcaacgagatactttaagggcaataaggcctcaacaagtatactgcatggccttttttgagaataagaatgggctttatagaatatctagagaagtagaattaagtgttctaacttagccagtagaattaaaaatagtagctaaagaatttgaaaatagtttaagatattcaggatataagtatattcaccaaggtatgtacataatagatatcaaaggaatgacaagaaagaaattaggagctaaagtgctaataaccttattagataaaagatgggacacaataaacaaagcatctttaggctatctagaaggagatatgaatgaaaatatgttgataacccatatagcgcctgattcaatgatgcctgtaaatgaattcatatataaaatgagttttggtttccaaacaaaaggatactaagagtttaagggaacaaatttattaataagtatagaatttataggaagattgactaatagaagtgcctccaaatacaaaatcaatgtaaatgatgtgatagaaaaaatgcattctaaaggaataaaattcatgagccctttaataatagactctgaagaaagagcaggagaaaaatggccaattagtgaatttataaaaaataaaaccttgagtcagcctgaaaacttcataagttaccaagacagcaaagggaatgttagtattacatctacaaattataaaaccagagacttcgcatgatttggatgcagaattatctgacagagatattttgcataacagaagacctattatatctgaattgatggaaaaattagaccatgaaagtgaaataaaatattatgaagataaattaagagatatagcagatgaatataataactctatgaaaagtgagtggcctaaaattagagacaaggaactttatttctatagagaactatccaggattaagaaacaaaaaaaagagaaaagcttggtcatagaaaccccgagaacccaggaaattaaaatagaacaaataaagtcagaagaaccaagagaagaaatccaaaagttagataaggtattaagtgaggaagagcaatgggaagtaaatgagaaattattactagagagttatgaagaagaaaacaacctgatagaggaaatagagaatatagaagaagaagataatgcagaacaatataatgattttatagactcattggatgaggaaggtttgcataatctagataatgcaatggaagctatggaagtagatttgggaataggaaaaaggaaaagatacggagagggttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaaaagtgatggggctatactaaatctagcagcacatgatcccatagactggccaaatatcattagtatttggaaggggttaatagttcaaaaatacatacaaaatcagcataatatagggaataaggtgggggatatgataacttatttagaaacatttttgggtgaatctgctaaagtcctatgggaacaatgggttgaaaagaatcctaataactatgaagagctaaaaagagcaggaagtaatcctcacaactttgcaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattttgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcacctttcttacataaacgaaatgtaagaagatataacccaaagaaaacttatgataagacatgcagatgtttcatatgtaattcaccagatcatttaagtagaacttgcccaaataaagatcaaaaaagatattctagtaaatatgaagaacaagagagagttttaattatagatagcgtaaatgaaaatatattagtatgtgatgatgaaataaaagatgacgaatcaatatattctatcatagaaacagatgaaattgaaaacaccaatgaagagtatgaatcaaccgatgaagagttagatttaattgacgaactagccggtttaaaaatagaattgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtggaactagagaatctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaactgcctttcaaagaaattttgggaataagaataccggtaaaagtaaaactatcacccaaggtatcatataaaattctagcactagtagacactgggtgtacaaaaaatattattcatgataagtacttcataaaatgtccagaaatagttcatacaattgatgataataaggcagaagtctctacagacatgtccggaataaagaaaattcataatcagctagctcataatgttgaagtatacattaatggaactaaatatataatagatgagattacaataagaaacttatccatgataagtgatgacatgataattggcctaaggtttttacaacaatcggtacaaaccacagtaatacatgagcaaggaattacttttatcccatatcaaaacaatgtaagcggcgggtatcaactagtattcctaatgaaacacgaccaatcgttgcacggcctaaccgctcgtctcaccttgaaccgctagatcgagggtgccttgtagtggctagtgcgcggctcagataagtcatcctcaacggcgatagtgacatagatcgactttggcccggtgtatatagatggcggtgaaaattgggatgctacaaccatgacggcggtaaccagaattgcactacatgtcgcggcggttccggtggtgatgcattatatggtggtgggcagaaaccactgagaaggccgagctcgactaagagcaggtacaataacagactattagccagctacaaacatattttaatgagataaaaatgatagagaataacagcgggttacagatctgtagccagttgtaatacggactctaatacgtaatgtgtatatgacaggtgtgaccatataccaatagtatagtaagtaattattgtataaaatagctattagattggctatagctgaattggagctaatagttaactatactattaaacttgctctaacattgatggcgccagtggcggtggcaagcagcatgtcaaagcatatgtacgcttgatacgatcgagattcgagaggtgactgagagctcgagccaagagaccgcgagcctgtgcccgaaaaaaaagaaaaagaaggtgatctcaaagggccaaagaaagaaagaaaaaagaaaacgtgatctcaaagggccatattctttttccattggattgggccgaaatacagtttatccaatcactcttttgagcccaaggtcagaaaattcttaaggtcatgtatttctaaccccggtttggggccaattacattacagtccttccaatctggctctttccttctatccgaattttttcgtttttagattttttttaatatttacagaaataatctatcgaccaaaaaaattacagaaatagcccctgccgccctaatggtgggcggcaagctgacgtggcagacggtgggtcgaccgcgccgtctgccaccgtcggcaaaaattgcgattaggcccttgccacccatacagagggctgcaaggg

SEQ ID NO: 11758 - DNA, 3950 bp, Oryza sativa
aaagtacggccaaaagatttttctatgttatgttaataataaataaagaagtatttattggtaaacttgttaatattgttataaaaatgtattgaagttggttgttgcgcaatttcaaatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaattttaatatgctaagttgtccgataatagctaacccctacgtgaggatccctctcctctctcaaaccgcgctttcaggccggcctcacgtagcctgtaataacaaattaatatgtcattataaaaaatattacagtgcaactaacttatagtaaaacactgttcgtacctcttgacaaaggagtcgtgaaccgtgagtagctcaccgcacgtcgtgcccggaacgtcccaagctgagccccctgcaccgcagtaaggtgagaccggtgtcggtgatctatcgccgggtccaacaactgaggtgtatcctgacatgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagttcgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacacctaggacgtggtcgagtggaggtagtgccttcacccgtagggcgagctccatctgctgctgatcctgatagtcctgcctccgccgcacatggtttctccttgtctttaggacaatgcttgtaggtgtgcccatgttcatcgcatttgctgcaacgcttcaccctgccagcctccgactcgtccatatcgttgcggatgcgatgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatggctgcatggcctgtggagcagcttcggctttgcacaagagcaatgacatgtgccgtcggctttgagaacacactcctgcttcactctcttgcggtagatacccctacctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatccagttcttctaaccaatgttggactatccgttgggagaggtccaagagcttgagggtcagcaacggcggtcgatggagccgctgcacgctgatcactgcatttggctgtcaactcatctaatttcttccaaagctcattgaattttttctcatggttctgattgcacagcctcttgaacatgttcatgagctccttgttcttgaattgcttgaagaaattagctcccatatgacgcatgcaccacctactctgtacatcttcccaaacactggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaataccatcttgcatgcatgtagagctaagaacgccctttgcagcacactcttgctaggatgttcaattgaggggaatttcttcaattcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccagttcgacttggcaaccctaaactctctatgaagtgacactgcaaaatgttttaccgcctccttcatatcttctgctctactataaatcgctccctgaataacctcattttctttgtactcccatctcacactatcctcttcagagacaatcagcccagaaaaatcctcactagcccattctgctggattaatatccgtctcatcatctgacgaatcaccttcctctacacgctcgttgtcagaatcctccctctccatttcatccacaatggcaccaacagtctccccctcgtcggccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattcattgttatgtcacttgtctgtggatcaactctcaagcccctcattaaccatccttttatagaaggtacactcctctcagccggtctatcaattcccctttctgatacaataaaatctgacagatctaccccagttggcccgtaacggaatatttgtttgttcgacatatctgtcaacgaaataactagatcatattactctttcatgcaataaacatctacaacgtaatatcttcttgtgtaagccaatgcaacggtaatgaattgattgcaagccagcatatctacgtagttaccgatatctaca

SEQ ID NO: 11759 - DNA, 7250 bp, Oryza sativa
  unsure (1)..(7250): unsure at all n locations
cactggaattgaggagagaagaatgagggctgggggctgggcagcaggccttttataggcagcgaggcctgccgcccggccagagggcggcaaggggccgcctgcaaaatagccggccccgactggcttttttgcgttcgggccccttgccgccccaccagagggcggcaagggttttcctgcaaaaaaccctccctccgtcaccgcccgttcctcccccgtttgccacgtcagcttaccgccccagaggtgggcggcagggtctatttttgtaatttttttggccgatagattatttctgtaaatattaaaaaaaatctaaaaccgaaaaaaactcccttctttactttgggcatcatggcagggtagggtagtagatagagagactattgttgttaatgactacttcaagatgaggaaggaagaagtcgatagcaattgccagcttgctagcggcacacacaaacatatgcactggtatgatactccctccgttttaaaatgtttgacactgttgactttttagcacatatttgaccgttcttcttattaaaaaaatttatgaaatatgtaaaattatatgtgtacatgaaagtatatttaccaatgaatcaaatgatatgaaaagaataaataattacttaaattttttgaataagacgaattgtcaaacacgtactaaaaagtaaacggtgtcaaacattttgaaacggatggagtatattgcgcgtgcctcgtgggtaggatcagaaggaagcaaggattctggggctttgctaatcgagcatcctttcttctccgtcgtctgatctgctcttcgacaaatcacggtcgtccgtgtggccatcctgtgctcaccaggcgccgtccgatcccgaccgtcaatcggccttggtcgatcctagccgttcgtccctgccaatcctcccggtggaccgggttcacgatggacaaccatcttccagttgttgatgcttgggacccacttgtcaccatcgtcaccggcttcgccacggctgatgcaataagtttcatttattgcatcataaatcgatatatccttgtctcagcacttttgaaattaataactaattcatgtaaactctaaaatagattattcaacttgcaagattcatttaaattcaagatctacatgtttgtttatttttatatacggttttatttcgcttttattagagttttttctcgttttgcgtgccaacgtgttagaatccacaatctcagaagaccggaaaagggttcaagagattaatcgaagatgccagacaaagtgacatatttctccttgaacaggttgaacctactttgtaaaaatgttttgtcgtttacaaataaaatgcatgctctgttaattactcgatgttggctagggctgcttgcccttagctcaatcaactcgtgagcagctcgcaaaacatctcaagttgactcgatattttaaacccattgaaacatcagctcaactcgtttagaaaactcaatgaactgagctgaacccaagccacgagcttttcgtctaggtccgtatacactacacaattcctactacacaattcctgagttcatgttggtagtaactaaattatacatgaattatacatgctatccccctgcaccatcacatattagtttctttgcgtatatatatctgactagaaaactgtcagtgcggcaacgggtaaatatgttttttatggtacaataactattaagagtcgagtaacaaattaaaacattgggatcgctatacattataattgaaaacgttaacgaaatattttcttggttttgggcaaaaagccaatttcttcgttccttttaacccagcccagttcgttacctcctccgctcagcctgcctcccttcggcccaacctacaagtggagccataggcccagctagcacaaccaaactggtgtctttgatagtgtcgtacccatatgattccggaaccgatcctccccaccaaatctgtctggatatttgttgatctctcaaaattggttgagagcttcttagccactcaatctcctctttccattttttccaaaatcggaacaatccgcaaaattggagataaaaacagcctagaagctcgtcgaccgcctatcattggcgactgttaattggagattaaattcggtgaattaaggccaaactgaagggaaatcatgggacaaatgatgagggaggagcggggaatcgacttaagacagatcaacatggtggtggcggtagggtttggcacgcgcagtggctggaggcaccctgtgtgctagcggatcgaatcagatgaggacgacgttcggaaaaacagaaacattgctattttttattaggtatagatatagataggtatgatctattagcttaactatcgtagataaataataaaagtcttataaaatcaagctcgttagaagctcgagcttagcccggtaaagctcacgagctttagctcggtaaagttcgtgttgagctcaagccgagctcaagtcgagcctgccacccatcaagcttgagtgacttgtgagcctcgcatgtttttcattacagccctagcgattcactatggcctagtttagttcccaactttttcttcaaacttccaacttttccatcacatcaaaactttcctactcacacaaacttccaacttttccatcacatcatttcaatttcaatcaaacttctaattttggtatgaactaaacacaccctaggtcagccctcaaaataaaaaatatcaatagcaacttcgcttatacactatgtaccgtgccaccaactaactagattacacatagaaaaacctactccctccatatataacagggaaatgctacataattattctgactattcgatcagaatgatacgtttgatatctggtaggtatcaactaatacaccgtctgaacaagatgatacctctaaggtattgtctgatatttggtatgtattggctgatattaaggtatcaggtgatattttagaggtatcatttaatcttaatgggataccactacgtagcattcctccgcataatatagaggcagtaaaaaaaaagaaaagaaaaactcatgagttggaagggtcccatctcatcgtgccggtgctccataccaattttctcgaatctacaaatacacaggagacgaccaccagccgcgtcacggccaagcacaccgaaattccaacgagaaccccacgcattattccgcgacgcgaccacgggaagacacgggacacggaagaggggagagagcgagagcgagatagagttcgagttctacgcccaaaaccctagcaagctcccccgccccgccccgcgtctccagtaccttacanaagcttncaaccccccaccccccaccaccaggtgagtggatctcccatttccccccctctccccgcgagctcgccccgggcgggggatcctagtcttgacccgtgtgcgtgtgtgattcattccgccgcagaaagagcgtgcttgatcgcgcggggaaggcaacgctgccggcgcgcaggtgatggcggatccgcctggcggtgggggatctagcgcttgcgtctgtgagcggagggagccgaaggcggtggtggtggtggtggtgccggagctggggagaagagcaggagagcagcggaggggaggatgctgagcgtggtgcgggtgcacctgccctcgaagatcccgatcgtgggctgcgagatcacgccctacgtgctgctgcggctgcccaccggcgtcgtctccaccgacgatgtcccggaggccgcccctgcggatggctacttcatgcggtacagatggtgagtaactcctcgagactctgaaaatcttagttgaatcagatgagagctgtggattgtgtagttctgcttgcttgattgctaaatgttgcgcactaaacttattgctgaatgttgcgcactaaactttgaccaagcaaggggaattttcgtagctttggtcaggcagatttctatgtgcttatatagttgttaaagtttggggaatgctcatttattggctcaactccttcataaatgaagcatagttggatgtattcagattaaatggtctaataagcttatcgtttgttttgtctgaaaaatggagccttagagattgtaaaatttagatgcggaaacatctatactgctgagttggaaacatagtttgatgcatatgaattgaaccgtttggtacatgtttttcaaattgcattatgacatatcaggaagcacagtttagctaatattaattgctatcatgagtgattcattgaaaagtgccattaattgggtggtttctgatgataaaacaagtgttattagaactatgggacagtagcaagtatttttgatatggggtatgttatgatggcttgagaaatgttgtcgtgcaagaatgttagtagtatccatcttcgatggaataggtatataacacactttatggtgttctgttggatcatcctatagttcctattgaaaggccctgttctatgagttctatgagtttctcctcattgtctgttgagttgttgtagaattggatccattacgctgataataaacatgattttatatgctcaagatgtgcaaatagcactgatgtacacgatgcttatagctagtttctgtgagctgataatgcaaaacactagctctttaggtggcctttgttggtttcaacacttccagttccaatgggatttggttataatgttttgatttactccttgaaggtaccgtatacaaagtgatcgaaaagtcgcaatctgcagtgtacatccaatggaacaagcaacaattcagtgccttggttgcgtcaagtcaaaaatacctgttgctaagagctaccattgttctgctaagtgcttctctgatgcatggcagcaccatagggtcttgcatgagcgagctagtagtgcattaaacgaaaatggagctgaagaagaggagctatttggcagatttggtagcactggttctggggttcttagtactactggttctggatcgatgtcaaatcttggacagagtcctggtttgaataatggccccgtgcctttatatccttcaggcactgataagaactcgggtgaaacttggtatgaagtggggcgcacacggacatatacaccaactgctgatgatattggacatgttctaagatttgaatgcgtgtctgtggatgctgaaaaaaaggtacctgttggacctccaacttcaattatgacatcccgtgtgattccagcaccaactccaactccacgtcgccttatccaagtgaatggagatgttttgagtcacttagatttggacagccaaacatctttcgggacattctcagtgctgtcctacaatattcttgctgatgcatatgctacaagtgacgcgtatagctactgcccaacatgggcactttcttggacatacagaagacagaacttgatgcgtgagattattggttatcatgctgatatcatctgtcttcaggaggtatcatatatatcaactaaatttccctattaacttttttggtgatttgttctattatttcccccacacagttacagttaattgaatgctatgctagattatggtggttgggctgctgtttcaactgatgcaaattttccacacttacctagagttttctgaagcttcttgtcatattatgctctaataatacttgattggtctcatcattttgaactgaattcatataataaaaatgctaagaaacaaaactgccctaaaatagtattgtaggttgacttctttgtgaaattgaatccataagtaatctaccttcataaaattaagttgaatcctactgttttcaggtgcaactgaaccacttcgaagattttttttcacccgagcttgataaacatggatatcaggcactttacaagaaaaggacaacagaggtatatttgactgcatctggttctattataatacgcatttatacgcttcaatttcttatttgattctgcttcatgtttttaaaggtatatactggagctcctcatgccatcgatggctgtgccacctttttccgtagagacaaattttcacacgttaaaaaatatgaggtacggccactgctgatttgagagtggtatgctaatctgcaggctgcagctatctaatatttcttgtacctggttgttcaggttgagttcaataaggctgcacaatcattgacagacgcaattattccctctacccaaagaagagttgctttgagtcgattgattaaggtatgataaattaatagaagaggatattgcatgctaatttattccattgctgacttttcattattgctggttctgttttctttgaaggataatgttgcactgattgcggttttagaagctaaattcggcaaccatggaactgacaatcctggcaaaaggcagcttctttgtgtggtatgtcaacaactctgcttcagagaagcacttagatgctaattgttagcagcattctgaagggatcagttaaatgttttctttggacaacggatttggactcattcaggcctcgtttggatgtgtcgaaatccgaaagcccagtccatatatgcatgtatgggatttcagttcacttttcatggcttacatgtggatggactgggattgaggcccatccaaaagatatgccttgggagaactatgcaaggtttacatgaaattaagatgcatccacatctctgaatcttgatgcatggctttagtattacatgtttgtcagggtgacctatctttaattgactttttttttggtgggggaatgggggttgggggttttatacaattcttcataccgataaacagtcttgacttgatgcattatggcgtcatgggggtcgcaggtctcatcactttttcaactgttctcactctgcaggcaaatacacacgtaaatgtccatcaagacctcaaagatgtgaagctgtgggaggtctgtgccatcacattttctttatgctagttttgtgtaacatcttagaatttcagattgacactgtatggcttttgcaggttcaaactctcctaaaagggttggaaaaaatagctgttagtgcggacattccaatgttggtctgtggggatttcaattcagtccctgggaggtgtgtataaatatgctatcactgtagtatttatttggtaaaattattttgaaaccatggacttctaa

SEQ ID NO: 11760 - DNA, 8215 bp, Oryza sativa
taaaatatattggtctggtgatcccttttatcccatgatcaaagaactcttaccaagggtcttgcttgtttgtaggtgagtgcatattcttcatttgcaagaatggtcggtgtcggctatgatttggagcaccagcggaggaggatggaccctgcaacaaatgaaccacttttcacaaactgcacacgagatttcactggaacggttgattacatattttacacaggtcagttcctggaccagtttatatctgtatgctttgatattataattttgtagcttcagtaaacatcttttaaggattacacagctagtgtcatgaaacatttaatgatggcccacacttgctttcgtatttcagcggattcattgtcagtggagtcgttgttggaacttttggatgaggaaagtttaagaaaagacacggcccttccttctcctgaatggtcttcggatcatatagcactcttggcagaattccggtgcaagcctagaatcagacggtgacaccttaggtatgtcataagggcataaccacattttaattatactgtaggactgcggtgctctgattttgctagtgcaaacagcacatggctcaagtaagatttggtgcctgcttcgctgtcaaagtgccacatgtgcaaatacctttaaattccagtggtttacatttgtaacaattaaagctaagaaaattgttttttgcacaataactcatctgaaagtacgcagaaatcgtcattctagtcatgtttgttgttgtccatcacctcatttcatctcggtgaaaagtaacataacatgtagtggatcttgtctattatgcgcaacacacgacaccctttcttcatttgatgttccaagctgactgactttcttcaggtcgcgaatagatggttaacttcagcacccatgcggtggaacattcttccatggtgtgtgggacttgaggagggatggacgaaagcggatcctcggggaaggaccaccagcaccagcaggcttagggtagtggcctcatgaaagggaggcttgtaatgttgattacctcttacatttccaactcatgatgtttttaagcggccccattgtaatatcactttctatagaaggaaagatctcctgagagagagacatttttatgacagattcagatgccatcatggctaggccatttcaaattttcaatcccttctcttctagtactatactgcagtttttttacccaaccctgatcgtgcagtgtgtacttgttggaacttgtcaaacttttatggcaaattttagttgttgcagggttgacaaatggggagatgaatggttggtgctttggtgggcacctgatgtcttggccatttatacaggtactgtggttttgctgtttgtacgtagtatagatggtagttagccttggtgtccatgtgccaccgtgtcatgagttggctggaacatgttacatgtatttggcttattctaatttggcttgtctgatctgatcgccaccaaacgctcaacatttaggcgatgaaaacagcgagagatcgctggagataacataaccccgtggtgttaatgaccatcgggtatcaagctcaccaatcttgatttggtcatggacattactaatcgtactcttggaagtttctctcttcgttggttggtcaggtctattgggacccacttgcagcgagaggagtggtgggcccacccctcgtggcgcaggtcgatgctggactgggagtgacgggcgcgaatttttacttgtttgaccccgcaaccgcgtgatcttcctccggtgttttgtcgctgacacctgggccccaccagggacaacatgaccgctgccgtgcgtggccgccggggacccacacctgcggacgtgtgcaggtgtccgctaggtccgtcaacggccgtcgggcaacggcaaaggatgcttctattctggagttattgctgctgtttgtttggacggtttcatgatagtcttaaagaaagctcgttccactaagagcacccgtaatggtaaagtaaggtgctctctataagacatgtacatctcagcaatagactagattaatagtaaaccacctcaatagtatgtctacatagatatctatagctctctaatgcattgtctcgtttttctctatagactatctccaggttagtagatagttttgctctctctcttcatttaatctcttccaagtagaaaaatatgctgacatggatctcttgtagagagtctatagataactattgtgggtgccctaatggcatctcggagatgagaaattttaagacacatgatcgagtatctatgtcaaggggtgtctaatactagttattattacaggatcaagtcactagagattgtttgtagtggctatattggctatgtatgatgtataatataaagcataacaaataaaaactttgccacatttagtagtttgaaaatataatatgtacgcaatggccaaaaattgatataagtatgattatattatagttgtggtggttaacagggcatttttctaacatattacgtggtagttatgtataggcaactaggcatcacaagctttcatcactacagataacaagttctacgaatcctatttgatgataataggaggttttatgtttcttaaacacatattaacaaatgacatcaagatctatttcctttgaaacaatgccatgtattcaattgaacaacatatacaataaaagttagagaaaaactcacaataaggatttagtgataaacattgcaatgaaagaaaaatgaaaaatatggtggatgatagatgatatggctctagcatttacactcactctctcgttttagtaaggataaaatggtaacctcttcctacatactactatctctctactcaatcttacctaatatcacagtctcatggtgcgtcgcgaacttgatccaacaacaggatattactatggtaagccaattgctccatctaaggtgcgtctccttgattgaataatggacatttgctctacctttatatgaagtctatcaaactagttgtacttttcaatatgatgataagtatagagtaatgcttaatccagatacgggctcatgttttagtttaagatcgtctccttaacattatctttattctataattataggcctattgtttgaacaacaagcacaatgtacttgtcaaagtcgaaaatagcataggttccaagatcaagtggcaataattacaatagataccacaatgtgttatataaggggggggggaatgtgacatactgtcagacaatggtaattattatagacaccacaatgtgttatatgtaaggaaaaaataataaggggaggttcacctaaaaaaccattgatccttaacctcccatgacatctccctgcaacaaacaatatataaataatgcaattaatttgcatgcagcatccaatagccatatcacgtagtctcattcaatacttcttgctagataatatgaccatattttttatttttacccaaatttctattaattttagttatcctgatcagatggcattgatacatagtacattaagaaaaatcaatttaaaactggatatgacatattctagtataatgaatctagacggatgtatgtccaaattcgttgtaagagcaaggataataataggctataagcaagttatatgcttatgtggaagagagagataaaaaaaagtggatagtgttggctctcatgcaagagccagctccacacaagctccaagaaatatgcattaaattcatagagtgagaaagagagagaatggagaaaataaggttaaccttatagctgacctattatacaagttagctctaacatagacatagtaagcagtgagctctactattaaatctactctaataggatgtgtcacatctaatactaggttggttttatatgagacgaaggagcaggacagtaggttattctcccaaacaggaaaaagcagaaaacaaaaagtcattcgttcatatcatcatacgctgtactgtactccctccgggttgataatacttgtcgttttagacaaggacacggtcttcaaaaaataactttgaccattattttctattataatatgtagaaaagtgttaacaaatatatgatcttattaaagtattttttaagaccaatctatacatgtagtcaccatatttgaaatacaaatattttaaaaataattcataattaaagattgtaaagtttgacctcacccttgttcaaaacgacgagtattatcagcccggagggattacgtttcaaacttgacaaaaaacgccgttatcgaagcctccgtgaaattccaatcaaattcagggtgcaaaccacaaatgccccccatttggaccatttgcctctcttcctcctctccatctccacgagaggagagaagaagaaaaggagccaagcaaaaaaaaaaaaaaaagcgagcacgcgaacgccgcgtgatccaaatcgaatcgaatcctcctccgccgccgacgagggcacccgccgcccgccggtgagcccgcgcgagcccggccggattcgattcggccgccgcccggttgatccgcccccccgaggcggcgggtggtggttccgagatctcccggcgagccggaggctcctccgcgtcggatttggcgccgcgggggaggaggatgggctcgcggataaaggagatggtgcgggtcgccaccgcgcggctcggcggggagccgtcgccgcgtgggggcgcggggaactccgcgttcggccgcggggagtcgtcgaggacggcgcggctcggcggcggaggggccagcctgaggcggcagccgcagccgcaggcgccgtccgtgcggaccatctgctgcaacgaccgcgaggccaacgcgcccgtcgggtacaaggtgagcgcgccccctcctggcggtttgatcgatctgttgagagtttcgtttggaggaggaggagggggctggtctaggtctagatctcgttgcttttcgcgcgttccttgctaatatgtggttgtgctggagataggtgtgtcaatgagctgacacagaagttttttttttttttaaaaaaaatttccctgatgctacatggttttgcttagtttttctggactggattttgttagtcatttgggttgcattaatggagaactatgaggtcattgggcagatttgagcttatctagcttttggaattagtaatttaggtagctattgctaaaaatgagatgtagacaccgctcggtttctaggcttgaggaattatagtacaagagctgaacgatgctattcattcttgccccaatattcaccagatgcatgctgtgtcggctactgaacctggatcagtccgaccacaactagctcaccctcaccacttgatagcaccaagctaaattaaatttagtttttacttgtaagacaaccttatgtttcaaataacaagattgtggatcatgccctgatattgtgagtgcattgatgccaaaatgccttaatggaagggtgtttcaggtgtttcatggtcataccggaaagttctcaatttattctctttcatttggttgaatcctatcggtcaaaatgttcccttttcctccctgcgaaactgctttgactatgttgtactccctccaggttgaaaacaattgtgtttatggacaagactgatgtccaactttaaaaactgactatgaataacttctataaaatattttctttagaaacatggaaaccatatgtatagattgatcttaaaatatatttcaataaaatcatatatttgttgatatttctacatatattgtaatagaaagtagtgatcaaagtttgttttttggagaccgtgtccttgcccaaaacgacaattattttcaacctggagggagtaaattggtgtattcatgaattttcttttcaccacagctgtatttgcccccttgtttcatgtgttgtctctaaggattaaaatgcatcaacaccattgctatattgctaacgtggttgtagtttgtttgaccatttatgcagttctctttttaattgattttgcagtttcccgcattttgggtatcaaactgtcaattatgcaaatgctaatatcaggacgctacataattttggttgttttgctgttgaggaattactgatatatttttctctttttctataacgtggttttttacattgcctgttctcatttgcagggaaattctgtgtcgactacaaagtataacgtcctgacttttctacctaaagggctgtttgaacaggtattacaacattgtttctttgtccattacatatgttgccaatagagaaaatttaggtttaatctccttttgtgatgaatctaggtattgttacgagcatcataaccatccttgtcaaatcaataaacgtttaccacagtggatgtttcccatggctagattgctgctttgcagttattgctgtgacatcaactttttgttccataaaaaaaataatatcaacatgtgaaccttgtgtagtttatctgtttattttgctttgacagttcaggcgggtggcaaatctgtactttctcatgatttctatattgtcgaccacaccaattaggtatctctatccgacacacccctgcacgcacctgtgctacttttggaatccactggtttcatattgacatgttgagcacagcacttattcattggttaattcagtcatcgctgttttctttttgcagtccagttcatcctgtcaccaatgttgttccacttagtcttgtgcttttggtttctctgatcaaggaagcttttgaggactgggttagtattccaccattcctcaattctctattttgttatgctttctaaactaagataaccgacagccttacctgtttctttttgctgtttcttatacagaaacgtttccagaatgacatgtcaattaataacgcacatgtcgatgtgttacaaggtcaaaagtgggaaactactccatggaaaagactacaagttggagatattgtgagggtaatgtcttaaatcttccttacaactacttttttacccatctgtttgtttacggaattattgcgcattacttcttattgtgtgcggactttaactctggcctcaaagtaaataagaaaaactaatagtgatggcatttctttagagcagatcaaacaagatggttatttccctgcagacttgctcttcttgtcaagcacaaacccagatggtgtctgctacatagaggttcatacattcgtttttaccttttccgctattctgcacattttcaaagtgtagtaaataagctacagagatatctttctctaaactgaagttctgttgaatatatttttgttcatcttagacagcaaatcttgatggggaaaccaacctgaaaataaggaaggctttggagaaaacctgggattacaaaaatcctgaaaaggcttttgaattcaaaggtttgtgcatttttgttctgtggcaaggtggttgtaacttatagttgttgctttgttggtttggaaacttttcccttcagtttctctggttattcttccttggtgctgttttgtacttgacttccataaaatgggtttacaggtgaaatacagtgtgagcagccaaacaattcactgtatacatttactggaaatcttattgtggacaagcaaaccatgccactctcaccaaatcaagtactactaagagtatgtttattcttgccgtttagttcatttttgtctttttttttgtccattataaaatattttgacctatgttttttgtgtattcctagatttagcatgacatgtttttttcacactccaatgtatataaaaaaagagtgttatcacttatcacgggattcatgagcagatacgtgtaacttactaactttgattaactcttttatatgaatgttggccacacaaaatgatgtcagtatatttaccacagaaacctctgatgattatactctgtccagaagtataaggatacgtagagtttgaaatttgtcaaagaatacaaggacacccacacctacttcgttatctcagccaattataaccatccctcacctcaaccttaatctctccacaaaacacgggagtacaagttttgcaaataggataactgtggtgcaaacactttaaagtactccct

SEQ ID NO: 11761 - DNA, 6891 bp, Oryza sativa
tttttgttcgcatatattttctgaaggaaaaagtctagttctgttcgctcgactcctcacgtggtttgatttttgtccgtcaacttcaatcccatgccataactatcatagctacctaaataatgaccctaggccagttttgcaatcagtatttagtgaggtggactgccatatcatccttcttttgccatgcctaccacatcatctccctaaccctaatttcctaaaaatgattagaaaaaaaaggtgaaaatgatatttataaatggataatctagtgggtcccactattttttttaattcttttgttcacttattcgccatgtaggctgtctaataggatgctacttacctctacttaagtcttatactagtcactgcaaaactttaaatatattcgttgttagtagtcgaaatacaatattcgtagttattagtagttgaaaacttgaaatagaatacttaattcttatactactcaccgcaaaactttaaatatattcattgttagtagtcgaaatggaatattcgttgttagtagttgaaatagaatatttaattcttatactactcaccgcaaaactttaaatatattgattttcctataaaaaatggtttcttgcatcccctatacaacaaagaataacagatgcacggttgatatacctacaattgctttcagtgaattaatttaaatatctagttatctgtacaaacttaccgtctgtttttttttgtcaacagtggtgtgtttattaatgagaaatatttctatcttggcttgcgtggaaaagtggaggaccagtttaatcctaagaacaaatttgtggtacatactatttctgatatatatactatagcttgtttgctgcatgtggccttatatcctatttctgttgcaggtcaccattttaaccatgtttactctaataactctatattcaacaatcatccctatttctctttacgtgtccattgaggtattttgtccaacttctcatttaatgcaacctacatttggacttttggagctcatgctagctttggatgcagatgatcaaattcattcagtgcacacagttcattaacaatgatctgcatatgtaccatgctgagagcaacaccccagctttggcccgaacttctaatctgaacgaggaacttgggcaggtaacttgtaacattattatctgttggtttgaagagaacccaggtttttggtcactggaatgctactgtcttatactacacaaattgatctggctaatggaatggcacaacctcattgtagtaaatcactccgaaaattgggattgcttggggaatgtggttatttgacaatattgagtgagctgatcccacttaataaacatgtagaattgcttcatctattcaacatagatgcatccagtctagcatggttatgggagaccacttgaataaaactgctcataaatgcatatagtactggactaattctcatgggggcattctgatatatttcaacaattaaagataaatcaaacatttctgagttctgaaatatttcctcttaccctgaatttctgtcattaacacaatggctcaggttgaatatatattttctgacaaaactggaacacttacaagaaacttgatggaattctttaaatgttcgattgctggagagatatatggaactggcatcacagagatcgaaaaaggtggagctgagcgagctggaatcaagattgacggtgatgaggtattcaacatttttcttgtcctttaatagattatttgtgttactattcttattttcgctttattcacctcatcagggtaaaagatcaggtgctgcagtacacgagaaaggattcaactttgatgatgccagaatcatgtgtggtgcatggagaaatgaacctaatcctgaagcttgtaaggtagttattatagactagttcagctcttgccttgctccagtgtcattaccccccacccacccctcagttatctttgttacccttttcacagttttgtaatgtgctagacagccaatatctgtatgctcctgtttatctctaggaattcttcagatgccttgcactctgccatacggttcttcctgagggtgaggagacaccagaaaagatcagttatcaagctgcttctcctgatgaggctgcacttgtggctgcttcaaagaactttggcttcttcttttataggtatttccgaactttaacttattttcagtaactcttgcacagttttattcttttatgtatttatccaatcagaatgtctcgaatacattagttatggtgacatttttgtgcttcttttatagacgtacaccaactacagtcattgttcgtgaatcacatgttgagaggatggggagcatacaagacgttgcatatgaaattctgaatgttctagaattcaacaggtgtggtttgtttgtttccattttaaattctgtgagatgaaattatagttctgtccttgacactactcaactaacagtacaagaaagcgtcaatcagtggtctgccgtttcccaaatggaaggcttgttctctattgcaaggtaatacgcggagaggggttggttcaacttcattctgtacatggttaacttgtttcactaacctgcatttttttttctaatagggcgctgacaatgtcgtttatgaaagattagctgatggcaataatgacattaaaaagatcagcagagaacatctagaacaatttggctctgctggcttgcgcacactttgcctcgcttatcgagatctcagcagggagcaatatgaaagctggaatgagaagtttattcaagctaaatcttctttacgtgatcgtgataagaagcttgatgaggcatgcatcttttggttattttatttgtatactgtggaaatgcccttttttattttctgagctcgtataatttgccacaatctggcctgttatcgttgcagtatgttttttcttatcaacactgtagaattactaataaactattgaggcctatccttttccttttaaattgcaaagtagcatgagccacaacctataatgtcaagtgtccgtctgcaatttagcaagttcttttcccttctttaatctaatttgttaacacttgctgctttgaacaagataatactactacttccaatatcttagctttgtttctttttatctaagagaactagaattttgaagttgtttattcttctattcctgggcaatattgtgatgcacttttttttttcatccctgtaggtggctgagttgattgaaaaagaccttgtattggtagggtgtactgctattgaggacaaactgcaagaaggggttcctgcctgcattcaaactctttctgcagctggcataaaaatttgggttttaacaggagataagatggaaacagcaattaatatagcatatggtgatatttttattcttaattatattgctcatgtcgtttcttcgattttttttcttgagattcttttcatattttcctgtctcatcttatatctaaatatatagaggatttgagttgattctctgctctgcagcctgcagcctggtgaacaatgatatgaaacaattcatcatcagctcggagacagatgtaattagagaggctgaagacagggtaagatgaacatatatcattgcactgtgaaattgcaagggcatgaaacattgtttttgagttggtttattttatctttattatgcttaagcgaccataagtggagactttaatggttgggtccagcctgaataactacatgatttttgatatgtcactggttatgagattgatatgtggtctcatgggtctaggacccacacgtgtgaggcatcagtttcatagaacatccaaagttatctatcggtacttaaggctttgtcttccaaagtacttaagaagtaggttatacaagttcacttgatgcctgggtttggtatatacgacattaggactttctttgggggagatatagcattgacccccttcctatatttcagaataaagagaatgatgtgatattctttaatagagttctgtggatcgcgttgctttagtgctttaatgtctccattgtattaacgtatgtcttgtgtacatctgtttttttttataattttgtttttacttggataaaaaaataattagctacattgcagcatctgattttgtattctaacttttgattctttttgttgaacctaactgtgccatttataataccggtcattttcagggagacccagtggaaattgcacgtgttataaaagaatcagtaaaacagagccttaaaagttaccatgaggaagcccgcggttctctaattagcacaccgggacaaaaattggcgctcattattgatgggagatgcttgatgtatgctctagacccaactctgcgtgtagatcttcttggtttgagtttaatttgccactcagttgtatgttgccgggtttctccattgcagaaagcacaggtaaatatcgtttcttgctgttattgttgttaattatgaatgccttccttcttcccagggaacagaacatgtcattttttatgttccgggttatctgtagttcttacctagatgctttccagagtgcttaagcaataaactgaagatatcggtataaggaaataatcattttttttctgacaaagtgtacttgaaaagatttgttatgttgttaatcatagtgcataagatgcttttattagtgccaactcaaatctcattcttatgtcctatttttagttgcacacattttatttcgttattaaccatcagcagtcttatctggtttgttatatttatttcttgcataacttatttggttagtacaatgctgaactgtaaacagctgacacttgctcatgttgtgtaggttgctagcttagtaaaaaggtgcccataagatactctcagtattggtgatggtgctaatgatgtgagtatgattcaagctgctcatgtggggattggcatcagtggacaagaaggaaggcaagctgttagggctagcgattttgccattgctcagtttcgatatcttaccgacttgctccttgtacatggaagatggtcatatttgagattgtgcaaggtatagtttagttctttgcagtgtagatttgtgtatagttcaagaaactgatgacttgatgctttctgttgcaggttatcacatattttttctacaagaatctgacatttacgctaactcagttatggttcactttccaaactggtttttccggtcagcgattttatgatgactggttccagtccctttataatgtcattttcacggccctacctgtaattatggttggattgtttgataaggtatgtaacttgtattcatttctacttatggagtatactattctctgtgcattacacttaactgatccctttcaggatgtgagtgcgtctctgtcaaaaaaatatccgaagctttaccaggaaggaatcaggaatacattcttcaagtggagggtgatagcagtgtgggctttctttgccttctatcagtcgatagtgttctattacttcactgcagctgcaagtcggtatggtcatggttcatccggcaagattcttggtctttgggatgttagtacaatggctttcacctgtgttgtggtgactgtgaatctccgacttctaatgtcatgcaactctataacaagatggcactatatcagtgtagctggcagtataacagcctggtttatgttcatcttcatctactctgcaataatgacatcattcgacagacaggtgggatagttcatagattactgaaaaatccagtgctctggtatgactattttattcctataactgcattaacttcgtgctgttttctttctgcaggaaaatgtatattttgtgatttatgttttgatgagcacgtttttcttctacctcacactattgcttgttccaatcatcgctctctttggcgacttcttatatttatcgtaagataccctatctttgttatcacgttgccccttttgtttctcaatacttttctagctgtgagcctgtgactgacttattactagctcttccttgattcctccaattaaattgtgttggtttgagccttttgattttaaagcattccatggtataaacaaaacaactgaatataaaccatcctgatgtgcattatttgtctcagaattcaaaggtggttcttcccctatgactaccaagtaatccaggagatgcacagggatgaaccccacgagtacagcaggatacaacttccagagacaagccatctaagcccagaagaagcaaggagctatgcgatctccatgcttccccgagagagctcgaagcacaccgggttcgccttcgactccccgggatacgagtcgttctttgcatcgcagcaaggtgtcggtgtgccgcacaagccgtgggacgtagcgcggagagctagcatgaagcagcggcagaaaacgggaggatcataaccctagtagcgcccctaccttcctggccccccccattttgtgtaaagtttttgtacatcacatgcttttgctggcagaccacaggagagtgtgtataagcttgtagctttgtagccatttttcgtgttttgtcaccgatatgttgtgttggcgatgttagcagaggccattgatccagttggctgcagaattacttaggacacgccctttatttcaaaacaaggttggaaactgggaatgcagttaatggcgaaattctttctgacgctattgcaatgtttagtccttttgtgctaacctctattgtggtatttctactatatttgataattggtgccgatgccattttgctacttctatga

SEQ ID NO: 11762 - DNA, 19565 bp, Oryza sativa
  unsure (1)..(19565): unsure at all n locations
aactcaatcctaaatttagggtttaaaacttacaccatccgttcaatagaaaactcaatcctaactacgaatctggacatatacgtatagaggttagtagttaggattagactttttataagatatagtaattaggattagactttttataggatccaatactagcgacggatttggacacattcatattaagatttatggttaggattgaagggagtagacattcataatccaagaaattggtttgatttttaatctattgatcaaaatttagggtttgaaacttacctcctctgtcccaataaaaaaaagtcaacaatgcttgttcaggttcgtagctagtatttacttcttctacatgacccaatcaactttttcataactcaagaagtaattgtaccaatttttgagaaatccaattcagttaagacaagagaaattaaagagggcaacttttcagccttatgagttgccattctacaggtgattcggatattgcataagctaggtttgattccgacccgggagattcggcaaatgtaggagcctggtttgccttcatcaatcctgaatattgacaatattctacaacgcaatgtatcgaattatcctagcctggcaaactcaattatcacaagttctaacactagcacttgaacataagttgtacaaaacactcgcactgaatagtggaggaagaattacgagtacttcataagatcgtcctgtgtctatcaaatgtagaatagttataaagatcaaacacgcccagatcaaagaattaaactcataaacgtacaaatacaatgtgaagcaacattaccgaagcacaacgattcccactacaaatagaagatcaaggaaattgttaactacctatgataattctaaaacaaattgtgaactacgggtgcgtttggatccaaggctagcaggggcctagcctggcctggcaaggacagtcgtttggaatcagaaaaaaatcctagcccatgggggcgagctagcccataagagtgagaaaatgatagctccaactcctgtttagggcctgtttgggtagagccccaactcctaaatttagctccaggagttgggtctggaatggagtgtggagttgcctaaacccagctctacctctctagttcattttgtgagagagctctacccagctctgctcccattttaggtgaagctaaaactgttaggctgagctccagttccagaagaggtggatctggagctgtgccaaacaagccctaattgtccaactcatggatcatgaccctaagcatcccaaacaaatactcactctgttccaaaatataagaacataggaccggatgtgacatttcctaattctatgaatctggacagccattccaaaatataagaacctacgaccggatgtgatatttcctagtactacgaatctgtacagcactaggaaatgtcacactcggtcctagggttttatattttgggacgaagtgagtagttctaattgctaacccataacaaagataaacacagatggctagaacatccatcatggtgctcgattcgcgttgctcccttgacacgctcacacggacatctcgctgtcgataggtttactgcatatcactgaaagaataattaactataaatgtgaacacccgtatcaaatctagaacttacacctagaggaatttggtccaccatataaaatctaaccagttgaactacgctcatttcgcttcagctttaacattctagttctagaaagaaacataatcaggtctttcttattaacttcgggattcagtactaagttaacgaggaaccgagaaactcctagggattttccagctagcttcacaatgtggtggactagatgacctgggtttaaagccccactctttctaattatttgatattacgtcattccctaatattcgtgtcgaagtttacgaggaagcaccatcaatgtgcggtgtggagcagtagatacacggcttcatcactagttttcaaattatgatatccacgagtataattcgtgcatctttaattagtttaaaattatttatactatcataaatactaagttactccttgtatttcttttttggtatcccatattttcatttttactccttccgtttaaaataaattcatttttttcctcccatttatctcaaattaaattcaattttcaataattatatatctgagtttatgaaaataggagtaaatgtattagcaatatataaactgaggaataactatattggtattggataaagtggatgtattctatttttctattttttattaatatgtgtggaataggtaaaaaaataaacttatttaagacagaaagtagttgctatagttgttgtagggtatgttttgcacggttgcagctcgagcccagtcaaacaattttagctccacctaaaattggagcagtggagtgctatccatttgtttttcgttaataaaatcagccggcgatcttccttcggaaaaaatgggttcacccagcaacaatcgagaaaatgttcacaacacaaattagagactaattacaacgatattatgaatgcagattgtgatccaaatacaatacaagttacagattatatactctcttttggcaaaagaatcggttgaatcctgccggaccactccaaacaacattctagtgacgagacagattatttttctagtgctatcttcctcagttatttttctccaaacaacattctagtgacgagacagattattccggtgggccccactcctgactttctgtactcctacgtggcaacttcagcctcgttctaccactacaacttcaagtagtttttgttctttgtttgagccttcgctgccgcagcaattaaaaccccgtcacccagagacaccgtacttcacgccgagaagctagcgacggtattncttaatttgctatgctctctccgtcttcaaataatataataacgctactactccctccgtatttgaatgtatgacgccgttgatttttcaaccaaaatttgaccatttgttttattcaaaatttttgggcaaatataaaaatatttatgtcatgcttaaagaacatttgataacgaatcaagtcataataaaataaataataattacataactttttaaataagacgaatggtcaaatgttagacaaaaagtcaatggcgtcatacattgaaatatggaggtagtagtttttaaacatatctattgcatttttataattatcttgtttcaaaatttgacgtaaatattatttacttttgtcacgacttgattgttttatcacttgaaaaatgacttattatctacactaaatttttaataggacacaagttatcaaacatatatgcataaatataatgtctgtaataagttaagtaaatcgcgctaggctatgtatgttttgctcaatgtatcctaaaactactaattttcgatatatttacatcttttatcaaaaactacagctttctaacattgaaaaaaatatgattcactgtctccctttcattaaaatgggatgaatattttcttgaagcttttaatgtagttgtttgataaccgcatgactaattttgtggtatatacttttatgataaatttgatattaattgtgtagtttcatgacacaatcttaaattcgtagctagattagtgtatgggtacttttgtcacaatatactctaaggcatgatcctagagtatgattaattaagctttagctaaaataaacttaaaaaatagattaatatgatatttataaacaactttcttttttttttgaaaaaacacatcatttagcattttggaaagtgtaccatgaaaaatagagagtagaagttgggaagaggtgacaaagaacacaccctaataagtttatagaaaatgtaaaatcaaataagtgcattttaaaatataccgagtattctatgataaatttaataaaattaatttcatgctatagatgctgttatgtctttatataaattaattatggacaggcttctgttcggcatgagtggacaattatggaccgagtattctaaaataatttcatgctatagatgcttgttctccgctcatatgtacgttttttgaagtgctaaacaataaaaaaaaactctaaaagaaagttgcttaaaaattcatattaatttattttctaaaatttaaaaaaatagtacttaattaatcatgttgtaatgactcaccttattttagtatcttttcatatcttttaagatctttttattttccccttctctcaaacataccataatattatacgattccccatggcgcccctggcttatcaaataaatcatggatttcgtctaaggaaaaaaaatgcagaagatcaagaaaaatagagaacaaaagtgttatgtgataattctagaagcatgtagtaccttaacagttttttaaagaaaaagtagtaacttaacgatacaacatctagaacagttcgattagatgtgatcaaaaggatgtactcccacatatgctgatccacttaaaatttgcatatagaggtatttacttatagaccctaagctgtttttatttggaagagtgatccaactgtagaaaccacttaggatttgttgccactttataacatatatattgttgagaattatacatttccatattattttttcaaataggaatatcacaaatattccatttcatatatcttttagaattaatcaataaaaataaaactattttttagataaccccgtacatttgatctccctagctcttaagtatatgaatttcacgtacattggtctatccatgtgaccaattgacttatcttacactactccctctaacttgactttctaacttgactttgtggaatatgtctaactatccatgtgggtactatcaatatgtgttctcgaggtgaatttttttcattctaatattttcttttttattggtctctttgcttccgtttgtacagagtcttcgaatctccaaaaataaaaaataaaaatgatcatatgtatctcgactaggaccaacaataccaccacaggctttattaatcggcgtgtcaactggcacgcctattttctagttgaacttattatcggatggagcaaatttcatagtattacgaatctagctatgccgatcatatgttcttataatttaggacaggtagtatatcatatagcgtgtgagtaattgtgtgttggggcacagcacctaaattatgagaacgtagtcctggataggacatatcctaatacttcaaatatctccgtccaaattaacagtactacatcacacataacataggttcttatattttgatacgcgagagagtagataattgacagtaggttcctgagctagccgatcgatggctttatatataccaagcgccggccgtcagcgaactcgcgccggttagttcgtcgatgtttctttctgcgtgcgagctaccatctgactacctcctcctgcagctctcttgcctttcttttttcattttcttttttgttgttcatcggatcatcctgtgagtcctctctctctctctttctttgcatgcacgattagttcttaggagcagggaacacattgctacctccggtctaaatgacgttttagacaatggatgaatcaattccttgggattacgacggtatcaaatgtgcatcgtgcatgcaaggtgtttgtggaaaagccgacttgatctgcttctcttgcagggctcactgtcagttccccgtttgcattgtgaaagcagttctttattattattattattattttccgaagcaaacctccgaaagggtagtggtagtgagttcttgtttttcattgagaagagagaaaccgagcataaataccatacagttacacggctaattgaaggaaaaccggccgaacccacacaggatacccaagcaacttgtgtttaatttggtgtatggggttttgaggatttttcttgttatctctaagggttccttttatgtaatcaggaatggaaggatcaactagtaaacatgattccctggtgcaaaaacatgtggattttggtatactggagaacaacatacaagatccaactgcgacgccaatgtatctgccaatggaattcttgaaaaccattacatgtgacttctcaaaggaacaagagcttggcaggggtgggtatggagtggtttacaaggtatgctccccttttttcccctctggttatcaagggtgcgtttggatccaaggctagcaggggcctagcctggcctggcaaggacagtcgtttggaatcagaaaaaaatcctagcccatgggggcgagctagcccataggagcgagaaaaggatagctcacaagggagagccgaatcggctcgcctccgacggcaagctcctcgcgtgaaaaaagttgttgataaggatgaagcgatttttctcaaaagttgttaccttcttcaacaaccagccccccaatttcgtcctactcctccactcttcgccaaagaatcgggcttgcagatctcgtcgctctcttcccccactcttggctgaactatagggctcatagatccggtcaatttgcaatcaccctcctccccttgccgaactttcaagcatcctcgattcatctgcagtaatcccgtgcccatatataaatgcagtagagcctccggcctccacgcagtaaatcggagagcaaggccaactcgatttgaggagagcatgttcttgcagaagattgctactggacacaagattgctcgtggtgagaactgagaagctcccagatttgatttcttccgccgatggcgcctcgtctatctagatttgcaggtacgaggactttttttcttatattaaagctctccatcttcctgccatggatggatgtatacgagctgtctatgttgcttcatgtactatttccacatccagtaatcttgctttgggcctttggtgctggattctgattttgcattaatggggattgtcgatggtatgggcagtagtagctaggaactttctggccgtcggcaccaagcatgatggaagacaacttgtatttaaagaagtccatcatgaggaatgtgcaaagcaaattaatggcaagtatcacacaaacttcacaagtcgacaagtttatcacaagttgaaggctcagtggaaggtgattatggaggcaaagaatttgagcggggccaactttgatgatgttgagaaaaaaaatcctatatgatgagattgaagttgttcgaatgactaatgtgagtgttctaactattctttccttgcaaataactatcgtgtttacatataatatggatgtctatttttctgacatttttcttgtcatgtgtaggccaaagataaaagggctaaattcattaacgtccccatacgttggtatgatgaaatggagtttatttttcaagacaagcatgcaacaggggaatttaatgttctgcaaacaccatatgaccatccaatgactgaagatgatgattttattggtgataaaaatggcagtcctggtgatgttgacccttcatcaaattatgactcagattgtcttccagatcaagagaacaatactggaagtagctcatcttctaggcgtgcaaaaggtagaaaatctgataaaggtaaaagagttagaactgatgataatgtggtttatgagataacaggggctacagataatatgtctgaaaccatgtgtttcacacatataacacatccaaatgaatccctattcaagataattgatgagatgacggaataccctgtcatggttcgacttgagctgcagacttatctcgcgacccatgagaatatagctgccatgttgaagggtaggccactggattctattaaggaatatgtgacccaatggataatacaaaactatccagctgctatgtaatttctttgctgagatgtttgaataattactatgcattcaagctaaatagtttaagaatgaaacatgcactttagatattatttaaataattgatatgctttagttcgaacttgtaataaagtagttcaaaaagatgtttgattgtttcaaggaattcttttagcatatagctttgccctttttactacttctatccgtattattcttgtggccaagttaactgtggaagaatctatagtgttcttgtgacaaagccataagttaaaaaaatttgatctgtgtgcaatattattttgctcaatatgaaaagaagcggcacaaaatactctaaagagaaagatgattcgttgaagcaaccaaacggctagccactaattcttgccatagaaagcacaccaaccaaacaaagggtatatggcaagcctggcaagctggcaacgagttggcttgcccttacccagctaggctagctgggcaatggaaccaaacagaccctaccataccaaagaccagcaattcagaacaaaaatgctcttagaattctacagattttggcacgagaattcaacagatatgacagtttagttcctccaaagaaggaaaatataagtatgataggtgcaaactaaggagacctagctactccaaatccaaaagcattttagatcaggaaaatcaagaacatcagagtatagaatttcgcaaggcaattgcagtcatagatggatagcactgtaccaactcaaatgatcaaagaatcacaacctgcataattgttcaccaatttctaccctattctagagacaacaatgaaaccaattctcctatattaaggttcattgagttaatagaattctaccctattccacagacaataaaaccaactctaagctctcccatatgttacactcaatgaaacgaaatcctatgttaaggttcattgggttatatagtctatagtaacactaattatcaacaactttaacaaaccaatcaaacattttctacgcgatatacagagcaaggtatataactcataccaagacatcaatttgaagaacacatgaacaagcaattacaacacaaggagcatatgggaatttcatggtaatatatcgaatcactcaagatttcaccagtgcgatagaaaaagataatcatgtccaccaaaacacatggtaacttaaagcatcatcatcacggctaagttcaaaatcttgaaagcaaccatagatctaaagacaaaacatagaactcagtagtacgcagagctaggcgagccatggcgacgacggcggcgaagaggcgacgacgatctagacgcggtcgcggcgggggccaccgtacggcgggcgggagtaggtcggcgcggagacctcttgctggcgctcgacgccggggaggtcggccatgccgagcgcggcgagcatctccatggtctccttgtcgacgcggatctcctccacctcgagcgccgacttctccgggacgaagtccatgcggcgctcgcgctcctcctcctgcagcttcagcgagatgccccgcacgggcccgcgctggatgcggcgcatcaggtgggtggtgaacccggccaccttgttgcgcagccgcttcgacggcaggatggacacctcctcgagcaccttcttgttggtgtggaagtcgagcgtcatccgcgagtagtacttctcgatcacctgcctcgaggtcttcttcaccgtcttggtccgcacgcgacccatggctgctcctctccttctccggcgacggcggcggcggcggcgcgggtggctacttgcggcggcggcggcggcgagggtggattagggcagaggttttgggggaggagggagagaggagctatttataagggaggcggcggagtgggggctagggtttgggtgggatctcagccgtcggatctgaatcgacggtcgagttcgttcgatggagattcggcttccgcggatgggccttttgggccggaagggtttgggctggcaaggcccagtatatggccccgtgggagttttttttttttttggctcgtcgagtggagaggaagaggaagcgggagctcaccggcgcggcggcgatggcggcggaggcggaggcggcggcgctgccgcagctgcagctgcagcttctctcgctcgtctccgagcaccggctcctccgcgtgagctttgcttgccgatcatccaatgccttgtcggatcttcctcttcctctcgtagtgctgattcctcttccattttacggtttcgcaggagcgggagcgtgcggcgcgcgaggagctccacgccgccagccaagtctctctctctcttactctacggactgtgattggattctctgtttgctggggattagggttttgggtcgaatttgctgatgcgtggtgggggttttggtgtggaatttgagcagagatggaaggaggcggaggaggggcaccgtcgggagacgcgggagctgcgtgcggaggtggcggcgagggacgacgcgctccgtcggctcgagtccagggttcgttctgcttagccccttcacaactctcaatttcgccaagtagcttgtgttctcgtctcatggatttgggtagagctcatgtgttggattatgttacagtttaatgcctaactaaattacagtccctaacttaaacacattgtgatcatgctggtgtttgccatgttgtgtttcgtggcgattataccaacatttggggctgtttgggccagttgtctatcatagtgtagatttgtacttttactaccgaatcgtaacaatgactagtcctggtgcttggttgattaggtagaagcagcacttgatttttgatatgcatgttatgtcacatcacaccgtggatgcttcattcttcccctagtgcttggtttgtacctattcaacagaggttcattgcaatacctttttttacagataaaatgccttgaaaatgaaaatgagcagctggagaaaaacgaaaaggagttaaaagataacatggagggactgcttcaatcaaaggaggctttcataaaacattacgaggcaggtgtttacctttattttcccccttccttctgtagtagtttatatggagctgaactcattttttatgttttctctccatgctaaacttttggtctttgtaataattgcatatttatgtgaggctacttgccattaatatcatagtttttccttaacaattgctatgcatttgtaagactagagtgtatctggagtctgctttattgtacattgtctaatctgtcatataattctgccctgttcttgcttctgacatttgcattaattatgaattacctgtatgtggaatcaaactgattatcggctcatgataccatgtttgataggcaggactctgcttgttctctgcaatggactatccagatgaaggataaacagattgctgtgatttcagaaaagctgaatgctcatctggctttatttagttcagtaggaaaggaagtcgctgcggtgaaacaagtactcggtaatgtgaaatgtctagttggcgacaaggaaaatgtaggtatgcaaatggctgaaacatcttattctactattgttttaccaaatgattgtctttttattttttattgcactaatgtgcattctttagatacttatctgtgttatgttgcaatttcagtttctgacttgaagggtaaagtagagaagatttctgtgcttgagaaagattttgttggtatgttgcttcttgtagtcagattgcaatttccatatgttgataatgatgaccatatataagttgatatcctttttaagatctgctgttctaaatgtgatttttcattaaaatctgctgttctaaatgtgatttttcattaaaatctgctgttctaaatgtgatttttcacttatgcagaaaaacttaggtttttcgaagaaaaaattaatgattaccagcttgaactccggaatagggcgaggttgatatatgaattgagggaacgccttgaggctgagaaactcaacaccaaatttcagcccaaactagaagaaatatccatttctactgagttaaaagtcattgcagtcaatcttagtttctattgatctcatttggttggttgcgtctccttaacgatgttaccttaggaaatctttattggtgaaggatgagattattgagagactgacttcagagaagcaggttattcagttatagcataacgcctttccaatgtctctgaaactccaaaaatctaaggtgatatttactgtttttctttatttaggcaatgcttatggagcttcacaacatggagattgctttacataaatttcaagacatatttgacagtattgggcatgaggtgagaccatatgagatgcaaatattgaaagcttcaattgcatatttgcattatctcctgtgtgcatttcttggtacaagtcctgcttgcaggattgttcttcctaatatataatttgtttggcttcttttatttaaaaccaagtatctctctaaactatctgtataccaggtaataaaaagaagctcacctgtttctaatagtcaggatgtaacagaagatgtgaatagagaaaaactagaaaggtgatgctccattcaatactttcaattctcatcaagaaagttatatgaattacagtcttaatgctattaatttatcatgtgcaaacagcattccaggtagtcagtgtgaaccagctaatgagcataccgtgatacctgtttttgatgaagcaggtactatcatttcttagagagctttttaatatttcttacaagttccttggtggctccattgtcgtaagaatataagatattaataacctgttctggcatgtctgttaattttatatttccttccagaatttctgaactctgttccttcaatgtttactattttttttttcaattacatagttagttactcgattactttgtgcattatccttggagataacaataacatggttatttctttagtcaaatatataccactgtaccattgtcacatcttccattaacctctcatttttgaggtttctgtttgtgaacataaatcttctcgatcactgagtttgtatatcatcaacagcaactactccgaacatagaaggtcagtcggaaattgacccaggcagaaaacaagtacaaagccagtcatcccttatggcaagtatacatatgattatatcgattttctggcaatgctactattctcccattttcatagtcttaagtgatttctccacatgaatgcagcattctgctttgccgtctccagagccagcaaatgcaaatgccgaaacagctgactgcctacatggatccgaagatattgacatggtaaaaacacaaaacacactccttcgttgtctactgctatgccctgaagttggtccttatgtgtgttcacttcacttgttatttacaggataattcatctccaggacggtgaattgattatgtgaatccgaaccttgagtcacaaaaacagccctgaattacaactgggcttccctctggtggcatggcgctgagtctgcaaatctccaatgcccagcatcgcagctcatgacctcctctgctcacagccgattgatttcttgtctgtatagcatgttaagtccagttagcccctaaaggtcagaaggaagattgggtgctgcattttggtttttgttttttcaacttcaaatttgtgatatctagctagtgatgggtagttgggacatgcaagaactcactgcgctgtgtattccattgtgtcagatctcttcaacaatatgacactaatgatgaatactacggatgatttcagactagcagacttgtatattgtgtgacatgctcgcttcaaggaagctaagagttggggtttagaatttaaatctgcaacaccaatatattaataattagcgtgggttaacatggttgaagcctctttagcatcgacgattttactatcaaatccaatagaatttttttttaagaaaaatgaaatgtttaccgttgatttagaccatcaaaagcttggagttgaaactgagtcggaatcaggacagaggattaaccctaaaacattttcgactgcaaacccaaactaacctatctaaacccatccaaacagtgatcatgctaaatcgagaagttatcaaatagaaatgtggtgttcatccaatgctaaccagaattcagacatttagactgcaggttttccatcacttaatgattttttcaaacggttttgctatttcacttgtgatagatttttggttcccgtctttcgatttttcgtcagtaagatcttgcatccagattcatgctcatgtatatccaatttatagttaccctcgattacagagcacttatacttggctatagagaatttgtacttagttacaatttactaaaattagattttacaagtgtttttttttatctctagatatacggtttttttttacatttttgtcatttttcattcaaaatgggttatatccattgattaaaagttctgtaagatttgaagctccaatttatccaaagatcaataggtactcccctttttcaaaggttttgctattttacttgtgacagattttatttttactttgtaggatcttgcatcaagattcatgttgctgtatatccaacttacactttcgctacttcttgttgggatcaaatccctcttgcacggaaaatggagcgatccattagagcatgattaattaaagagtaaattgcattgctggtacacaaacttgttagaatggtacaatttagtatataaacttgtaaaatgcccgttttagtatacgaacttgcctagttcgtgcgaacgaggaccaaaatatcattgctcgtttttttttcatcttttttctactatcactatgtcatattctattttttattggagaggtgtatgtctaatagcaatcttctcagatatatgtttacatagtatcctaattagtccatgaatcaataagattagccatataatgtccttttcgccttcatccgcatgcattaaacaagttcatgcaccaaaacgagcattttacaagttcgtgcactagattgcacccatctgacatgttcgtgtaccgacgatgcaatttactcttaattaaatattagctaattctttttgaaaaatggatcaaaatgatttttaagcaactttcgtatggaaaattttttgcaaaaaatagactgtttagtagtttgaaaagcgtgcccataaaaacgagaagagtgagtagggaactcatgcaaagaaactccgccttacattcagttgttttgcacttacacttagttacagtgcatcaaaaaaaattttagaaacatgttttttttctagatttacgattttagacatgtttgtctcttttcttttttattttacttataatttgttatatccattctttgaaattttcgcaagatttgaaactataaatttatcgaaagatcgataggtaaaaagaaaatgaaactaaagaaaagtagcttatctgatgggccgagtcagccggcctggcccggcctaacaggccaccaacccactcagctcagctccctctatataaaccacccgagacgaaccctagggttttcaccctcgcctccactccttcctcctcgcgccgtcgccgccgccgcatccgtgccctccttcgccgtccgccgtcgctagcagccggagaagagaaggtgcgtcgtcgtgcttcctccccccttccctctttgcttccttcgcgatgtattcaccgtgatccttgggacgcgcgcggcggcgctgtgcgggggtaacggcatgctagatcgttgcgtcagcggcgtcgcgatgatccatccgcgtcgccgcgctgtgcgggggtaacggcatgctagatcgttgcgtcagcggcgtcgcgatgatccatccgcgttgggtagcaaagccggtagatagatggattggtcttgtggtcgtggttcggtttattgttttgttaatcgattcgtcggatttgtttctaggatgagtgaatcgttaatagatatatacgtcttcatgaaatttctgatccgttgtgactgaaatatttgcatcgattcttaaattatcttttgcttgggtagagtagtatgactatgaccgtgattatttggggtaagtagttgctgtgactgaaattaacaatagctgatatttaggaactgtttttgtttgaattccagatgttaacatttgttactgtaattttgagttgtagataaactgcctgaacatttttatcctttgaaagcaatattgaaatctgatctgatacataaattcacgaactgtaatattgaaatgactgcgattgaattacctgctgctggtttgtatagaacatcagttttgcctgactgtatatgcttcctgcttgtgcagcatggatacccaggtcaaacttgccgtcgtggtgaaggtgatgggccgcaccggctccaggggtcaggtgacccaggtcagagtgaagttcctcgacgaccagaaccgtctcatcatgaggaacgtcaagggcccggtccgtgagggcgacatcctcaccctgctcgagtctgagagggaggccaggaggctgcgctgaagctgtggcggttgtgttatttcgtggttcctgccttttgaaagtaaaatgccatattgtcgccttatttcgtgtactgcttttccggtccagttcttgaacaatggtttgtctttctgagtaggccttatatgttatgagttaagagcaatggaaatgtaatgggtacttgtctggttgcagttttggtctgttgcctataactaaagttccattgttgtgagacatggttatgctctactggctttgggcaacatgaactgattagatgaatgctatcttcaatttactacgagtgtgacatggctgtcaatgttacaaatcagcacaaatctgcttggtaaatgtccttatttgtttgagtttgtgattgcctgattcccttctacgtcgctctctggctttgttgctttaggtttgtaaagtgatcgataaatgcatgtgcatgtgatgaacctgcatgacacatcaaatgcttgctcatactacagattattgattggagacatcaaattccttagcttgatcatcttttgtggtacaaattctggcatctgtttcttttcctccctgaaaacctgtaatctctatttttgcttgcaccttgcgagtgtcaaatgtgtcatatctaaaaatacatcttattacttgttattacttcttcggaaggtacatcttattgcttgttccttggaagccatggtgtgtttgctctacacatctacaaaaccaaagaatgacattctcatgtttccctcactcactatacactttgcatcgtcctccagttaaggagaagaaaagcagcattgcctttgcaatttgcatgccatatcaacattagaaagcagtccaagtagcacacctctgccttggcttcagccccatgttgtcaccttgggctgtagggctacaaccaaatcttgcaactggaatgctatttggtgtcaagggctttcgcctcggcgacgaaaacctcgtcgacctagttccccggggtgacaggctgacctcctccaatgctcggaactggagctccgatgggtagtcgcgaacgcacccgatccgaggacctgctccagtgctccattggaaggacagttgcttccccagctggtatgacttcgtggccttcttgcagttgatacggttcatgatcatctcctctggtacttccaccagctcatcttcttcattgccttcctctgcaaacaggttcttcttgcagaaggcgaggcactctccgaacatggtggaatcctcgtcgatgtccttgtgaaccggtgatggccttccgttgcaatgtgttgcgggtagttctgtgttgttggaactgatcagcagcctcggaggccgcttcccttgcagcttgttggctgaggtggatttcctgattgccggtgtgctcgccatggtttcggtggatgtcatggtgggtgcatcactgctggtcttggtttcgtcagcgccatggtgttgtgtgacttgttcctcatgttcttgcatgtcaggttcacagagttcggtcaagtcctgcctagaatggctgctcttgaggctgaattcggcatcatcttcaccttccgaagggttcaactgtagcaaaaccgaaacacggcacaccaatcagttcaaaggaaaactctattcagtatctataatttcctgcagatgaattgtgatattattcacacttcggttctcaccataacatcagtcagatccacatttctctccttcaggaaattcatgaactcctgaaagttctgctctgttggccggtaatgcccactgtgaggccagactgcctgaaacaaacaaatttcaagagtcagagagagcaaatccagtgttgctcgtagaaatcgacacatccccaacataccttcaaaattccatcctctacaatcagtctccctgcagctgatgtagctccccctgcaaggaagctggagtgctggaatgtgcccttctgtttctgtaatcgtgttgaaaaaccagcatctcatcagttcccagaatgtttgcaagatgaaaagatgtagcagcaatttgccaatgaagaagtgccatggatgcagagtagtcatctacctgaccaatatacagagtcttgcatgtgctcagcacaaagatccattttgagccctttcggcttttggtcgtgttgacgatctgacggctcagtttgtatatcagcctcgaatcctcgacgatcacttcataggattccctctctttctacaatcccagaacaagaacaaacatatgctgttaatcagatgcaatttctacaactgagcagtttctaaatggttggttcagattttcagatcagaagaatagtgatggaacttacagggccaaggtacttgatgcattgcttatgcagcttccatctagggcaatgctcttccaagttgacatctttcccttcaccaacatccaacctgtgtttcagaatcacatatttgtcagtaagccttgtctgtcaactgggttcggagatgtgaaacggtcttcggagattcgcgcattcgcaccagtagaagaatggctggttgatctcacaatggagccaacggtggtagtagtagtgcagattgtgcccataccgatgtcgaggatcgatctgataatcagacatgagatgaaatctcagttttcattgcacatttcaatcatgaaaatactgttgagatcaatgtttgaagcatgtaccgcctcaagccaatgctgtagagcaagtttctgggccttctcatctttggacagacctttgccaacctaaggtgatagcaacactacacctatgtcagtaatgcagtataaattccatgcttactgaaagaacaatggtggctctgttaaaaagttcagagattaatccctcctatgccactgattttgcaaatcccccacctcgt

SEQ ID NO: 11763 - DNA, 2841 bp, Oryza sativa
ttcaaacactatgacccaaaagacaaagaatacttttacggtgatctccgctagtaatattctacgacaaaaatgcacaaatatttgcattttgcatgagaatcataccagctctgctcgacaagaacggcgcaatctgcgagctgccttcttgtcctgaagctcttgtacaccttctgcagcctgacagccgctgcctggtgcttggggctggcaactccggcgatcaccggagaatcctccggtgtctggtctccggcaagcgcaaatctcgatgcaccagcagtagcatttggcttgctgctgcagctctccttgtcagacttgggactcctgatggatatcatggtctccatctgaaccgggtcagcctctcttctcttgaagctcagggagccctctatgatcagcttccccccggagccgaatgccggcagcaatgtcgccgacggtgatggcatcggtgatgtcgacggcgagtcatcggcggcggcctccatgtcgtcgtcgaagctgagggaccggatgaacagcctgcccatgttgtcctccattgctggcaggtagtcgtctggtgggtatgagattgacagccccatctttcttggctttggactcaaggtgatgttgcaagcctgtcttgtttgcacgttttcctcttgtctggttgatccacttcctcttgttgttaatccaaaatttaagttatcctgtgcagatcaaagctaatttttaatgggcatcaaatgtaagttccagggaaagaatttgacattttcagaacaaatttcatgttccttgttcattcattttttttttgaagaacaccttttcattctttcttgatagtatatatttgttcaagaaaacatcccatgataggacaaatgagcaacataacaagatgcaatcatgcaagaactgaagaaaatcaagggaaagagagcataaaaaaactaagcaagaacacattcacacatccaatttcttgtttcttcatgaaagcaccaaacctgttcccaaaatgcaccaatcatctctttcccttcttttttccccctcaacatatagaatgttataatctgcacaacatatgaacagaaaaacaaaagacaacaagaatcaagaacagagagctctaccttgttgttttcctcctgatccctgcaacaagtcccaatcaccttagagaagctccttaattatgactttaattatgagacagggatgtgagacagaagggcaataggaggagattcaggagcagccaaacataaatagggccatagccatagaatagaaggaaggaaaggttgcaagagctgagggcagcttgcctcaaatctcctcaagcctataaataacaaagcaaaacttggggccatcccagtggtgtcaaatggaaaaaaaaggtcactgacaatttcggtgagttaaaaattgtatttatatataacaacatttagattactagctatgagcttatgacatgcaagcatggattaagaagctttcacaattcacactagtcatccttgaagcattccgaaggaatttagggcctgttcactttgatgccattttcaaccttatcaaattttggtaaagttgctaaaaaagtggctacatttagtttgctatcaaattttggtaacttaataagaaatcctgctaaaattttggtatagttgtcaaaattttggcaacttgtcgaaattttggcaatgccaaaatttggtaaggttttttttggcatcaaagtgaacaggcccttagagagagagagatgtggtgccaaccgatggctggtctattctgacttttgcctctagtttgtttattccctcttcaggtggtaaaaaaatttaaaagtaccatcgcaaagatgtataagttggacccacgtgtcattaacatatgcaatggtattttccaacttaaaaatctttgcgatagtattctccaatattgcccggtaactaatcccatgcttaataaaaaaattacgggtgtttccaatatgtgctctttactgtcctattggaactaatcccatcctgccatccacacatattacgttaaaggaattatttatgtttgaaatctatgttttcttttacctagctggcattttttgcacactgttgcttgcaaaagttttatgttatcaaacactcttgcaaaagcattttgccgacacttcacatcaaggagaggcatttgggctaaccgagatcgtctgatccccaacattattttatccaggtctgcatcggtgacagaaggagagatcaccatctgttggcggttgaatcttttgtgtagggccaagggcaacaatctcttgccatgtgcaagctacaagaactcctagcttaccttaggtaataaaggagatcaagaaaaggttgcaacaacaacaactcttcctcctctctctccatgaccatttcttcatactactatatattatcagccagttaaccttgaggtacaagatgatctcttgaaagtgatttatgacaccattttgatttgtcccatcaaagcttttgtccataacaattggatggtgacatctgaaaaacacaagatccctagataagacatggcatgatctctctctctgtgtgtattaatttcttcctgttgcctccctaatataacattaatagtccagactttgcggttttacaactcgatcttgtttgagttgaaaaatacagagaaggtgatgatgatgcatggtgctgttggtcaaggggacacagaggaggtgatgggctatattcaattagcaccgccagcttgccggctagctactaattaaggtgttgtttt

SEQ ID NO: 11764 - DNA, 11216 bp, Oryza sativa
gtgcggcgccggagccggcggaggagggatcggcggcggtggccggagctagggaggaaggggcgctggggcggcagtggtcgtcggcgtcgatgtcaggtatgtaacgcgtgatacctaatgatacatcgcaagtatcacctgataggtatcgcctaatacctgataggtatcacctgatacctcacaagtatcaccttctatgtggcaagaattgcatgataactgataggtatcacctgatacctcgcaagtatcacctgaaacgtggtagaatcacttgatacctaataggtatcacccaataccggacttgatacctaactggtatcatcccgcgttatatagcatccctaaaaaaatcttctactatactccctctgtcccaaaataaaccaacttctacggtttgatttgtcccaaaataaaccaactcctaccttcttacctgccactaatatgcaaatcgagaaattttattacttcaatacccctcacctgctcatcaaccaatacaaattttacattaattaagggtaatttggttttttgtttctttccttaatagtttcttgagattctagggtttgattttattagggacaaagggagtattgtttaaaccatttttcttaactgtttgttaccattttctaaaatattttcttaaagctgcatgttataatcttgagtcaacagctatgcagtttctcgccaactttggatggaggttaaaaataggattcaataataatgtggtcttgctcttgtgttggtgtttaggagttggtgtgtgcttctgtttattaaagcgtgttctttatgacttgttgaggtatgtttgtgtttggatgaattgttataataattggctgtaacacgttaagcaaaggccgcggattctattccattactaaaaaaaagaatttaatttatccacataattagatagatagataatcgccaatcggccataataatgtaccagtaatagtgaataatcttcaaactgggcctagtcgagctggcaccggcagtacgtttccgtacgtacgatggaacagcacagcctctccgtacaggcaccgacacacgtgcaagcgagctattaggctgagaatcaccagctgtgtcgtttctgtactgtatgcttgcatctacaggtgtataagtcctaaactcctaatacgacttagggcatcaccaatgtttactacctactttgtgtataagagtgagccctgcatcagtgggtattagctgttgttgtagccacaatggtgaaagaacaaaagtgggtagtaagctggaccccaccatcactagccatgagagaaagatgagagaaattatttgtttattccttatgactaggtagtaagcatattacctggtattagttacttactactcttacaatatatacaacctgttagtagtagtattttattgcttactacccactttaaatgcacattgtggatgcccttacctatgcaatcgaagggagtatatatcttctgtccacggagcctcaagtgaatagaggattggcataaatttttttataggattcaactttcgaaagaattttcctactgatcccagtagctcgtgggaaaggaaaggaaaaaaagttgtaggattgcacgttcctatagctcgatttcatggaaaaataaacaaggagttcaacgtcttggatatgatttcaattcttgtttttttttaaatgtctctacgtttttcctaacatgtattccaaaagcctcaattttttgtgatgctaagatctactttaacttaataattaacttcggagctttcttcctcatctgatctattgtttataaaacttgagggcttgtttaacctgaggcttacaagttgcagctaattctgaattttaaaactgatttataggtttaatgttcattgttttcaccatcactcaattttggctcactagaacggataccctcatctcaatcgggcggtaagccccatctcaatcgggcacagcgtccgtcacaggctagaagtcactgatgtgaagagttaactcaatcgggcaaacggccgtcacgaatgaatatatctcaatcgggccctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcatctcaatcgggcctaaactatagcctgtcatagatgactgatgacctcaatcgggcctaaactagagcccgtcacagatgactgctgacctcaatcggacctaaactagagcccgtcacagatgactgctgacctcaatcgggcctaaactagagcccgtcacagatgactgctgacctcaatcgggcctaagctagagcccgtcacagatgacctcatctcaatcgggcatttagttatggtccgtcacagatgactataatccacaaaaaaaataaattttgttttttggctagcctcaggcctttgctagccatgcccgctgcaaaaatgacagaaacaaacacagatatccaatatccccagctccccagcatcacccattcatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcatcacagttgcataataagtgttcatcattgcctaaacatagaagttcaacattgttcatcattttagtttaagcctaaacattcctttggggttaattatttcgcggaggatgaagctggttatctcctcgcgaacctcctcaaagctggtagtcagagacttggttattgtgccctacattgtcataattccagattagttgatcgatcatatataagtactaaaatgtagttagtctatcacaattgagaccactgacctcaaactcagccaaagtcttcaccttttctcaatacagaagtcgcatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattggggtctaatcatatgcgttcttatcaattctggagttcaggtaatgacatgtactccatttaggtgttatgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcgtagatgtagttgaccattccttgacggtcattctggagatttgtgacagtgaccacttgtggatcaaggaaggcaacttccggtgcatgcttctgacaccattgccaacttaacctacacacaggatcaatgatcttgtaagcaagttaaaccgattgttattaccagaatgagttgggcgacaatacttacaaggagtagcacttaaggaggcttgtgtccaccgctcagagcctgtagaggtcgaaaagatccttgaagtcgaccacgatataatttattggaccaaggaatggctttccatcgtgctgtccaaggatatcggtagctttacttggcttcctggcgttagatttctccatgtagtataagtgaaggtccttgcaagcggtgcccatagcggcaagcacgtcatctccaaccaatggcatgcctagttggaactcctgtggagcgacatatttcttcttgacctctttgcccttagtctcttcctggtccttgcctagatctagctttcttggagctagaagcgaggcctgcacctttcctccccttcctctcccctttgcttcgggtttatcgagagtaattctctgaggggaagagtgtgctttcctgctcttcttcatcggtgggggttcatgaatcgccttgctgtcggcctccgttcgatcctccccaaaatccgtgtcgtactgcaactgcacatcgtaagattgtgcatgacgatcttgagcaggaggggctgaaggagcagaggcgggtctctgtagcgcccgttccgtcgtggtgcctagcgggaaaactatctcttaaaaaccctagttgcgaaatctgtttctttgcttgttgtctagtgtccgtgccatctcagatctcaaatccccgatctatcgtcgagttcaatcccgaatccaaatccttcccaaatcaaatccctccacaaaagtctattttgcctccctcgggttcgatgggccgaatctctctcggcccatctccccctccctccccggctctctctctctctctctctctctctctccctgctctgccgtgagccgcgccgagccctccctcccgctctcgctgccattcccgtcgatgccgcccaaatcgccgagccgcccgcatgcgcgcgcgccgtggtggccgaccggccagtcgccgccgccgtcagctcctgccgcacctgcccctcgtctgccgcccgtgtcgccgctccactccaaaccggtccgccgtcatcgccgtcgtcatcaacccagccccgccaccgccgcgcgctggcttccaagggacggaggctgagccccccctctgccgcatcgccccctctccctcctccttttccccaaagtggcaaggaggcaagccccctttctctccccctttttcccttttccctcccgccggcgtcatccttccccccctgtcgccgctttggccgcgaccgccgagcgcgagctccctcccttgaccgcccaaggtcggtttccaaaccgacatcgccaccctataaacccaggcgccctcccttccttttcccctcccaatcttccccgtttttcgcccgcgccattgccgtcccctttgtctcgccgatcgccgaccgccgccgtcacgtgtgccgaaggagtcggtgcgcgttaggacgcggaaggggactccggacgcaccctctccttcctcttccccggcccgaggccggagagatcgctcccgtgccgtcggcccgtcgtcactgctccccgtccgcacggtagtgcatctccccgttctccctcctcaatccatctcttccccttagttttcggtagtagcatgtgtagcctccccgtagctagccgacgccgccccgactgctgccatcgctcgccgtgtgctcgccgccgtcgccgcccgagctcgaaagcgcctctcgtcgccggcctccctcgatgcgattcctcctaatccggcgcaaggggtgggttcccgtagccgcgtagatgctctcgccgccgggaatcggcccatcgtaacctcatcgccgtttccccctcctcccgccgccagttgccgccgccgcaatccgccgccgtcgagcgtcccccggcgaatccgagccattggctcgtctcccctcgtcctgtgcaacatcccggtgtgctcgtcttcgcctgtattgccatggttcgctccgccgctcgccgccgtcgtccgccgtccgttccggccggcgtcatcgtctacctcccgccggcccgcgtggcagccacgtaggcgccacgtcggcgccacctcggccgcgaccgggtcaagcagaccccggtccgctgcttccctccgccccctcgcgcgcgcggtccaccgcgagccgtgaggctgcgcgtgggcccgccgcaccgtgtcctccgcgaaccgcgcgcatgcgccgcgcctccctccccaaaccctagcatgccccgcgtgcacctcgctcacggtgagccgagtcgccgacaagcgggtcccacccgggaccacgcgggatggacccggcccaccggctttctctctcccctccccgcccgcgcgcgcgccttgggccgccttcttgggccggccggcccattaagctcagccgagccgcccctttctctcgggccgtgccctagccgcccgagggaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttccaaaatttctcaaatctcgagatctatctaatggcacgcttagaggtcaataatagggctttattttcgccgtttgctgagttgtcccgtttcgcgtgtagtttcggagctcgaagacccgcagtgcgaggatttcgaggatcaaactcaagatctcgagcgaggcaagccacctttgaacatcttgagcctatatttgaacttaattatgttgcttgaaaaatattatgcattgataggatcgcacttaatctgcttgtcctgtctgcaaggcagattggtggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagacttggaaaacccgacacctgagtcggtgcttgcgaactaaatgaatttccaaaatcgcggaccggggaacgtatcgggtgtacggtttcccgctcttgcacttaaggaccgtttccttggaatttcatccgaacacatgacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggaccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtacccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctaatgggatcagccaggcccgggtggccgtttgaaagctgttggccgggtgccaatcttgatcaattcaaaagactgatacattgcacatactccgaccggacgagacgcactatctcatccgtgtcgtttgagaagcactcacttagttgtttcagaaaagagttcaaataaaatcaattgcaaaaacaacagcctttctttgaagcctgcattaaacacttatttcccatggcttgctgagtactcccgtactcacccttgctctatataaataatcccccctagttgctgaagaagatgaagcggatcccgctgacgaggagttcttccaggagcaagccggctacgatgagttttagggtttcggcctagttcccaagtcgtgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggattggtatcgattaacaggttaatttggagcgtcacgggctagttccgctcgggactagttcggggcgtgacagtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagagggaacagctcgtattcgggcttcaccaagtcgacttgaacttttgcacagtcggccctgagttgcgctccatgcactcttgtctctggggtcggcttgtacgcaagtccctcggctgctggaacagtgaaggtcggcatcaccctaactgtgaggtgcagctcgttggttcctgcgatagattaatcaatttttttagaatattatatatcatatggattcgttacatctttcatgtattgagtaagttcacggttaccgttatgtggtcgacggcgatgtcgaccgatgttggattttccaccaactcagttgatgcgcaactgctgtgtttttcggtgggacttcctaactctttgtgcgcagcagcagcggcggcctgggggatctgttgctcttctcggatctcttgcctaatcttggccctcatcgactcgagcttttcgtcgaattcagatgtcagctcagctcgtatcgactcccggatcttggcttcaaggcgtgcatctttctccaccttgttggaagtccgcttcttgtactgccacgcgtagtctggaaatccatatttccagagaacagaagacccaacgccccgtgtccgtccacggtgttccttgttgcccaacgttttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagatcgtgccatcatcatgtttctggtacctagccctggcccagttcctagcccgagggtgtgggatatcgccaaacacgagcggtaccaagccggtgcacgattcctccgcttcttcatcctcacgctgccattcctcttccttaccggcatatccggcggtaccaagccggtgcggatgctggttcctggtctggagcaagcgatatgcctcgcttctagctctggactcggggctcgacttcttcgcatggaattcctcccagacctgttccgtgatccaaggaaatttctctcttggatctggatttgccgggttgtagacgaactcgctgactagcttagtcttgaagttcttccaagcagtgcccataaccttgaaagcagcccgcctgagacggtcctcatgctccgcaggataatcaaagctctccttgaacgttagccaagcaatgtccttctctgcggccggcacgagcttgaagtcgtcttgcagaatactgaatttctgcctccctatgaccccgcagatagacataaatcggctcaatattttccttggagatgtcggcaaccctacggcgtccaccgttgttatgcggaaccgttccttaggaattttgttccctgtcctaggagtacgtgcccttgaggacccactagttgtcgtcgacattggttcgccttgctgagacattgtctacttttttccaaaaaaacaaaaaaaacacaattgagtgctacaatctattacaatctattaaccatatttcacaataatttcattaatgcaccacatttcatcccaacataaataaaccacatttcatcccaacatgaataaaccacatttcatcccaacatgaataaaccacatttcatcccaacataaataaaccacatttcatcccaacatgaaccgcattgcatataaataaagttaaatgaaccacatttcatcaatcactacaatcatctatcacaaaattcataaatgcaccacatttcatcccaacatcgacatgtctcactcacagttcaatcacatatcatccacatccacatttcaatgacatgtcattcacagttagcagagggcggcgcgatggaggactcacctgaggatggccggtggggctcggtggcggcggcgcccgggctcggtggagggcggcgccggtcggtggagacgccgattgggcaggtcggcaccgggcgggcggcgtcatgctcggtgggggtcggcgacatgggtcggtgaggacgcgagcggcgacgacgaggaaggccaacaccggtccggtcggtgtaaagcctcggtggcggcggcggcgggctcggggggggggggtcgtcggtgaggaggctcggcggtggaggtccgaatggagggccgaggaggctcggtggtgacggcggcaggcttggcgagggaggacgactgcggcggcggcgggctcggtggcgacggtggcgggcttggcgagggaggatgacggtggcgctagggttctaaggaggtgggaaactgtagcgggacttagaaaaattttcgatccgatctgagaaaccctagttatattagagtgatgagtcatctcaatcgggctttgtcgtagagcccgtcacagatgactcatcggtgacgggctccatactaatgtccgattgagatgacattcaggcccgtcacggatgactcatctgtgacgggccctaagataatgcccgatagagatagattaatctctatcgggcttgaactaaggcccgtcaccgatgactatttttccatttcccagataagtctttatatttgtgagtacaaaatatatagctgctgtataataattcattttattagtcataacacactttcggatagtaaatgatttcaaatcgaaatatggtcaacaacaaaattgtagaggttatcaagatctacaacttttatttcggtcatttatctatataactttgtttctaacagcttgaaattgattttgacaatatgacaaatataatcaacatttgtaaatactaaatgatttcaaatggaaatatggtcaacaacaaagttgatcctctcatcaagatctacaacttttattttggttacttcttcatccgacaaagtgatagttatattattcacaaaaatcacatttctctcatctggtttataaatatcaacacagatatgtcaattttgtaaaca

SEQ ID NO: 11765 - DNA, 939 bp, Oryza sativa
aacgcccgatagagatagattaatctctatcggccgtaaactaaggcccatcaccgatgactcattttccatctttcatttgttatgagtgcaaaatatatagcagctgtgtaataattcattttattagtcataatacattttcggatagtaaaagatttcaaatggaaatatggtcaacaacaaagttgtagagcctttcaagatctactatttttattttggtcattattctatataatttttttcccaacagcttgaaattgatttcgacaatatgacaaatctaattaacagcatttgtaaatactaaatgatttcaaattgaaatatggtcaacaacaaagttgatcctctcatcacgatctacaacttttattttggtcatttgtaataaaacaaaattagccatattaatgactacacatatcaagtctttgcaataaaacaaaatacttcattcattacaatagataagtacaaatgcatcagtcacaaggttgtgccttcggtatgatctgaacgagcacatgccacaggctcttggggatcatcgtcaaggtcaatgtgaggtcttacatgaagattatggttgtattcttcttcatcgacgacgttgtcaactcctacaattcggcactttccatccctcacgatgtgcatcttcttgtttgaagggtcttttatgtagaatatctgctcgacctgtttcgcaagtacaaatggttcatcggcgtatccgaccttagatagatctactaaagtgaaaccttccttgtcggctttgacaccagtgcgtagattcacccaacggcagcggaacaaaggaaccttaaacttgacgtagtttagctcccagatctcctcaatgtggccgtagtatgtgtttgacccaacttgatcctggaatgcatctatacggacaccgctgttttgcac

SEQ ID NO: 11766 - DNA, 10953 bp, Oryza sativa
ctgtactgtctcatttgggacatccgtggacattgtcacacgattcttgaaccattcgttgaaccgagaattatgttctctgttaatccatgcatcagatcgccccaagttctcatctcggattttcgctaggtgctcctcaaagtatgggccaacttctgccatatgttggagcatagcgtaatgagcctgcgcgtacgatgcttgatcgggcctaattcttttccttccgattgtgccaacacccgacaaccttccctcgtgacgagacgctggaactccgatatgatcggcatcagacatgtaattaacacggaactcaatagcctcctcggtcgtgtaaccttcaatgatgctcccctcgggttgagctctgttacgaacgtacgacttcagaactcccatgtacctttcaaacggccacatttcccttagaaaagccgggccacatagttttgtttgcttcaccagatgaacagggagatgaaccattatattaaagaaagacagtgggaaaaacatctcaaggtgacagagggtattcacaatatcagtctgcagcccatctagatcttctggatctataaccttctgtccaattgcattgaagaaggcgcacagacgttggatcgtgtgatgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttcttatccttcgacagtgtgtggcaggctggaggaggtacactttacctgtctctgcatctcgtatgggctggagttcgctgcgaatattcatgtcctgtagatcaaggcgcgcgttcaacccgtcctttgtcttcccgggaatattcaacatcaggccaaccaaactctcacacacattcttttctacatgcatgagatcaatgcaatgacgaacatcaagatctttccagtaaggtagccgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccattaaaaattttcttctttcttctaaatgtgtgacgtagcgggagccaccttcggtgacccatgtataccatctttcgtgatttcttcaaccaccggcttcgtgtatgttccttgcaatcggagcatgccttctttccttttatagtttttctggaaagattaccgagtgcagggtagtcattaatggtacagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatggcgggaggttatagttcgcaataaaaactggccaagtgctgtgagtactactcatgtcactgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaacgatcaatgataggtagataccacacaacctttgccgaaccacccctctttgacttatttccttcgtcagcacttttctttcgcttgtatcgagaagccttgcagacaggacaagcatccaagtccgcatattgcttgtggtacaatatgcagtcattgggacaagcgtgaattctacggacctctaaccccaatggacacagaacttgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaatttagtgtgttttgctttgcatccagcgtacaaaggcgtctcggaatcacttaccaacctgctgaatttcattccatctctctcattctgggctaggtcctcaacgtcacgtaacatgtcttgcagcagatcgtgatccacatcaaccatttcaccgcccaatggagaaggtataaacatgtcatgctcattttcatcttcctgattatgcgcaccacttctgtctgctgctgctccacttcctgattcttgctctccatgcttcacccaacatgtatagccctccatgaatcctcgttgtatcagatgtccgtgtacgtcctctccgctatcaaacatattctcgttcttgcaatctgcacatggacaacacatgtaatcactgtttcttcttatccgatcctcctccgcggcattcataaaatttattacgccctttcggtacttcgtagaatgacgtttcaaatttttggcatacatccaacttcgatcaattgctacaaaaaaaaaacaaattagaggcacatattataagatcagtattgcaaaagtaagacatgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgagcatacaagtaatctctatcgggccttaataaaatgccgtcaaaaaagagtgtcatctgtgacgggcaataaacttatctcaatcgggcctctagttggagcccgtcacagatgaccctcatctgtgacgggcttcttttagggcccgattgagatatggaaccctcgtctcaatcgggtctcaactatagcctgtcacagataagtgtcatccatgatgagctttagttttatgccgatataccatggctgtgcgaccatatctcaatcgggcgaaacttcggcccgattgagattacttccttgtgacggcccgcaaattccagtcttgttatgggccgtcacagatggaaggatctgtacttagtggcttttggatcactccgagtagaagcgcaaaaatctcatcctaaaaagtattttctgttgcatctgtcacctatctttggcctaaactgtgccgtatccaaaaaagatttacactttacttttaaaataattgttcgaatatgagttgtctagttttaacaaaaaataatttcttttaaataatagagaaatttagcagcaaagttgtatcaatatattcgtaatttaaagttctttaccaacgtattacatttaaacctattttcttagaagttgcttaaagggataattgtcaaagtccatctactctcgttcaaaacagacaaatattcctgaacagatgggatatcctatatgttgacacacatgtactagaatttttgttattatgcagtttatagctttgtttgtacaagatgtgaataaggtgtagcgaagagggatacattcttttacttttacagattactataaattatcacgtacggtacgtttttcaagctctctaaaatagtttgatttctgcaaaaagtttgtctatgtgtaagtttcgtagaatagcatttaagaacaacttttcaactctataattgttaacttggttatttgcaccctcaaatattatcgcaaaatcagataatccatcgtccatatagggaaccatcaaatcgaaatgcattattagttgggtagtgggggtgatcaagctagagatcttgcattgcatcgatcaccgatgaataaggcccggtttagttcccaaaagtttttgttttggggtatcacatcggaatttgaagtataaaatatattatttaataacaaaacaaattacagattccgttataaaattaaaatttattaagcctaattaatctatcattagcaaacatttactgtagcaccatattgtcaaatcatggcacaattaagcttaaaagattcatcttacaatttacacgcaaacttacaatttacacgcaaactgtgtaattattttttttccacatttaatatttcatgtatatgtccaaacactcgatgtgatgggtgaaaaatgtttgttttgggaactaaacgaggcctaataatgcatgccacatcgttatagctaggctgatcgaccctacctacctgcacacgctgaactgaaggttgagtaatattgactcctgatgatcaagtgagagtgagctagccacagctggctggacgacgatcgagtgaagctaatagctagcactgaaacgaagcatccggtcgcagttcgttcttgggttgttggtgctagtaaaagtgtaaccgcgttggctacctcaaagacagacatatgcaggggcccagcagaagctgatcgatcactgatcactgatgctactgcagtgtgtgcaagttcattggggaggaagattaggttaattagctagctaggatcgatgctagatacatttgcatctgcaagatgatgaggatgagatgagacatgggtgtgatctatgagggcgactggtgatttgcatactctccatttcatctacacggctgatgactgtgcctgactggctggtgattgtgatggtgagccatgggcagtaatatatagccatataggctccatttcggtgcctgccttttgtggatttatgaattcatcatttatgatccgttatctagctcctactagtttcttgagatgatggtgaaaagagagagcgatataataatatgagcatattcagcaatagtcactagtattttgtagccccaaatactaaatgagggccgtccctatttcctaagacctctaagaggcatccaatttcagtatccaatttcagtagacaacgtttatttcttagtccctgctaatataagccccatttcggtgcctgccctgtggctttatggaatcattatggaccccttacctatttcctattagtttcttgacatcatggagagagagagagtatatgtgatttggcaactctaagaatctccataaatagccctattttacagtcctaaaagataaataggggtctaccccaatttcttgagggccaaagtgactccaccaaatccaagaaaccacccttatttcctaggatccccacgtcagcgacacaagtccaagtagcgtgacatgcacgttatgtgatgctggcacggtaaccacgatacgcatggcagcgaagcggaattgtcgaacgatgagcgattgctaggacagtgccatatggagaaggtaggggttctgggtgaggagcgtggtacgccatcaccgaggtcatcaagtgcaagaggtggcaacacgatattctggtttctgctagggttccaactcgggaatggagatgatggtgtgacgttaggggtgcttagggacatccaaaaggtgaggactggcatcatggcatggggatctccagatccatcagcggtacacccaatccatttttttggtggcgcacggacaaataaaaggaggggtggtgaagtggccactaaagtagggcagggaggcagcagcctcaatcggagcaggcatcggtggccaagctcggggcagcggagtcacggggcaagccagggacgccactggctagatagggcctacagtgtggtggctctcgcatggggtgaagaagagtgggaggcacgagaccataaatttcctcccgcgtgaataaacggagaatgggggctgtggtctagagccttgggaattgggggtatgtacggtaggatatagcgccaggggctttccgattttagagctctaggctcgatttcattttttccctagccctaaaaattgtttgaggggtttgtttacaagacttgctggagttggttacgatggcacaaataactttcctaatatatatatattttttttgcgaaacacataccttatctctatgagcacattcgaaaaccgggccaacatatattaagatagacaaaattagcacgtgtctcactgttaacaggtacgtcacttaccactgaaaaaataattatccgtaaatacaaacatccacataagtctaggagtaagcagccaacacaaagtaccttaccagctacgctcagttcgcttattttagctacccttggtcctgcaggtctcaccgtctcagagctcttggctcggatgctgcatggagttagcttgacataaaaataggtggccatatatacatatactagatagattatgatgagcatgttttccaaagttttaaatggtttgatttttcagaagttctatatataagttacgtttcatagaatagtattttaattataacaacctttttaaacagcaatagttaatttattcgttttttcctctaaaatattaccacaaaatcagataaccataatccattcattcattaagataaaaatgaactggaacacatctcggtcatgactcatgatatgtgtcagttcgaccttcatagggatggactgaatccctgccctgaagaaaatgctgcctgcaagaagacaggtatttcacaggaacagtgataattctccaatatgtacaggccctaacaaaactcaggtgtcattaccatgttagattagaacttcagcttgggcgagctaacaaaagggccaagatgttaaccctttgatttgaagtgactaggttcagagtgcatgttagattactgttttttctgaaatgactagttcagattgcagtttgtggtttcagctttggtggattgattatttaggcttaactaaatgggaaaaaaaatccatgctgcataaatttgttcaactttgtttgtgccatccaaacaacacatctttttcagctatggttactgggctgacaatttcatctcttggctacatcaaattgtgtgaaattgagttgggcttggatctcacctcagcccattaaataagtttcaattttcaagtcttctcaggcaccccgcttgttacctgttgggccataatttgaggcctacacaaagatgacctcttaaaactttgtagctatttatttattttttcttgtctaatttgtagtacttgatcattgaacaagttatataaggaaataagtctcaaattcttttttgaaggaaatattccctagtgaaattgtctcaaactctttccaggtcagcatcccagcttccaattctgctgaagagtttatctattctttttcacaactaggacatttgttgattggactttttgcaagtaaagatatctccaaaatatgtagattttacatcctgcctgttctaaaaaggttgtttcagcaggtgaaaaatttctactttcctttgtcaaggaaaataaaatgtgacattgagtctgaaaacattagcttgcataattgcttagaagttaaacaaaatgagtggccatgatcagacaagcatggaagcagtaattctacagagttagtattgtccctttcctttgtcttttcagaagaagcagagactacctttctaatgctgtctctaatccttgtccttttttttccagaggttaattcaaggacagcaattagacagctatgggttgcttgagagagtgaataaccgaaagtggcacatcataactacacaaaataaatcgatgcaggaggtcacaaatttaggaacaattaattcattcattagcatggcaatgctcataaaaagaagtggcttatcatgtcagctccaacagatgcttttggaggtttagccaaaataatttttccagcttaaaatagcatcagggaaagagatgtctgacactcaaatttggaagtgtactgttacaatgtcaggtcaaagtgatgataacagagaaatccaactacagtgctatcctgatgatgaggctattatgaacataagaatagatgcttgatttgatcatctatatataaattcttcttctgttcagtgagactgaatgcatatcatttttttttcagaaattcacatttctcaagtaaatggattagtgtgttcaatgcaatctaggacttttattctcctgccaacaaacactggttgcataatgaaaatgacagccacctgtaagactgttatcatagttctgaacctataaaagaaatcatatcatatgaaaaacaacctcattaacagtttggccatgtggcttcatttcagtacatgagagggctcaagtgacagcaacccagccatcagttgtgacagtaacccttaaactgatattctctctctttgcttagtatgcaatgcaagtagttgaaaatatccctgtctcctaaatccttcctggataagcctgcaagctacaactactagtctttttttaattcttcttcttcctgtaatgaatcagaaagtattctatcctaatcttgacccttgttccgtattgaattggatggatatacagcaagaataccaatacagaaaaaaaaaagtccatgagagttctgtgactgaacaaaataaaggcatccatcagttaaatgataattgctggggcacactatgaccagcagtaaagcatgcagctattatatactcactcactcggtcctaaaatatattctagcgttcaaattttgttttaaaatataactacttataaactactaataggtatttatagtgatgaaatattcaaaatactattcatttccataacccccacccacatcccaccatctgggataattaataaaggataacctagtctttttacctatcttgttaatctccgtgaatttttttttttaagaaatagctatattttgaaacgaacgagtatgcatcaggggttcagcaacagtgaagccatggtttttaatactgacataactatgcagatgtgatcagtgcacggatcaaatagcttaaaatcattgggaaccagaaaagctggggaaataaaggtctggattgacttgccagtgaggtacttgaggtccacaggatcatgataaatgccacagaaaagggtcttgaagcagtcatagatatatactactaacatagcagagcaggaggacccatgaattaacatggcagtaaatcctgttactaaggtcataactcagctgttaaataagacagctaattgttttacagaagcttaacatttacactaactcctggaatgtaactctgaaagttcttttcctgacaagatcaatcttcaacacctatagctcaaaactcagatggtaagttgtcattcttttcatcttcaggtcttgatctccatggctcaagttggttccaaaaacaagaaaagaaagctcaaggttctaaaagtcttttttttcaatactgttctgaaatatcacaatgcaaaaagatcaaagcttggattcttcttctccagtacaaaaaaaaaaccctaccaatgcatgctaaatacagaggaaacaatactagtagtaggtaaggtattacacatctggttgccatgtcaccctcaataccctcctcttcattctccatctcacatacactacacatgagctacgaaaaagagttgcagtgtcgccatcatctgaataaaaagaaaaataaaaggccctgaaatgccatgtaatgcaatgcagtagttgggaatcgtgatggggccttcaattcagaagatgagatcattctgaaaatgccatgatttgagaggaatcatcaacgatttggcaatatgtaatctccaggtcaggtggccatcagatcaccccaggatgggttaccacaccaacagcaagttcttgttgctaaaccgaaatgtcatgttgctcattattcttcatggacttcatgcttaattagttttgatctgtcaaatccactgttcttcttaggcttctcccttgtcttagattgtacactgtttttatttttgtgtttaaaaatatttttacccctatccgcaaacatgcactgtcattaaaactttgaacattgaatttgcatacataaataatatgaaattattaagaaattcttttctggcgtatattttctttttttttaaaaaaaagcacaaacacagacgttgatataaatacatgcacactcaccccacaaacatgctttcatacatcctattcctacccttataagcctctgtaaaagattgggccagcatatcaatagattgacgaacttgctataagcgctttgttttcagcaggtacatgacataccaaagaatagttagccgtaaaaaatcgatgttgaaatagtaggaaaaaaaacatgatcaaaatgttttatcccataccagcatttagtgctaaaatagctccaatttctcacacccaagatttagaccctcccccgaccccctcaatcctcttgcctcccttcaaagctctcccaaagccctgggccccaccttccaggcatacagtcacaccctccctgccagtgggccccacaacccaacctcccccgggcccaccatccagacactgtcaaactcccccttgtctcttctcttccctcctttttaacacaagtgatgagctgagctgagctgaggcaacgaaggtgttcgtccatggcgccgcagctggccacgctggcggaggagccggggggcggggag

SEQ ID NO: 11767 - DNA, 4350 bp, Oryza sativa
agtacatcctcgagcagttccggcagacgacggggtgcgccaagatcgagggcgcggcgaagagcatgtacgcggcggggagggtgcggatggccatggcgccgaagcccggcggcggcatcgagcatcgccggcggcggcggaggcgggcacgagagggtgcttcgtagtgtggcagctcgtgccgaacatgtggctagtcgagatggccgtggccgggcacgccgtcgccgccggctgcgacggccgcgtcgcgtggcgccgcacgccctggctcgacgcccacgccgcgcgcggcggcggcgcgagacctctccggcgagccctccaggttggcaccccgcatgtccctgccatttggccattctgattagctcctcctctaatccgattaaaattcagtttaggcaaaaaaataattagttttgcattagtttgcattgcaatctagacttataaatgtctaaaccgaaagaaatcaaaacgaaaaaaaaaaatcgtacgcatacattttgtacgtacaagcatacgtaacgtacaaaggaattcataagaaaataaataggagtacttcatgtgtattcttcaaatatatacatggggcctttgttcgaatggcgaatagaaattaccaatgtgtcaaaaaaaaaaacatgtcattttttttataaaaaaagtgaccaaaatacctgataattttgcaagcacatacagacatacattaggtgatcttatctttggaaacctattcctttatcaatgatgtaaactctttttcggagaacgatgcgaataggtttggctgtatgcttagttatgtagatgttgccttgatataattgtccaagttcaacaataaaagtttcttcctttatcctaaaaaatgtgagcatgtatatatatttaaaacatttaaaccattttgaatgagaaataacaagtatctctagacaaaaatttaagctgaaatttatgtatgtcggagtacactgggaagctacccaaaagcaatgtgagaggtgtatgagcgtgtacgtagaaatcgctgcttttctttttgtggatcgctttgctgaattcgcctttgccttttgtgctttaatttgtgtgctgggtgtgtgggagtattatttcgcaaaaaaagagggtgaagaattggggagcatttgtgaaagaagaatctttggctgaaaataaaggtgcagatatggcattctttcatttccactgtttcacctcgggatctgaggctgctgcccctcatttcctgaaaaaaaaattcagatcactcttgagatactcttgaaaaaaactttctgtgaggatgcagagtccgcagactttgcttccttctaagtagcactcgtctgtttacaagattggcttttgaggcatatatcttgagcaatttggcaaactgaggctagtataaatctgtgtctgaaattgatgatactctagtgccaagtagtagtatcattcttctttggtgaaagttaaccaagatatctgaacataccattagccgatcgactagtactgtttttaatatatatctggatattctagcaactgctgagatagctagttgaaaaaccattttatccggtcctcataggaggaccaaataaaagagcatggattatgattatggttaggccactgacctgtcctttgaaatctctagctactatgattggctagtacagctttaacagcttggcagtaggaaaattggatgcactgccactcatgcattctgatttctgaaaatcttcatgttatcaaatagttttaaatatttttaggatgcagcagtgcgtatctaagtaggtgtatctgtcctgagtgttacaccaatttggtctattaggtcaattgatttagactttttgtaagctgcctcacatcagcatggcaaagaaagttaagcttctgttgaacatgggacatcatgttaaaccactttgagtgagagtctgcatccatgttattttccttatagacactgaaacagtttgcttagtctttctgaaacccaatcagactatcagaataactgggatcatttacatgcatggtgtatcattaagagatgtacctttctggcaattgattagctgacccagatcaacaatggagatggaacacatcatagtccccatgtcaggttagtactaatttagtacataatcacacagcactgcatgctggtcatgctgtataattgccaacacaccaaacttcaccaaatctctctggcaaaagtgtgtgaaatgaaactggatgggggttactctcaacagtatcctatgctggatgctctgtactatagtgaatactgctgaacagatatcagtgggcatcctagagtgtcttagctgtttttgtactgtgaaaagagaggagctttgggcatgatgtgtttgatacaacatacaagtgtactggctttctatttcacacagcattcttttttgtctcccatggcacaataaaatacactgcacctgcatgttcttgcctctgaatttatggctcatatttacatccataagagagcagagatgtccttggaacagcataaggacatcaaccttttctcaataacaacagttctaggacataggactccaaaaagatgctactaccaagcacctttcatcctcatagggctcaatggcatcctatatgaacactgtaccacagtaatgaatctgtctagatgtctaataaaaaggccatgccatgagcctttatatctttaattatgaaacaaaattgatgccccatcaatgagtttacctaacaaaattttaaaactacaggaaaaataggagcaaaataatgcaatgcaatggtgaacaattagtgcattttctataattttggtgaaagtaagaaaatttgactttggaataaaactaaaagatcttataataatatgaaacggatactctctccatcctaaagcataggcggatctagaggatgatcccggtggtcatacgaccactaaaaaaatcctagcccaatgcataaatatacatatatgtgaaaagaaaacttttgagaaaaaaaaagagctcatatttaatatattataatgtacatttgatccatttatacttttaactttgttatatttaggttatttgaaaaatatatataatttggaccacccatagaaaaatcgtagacacgtcagtgtcctaaagattttggttgaatgaaatatcttattactatgaatctgaaatgaatctgaagcataattacttatattttaggatggattgagtagaatatagacaatgcatctgcaccaatgagaagcgtccacgtgtgcatgccgatgaagtgtcggtgctgacgatcgtacatgtgtgcatggctgtgcatgtgcaggggctggacccggtaacgatcgcgtcggtgttctcggcggcggagcacgtcggcgagaaggccgtcgacggcgaggactgcttcgcgctgcggctcgaacgtggcgccgtcggtgctctccgcctggggcgacggcgcggcggaggtgatccggcacggcatgacgggctacttcagccagcggagcggcctcctcgcccgcctcgacgactcgcagctcacccgcatccagacccccggcgcgccggcgatgtactgggagaccaccgtctcctcccgcctcggcgactaccgcgccgccgacggcgccgtggtggcgcacgcgggcacctccgtcgcccacctcgcccgcttcggcgccgacgtcggcgccgcccgcgccgtcacgcggatggaggaggcgtggaccatcgacgacgtcgccttcaacgtcgccggcctctgcccggagtcgttcatcgcgccggaggaggtgaggagcggcggcggcggcggcagcagcagccgccgctacgacggcggcggcggcgctatcgccaagaagaagtgacgtcacggacagaatgtttttttaattaattactgtctcctaattagtgattagcttgggtggtttaattaattattagttaacccggtggatcaacctggagcttttaatcaccatcagcagcaagtgtggcatataattgcttagttagctaggtgagtgtaattttttgttttttctctgttttttttttgtttgtttgtttcttgtacttattaagtgaggccctgggatgcaatcatgcacctttgttgtacatatgcctgtactactggattcacaagaacaaccagtatgagtaagagggttacacacttgagtctgtaaaatttattttttttctttttttttcacattaattatgcagcggtacaaattttcctctctttctt

SEQ ID NO: 11768 - DNA, 335 bp, Oryza sativa
ccccccagaacgcggcgccagccatcctggcgccgcccctctcccccctaggaccttctgcctctgggccacggctggcgccgtcctcacggaccgcggcgctagggtggctggcgccaccttcctccccccgaaacccttctgcctcgtggcattggctggcgccgccctccccaactgcggcgccagggtggttggcgccgccctctgcctccctgcaaatcgaaaatctatattgcacaaatgtaccaattcacagttcgcaatacaaatcacaattcatagtttcatacagactaaaacaagttccaattgcacaaatcacaatgccaaaa

SEQ ID NO: 11769 - DNA, 592 bp, Oryza sativa
cctgctaagattggcaacattttagtcacatctaaaaaccttagctgcataaaatgaactgaagagtaccttttggtttagtgctaatacgggaggtgtgtcgatcagtttgcttatgcttctgcagccctccgctgttaactttgggcgtcttctttggtgcatcctgaaggggggaaaaagaatgtgttagtgttgcagatgcaaccacacaacattggcaattcaccaactgctacaaatactaattctaatttttcatacatttttgcaaactattttttcataattcatgaaaaaaatgtttaagtatttcccttgagaggcaataaccaacaaggatacagtgttgtcctcggaaagctaacacgctagacttaaaattcacctctaagttgcaggtagcaaggattagcacaagtatcagtcgtcctggccactcatttattacatcataggagtagataatgcgagcaccttacgatgcattggcaccaattgaggtttcagaagcaaacaacatttacaaagcagtcaccatcatcgaacaggatttgcaaatgcgaacctgattcagtccattgacagtacc

SEQ ID NO: 11770 - DNA, 14583 bp, Oryza sativa
  unsure (1)..(14583): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctttgtcttccatccccacttctgcaccactccattcccttccattctgatcctcttattattcctctctctcctcttctattacgtctgtcccataataattgtatttcaaatcctaaaataattatcacaatagagtactaattgttccattaatcacttgtaattcaattttttttcccattttaccctcaaccacccttccactctcagctataagccatttaataagggacatcatagtatttcttcttaaaccttaatatattactaaacaacctagaattacaatttatataggacagaggtagtatctgatacttatggtatggatgtgtgtcaccaccggttagttgtggagccaaaaagatttttatgtccagataaatttcgatataactagtagtgctatttgctatagaaatttcaaaccatcaatttaatcattaacattaaaatttaacggagctttcgtcgatgagcccgagcggctgtccggactagccagacggtgactccgccactaccaccagccgatctgatcgatctgccattaatatttcttttggtacacctcaaaagagaataacaagtattcgttttcatttaaaaggaaaaaaacttggtacaatttttaagaaaaaatcggaaaaaaaatcttacgatcgcacgattaattataagaaacgggaaaagaaaacacgaggaagaaaaaagcactggtcgatctgccattaactcctggagcttttgggttgttggcggatgtggcttcatcttctgctgctgcttcttcttcttcttcagctgcgaagtgcagtggccccacatgcagtagaaggaggaacagtggtacagtactacagtgtagctgtgtagtggctgctgctagctaatctgaatgtcgaaagggaaaaaaaaaagggtcatggcagtagtccacccaacgctatggataggtagactgttgttgttaatggctacttcgaggaggaggaggaagaggacgacgacgatgatgacaactgccagcggctcatccaactagaactgaacgagaactgaactttttagaccggttcgagaacacaaaccagtcatcaattatggcaaaattgcatgaccattctaattatcatcttagttttgagatttcaccttataacctattttattgcaagaactcacccacccaacgttatccagtcgaaattgtttcctttgcgcatatgagaagttaatttgtcggcccactttaacgctcggtcgctccgccttcgggggcgacgcgggcagcgaaacaggccgcgccgctcccgaccccctcctcccctcccccacctcgccgctgcccgagccaccgccggcaaagccaggcggctgcaaggacggcggcggcggggctctcttccctcgctcgcagtcaagctggttagggcgccggcaagacggagctcagggcaaggcgccggcgccgaggagaaaccgacggcggcgtccagatccggcgctgggatgcatggatccgaccccccccccccatggctggatttgttgctccgggcggcggactgccggggacggcgagtgggcggcgcggaggtggcagtgtcggtggctggagtggcggcgtggcggaggaggcagcggcatggccatgtctgcagtggcaggcggtggccgtggccagatctgatcggtcggctggcgctggaggtggctgcggtggcggcggcggctgcggtgccggcggcgtctgcggtggctggtgacgacggcgacagctgaggcagctgctacggcggttggcgacggcgacgactgcgctggctggtggcgacggtgacggctgaggcagctgctgcggtggttggcgaagacagcgacggtcgaggcagccgcggcagggaccatgcggcagcggctcaagcagccgcacctgtcgtggcggctgcacgcggtgtcggcctgctgcggcgggagaccggatcccctccgttgaactgctgtggcggttggcgacgaggcggcggcttgcggcgacaacggctggctacggacagttggagacggcggctggctcgtagctgccgcggctgtggaggcagcgtctggcggccggggacattggcggatgcgacaacgtctggcggcgtcgtatagatgatcgacggcggcagcaagtggaggcgtgacggtgggaggcatggcggtcttcgacggctagccaggggcgtggaagacgagcgcacctggacggcgcagcagcgatcggaggagggtcgggggtcagcttggcacagagagtcgcagccgatgacaggagaccggattggcgcgagaggcgcgtccggtggaggaggccggcacggcgcgagaggcgctgccgacggcgacggaggacggcttggcgcgagaggcgcggccgatggagggaggccggattggcgcgagaggtgcatccggtggaggaggccggcttggcgcgagaggcgtagccgacggtgggggaggtgacctcggtgtgaggaggagctgccggtgggtgtggtgcggtcttcgacgcaccaaggctgaccggcgagggacgccggtgcaggggtcccacatgtcggcagagcttgagtgatggtggagcatcggtgcgtcagccgtggattcgcaggtggtgagcggcaggtgaaaacccagctcggctgtagctgaaccgacaatgatggttcattccccctcctgagggcgttgtcgtgctgtctcacccctcaagggcggttgtctggcaaaagcccagtcttgacttctttgagccctgacggatggcggcggcggttcttccgtcgcttctcttcctgaagacatcattttggcatcctctagggggcgatctcgtctatgttcctttgttggtctagcggcggtcggtcacgcttagcggcggccggttcggtgctagccttctcccgggtgtgtgtgtgtgttggcgctgtcggtgtgtgggcggtggtattttttttctttttgctggttatgatcctccagggttgtaatcttgtaattttttcctgctctatcaatagaacttcgcaccgtctcgtgcgagtcgttcaaaaaagaagttaatttgtcccatttcttttgacgtagattcgcagcgggtcatatcacctaggttaggcccgtccagtgtgcctataaggtgagcccgactcgagagagctcttaggctattttttttgactcgatattaggtgaaggacttgcttgctatgagttgtaagcaacatcattcttaggtgatgacaagttctagttggactcatcacataaccacgctggacaagcttgacctgcctgatatggccctcgtggatcgacattagaagaaactagtaatcgcaatgcacgtttcccacattagctatagtgataatataaaacacttaaatttttttgcacttttcatgtaatatatgtcacacaaaatatacaaacatactaaaagttattatagtaacttaacatactcctttaaacactaaaaaaaatgcaaagcagctaacaataccaaccataatttgccatagcttgataaaaacttgaaaagctcaaagcaagatatttttcttagtgctattgaattaaaccccagtacccacagcatacaatatctaatactccctctgtctcattttaagtgcaaccatgatttttcgtgcccaactttaatcgttcgtattatttgagaattttttgaaaaaaaataaaaacataagtcacacataatttcatgttttatcatctcataataataaaaatactaattataaaaaaatttcaaataagacatacgatccaagttgggcacggaaactcatggttacacttaaaatggagcggagggagtaaaaaaggactttatgttttctccaacaatacttcaaatatacccctcatggccagcaattaaaaatagcatttacatgatcaccaatgagatgtatataggtcctacaggtcctaccgtgtgtccacataagttcatgtggtctacaaaacacaaatttacatccatttcacttgcaggaaatggtcatcacataattccaaaaaaaaatattgttcatagttgccttaattgaagtaaaaagtagatagcaagtgtgaacatttcagaaacactaacagttgtcaaaacgcctatatattttccttcaccacaatattaatctaaagaggtcatattgctaaactatgcacacacctacagttgaagtggcagccacgaaatgacctaacaatcttgaaatctggaaaccaatatatttcatggaattccctcaaggaaaggtttcctttgttagattggaaaaaaggaaacatctcaaatcagggaaatgcatcatctgaaattggaatagtgcataccttttcaagattcaatgtaatcctggagtccacagccacactctttttcttgtgaagctacaaataaataatatatccacaatgatgatgaaaaggatttaaaacatggatagcagtactggtttaaaaaaacatgaaaagtaccttacaatctgaaagctcgagaagacattagcatcaagcatcttcctgagaaaccaaataatcttttagccccatcaaatttttcaagcaaactacgtatatccaaataaaaagaataacaaaccggctaagcaagcatatgctgatagataaaatttatgaattacatcgttagtaattagaagtcatcagcacaatgcaaatattcaaaattccaaaaaacacatctttacttgaaattttcagggaagaaataaggagcatcaaaatccttgcttataacttgcagaatatacactgtggattcaaccgatgcactttttaaggaaatgaagccatggttccattttcctgagctccaaaattgatcattggtatatataaagaggatattcacttaatatgaagcaatggtcaaaatttacttgttttttataggtgaggtcccaagtgtcctctaatagatgttaccaaaagggactccagaaaaacaacagcttcatgacagaacttcttaggttcttgagtagcctgcaattaaaactttgtgcagaaaatgactattagcaactgtgaaagaagagaagaaaaaaaaaggaaaatcgtgtttgctcaagttgcagaacataccactggcaccatggaacataagaaagtaccaacagctacatctcaaagagattgtatgggcaaggcatctaatatttacacatttgttcctgctatacctgcacattggctgaatttccctttttcttctttgcattggaagaagggtttgatcctcaaagcagaaacattgtatcttactgaaataaattgcagccttcacgatgaaaggaaaaaggttgtaaactcaaaacattaggaatctgattactcttagcttaattgccacagtgatacacctcaatttaattttaatcagcaacataaatagcatgatatagtgaagtcacatgagtccttgccaatatatttccaaatctatacaaggttaacagttaaaggtctagggtagctttttggctctttagtacatcaaccaattataaatttcaatcagaatataccaccaatgccacacaaatgagctaaccccatgggcaatatttcagctcaaaggaaaagtaaaataacgatagggaatgaactatatacattgacatattatgaactttaccatggccgtcatgatattaacaaatggtacctaaatacatggacaactcctttatgatatgaagcatccaaccttggactctgggatcatcacaacatacctgcagaaagaacaaataagttagtaatggtcatgattgtttgcacatatgtacatgtaacattcacttacattccagcatttttttactcctgctacaacagaaggtgcatctttcaactccaatacattgcaaatactgatcacagaacattaataccagaaccccaatactacatttcaactatattctattgaagaaaatgtacagtaccagtaagacaaccacttgcattgctggtggctcctggatcttgtgtaaagtattgaatgctagctgtcttgaattcactttggcgacacccccttcctgagcaggacaaaaacctgcacattttcatgtttttcaattgacacagtggcacaaagggcattttcaacaaagtatgaactttatactccgttacgcatgtttacaaagttatacttagtttcttacagaaaagtagcttagcagagtatgcatgtgaaaaccattcaaaaatgggattgaatttttcaacttcaaagaactatacacttctgctgacaagaggaattttttttagttatgcattataaacaaatgatatgacctgtgtgtcagttgaaacccccccccccccccttcctagcaagttcatgcaaatcagttaacatgtaaggtcagaagtaagaaatttagtgtcctatataggtcttgttgcccatgttcatatttcctcaaaaaggatttaataaattactctcaatggccttcatataattctgttgagcctaacatgaaaccactcaatcaccggtccacagattgacatacatttcacgggtagaagaaattttcattggacattcaaattagtctttacctcaatgctttcacttctagtgctaataggaaaaaaaaagtcataccttccaggagaatgtgggtgctgaagttgatttgaaaatgggaagcagggtgcaggacgatggccagattccaaatggagccaagagtggatgaaatcagggcagtggtgttccaagggcgtcagtggcaaatacaggatagaaatagagggtaggttcgacctaaaagaaccaagttaatttatgggtttgtatttatatcttaaaaagaaaacaatagaaacaacatgcagagtcttttttgacactatattctaaccaattaaatttatctaaccaattcttttgaaatgatcttataaccttaccaacaaatataccatccttatttcatctctcatttcgtgacaaaacttacctattgttattcttattttgtgcacaatcagcaaaaattccattctgttctcatcagtttgattggtactacttgaattgcttgcataataatttaacaacattgttttcttctccatcgaaaatctacgaataaatcaaaactatgaatcgcgaagctcaattcttataaatcacatcatctagatgcattactgaaacagagacgaagagtatgaacaccggcaccgggctaggactcaccgcttgctctgctagctgctgctgcttgcccctcgtcgtctgatgcccttcatggagggatggcctgatctgctagctcctcgccctcacctcctgctgctcgctcctcgtcgcccggttgccgcgtctgctcgtcactacggcgctgcgccacaacgctgcagcctgccacaactgcttgccacattagctatgtactactacaaattaatatgtgaaatgaggatgacctcggctccgttgagcgcagcggtggactgcagtggcgtcgccggatgggaagacctcagcttcgagggcaggggaagagggggggggggcctgggctccggcgacggactggggaagaccagggctccggcggcggcagcaatacacgcgaggaggagcgtggagcacggctccagcggtagctggagaagaactcgtctccaggggggtggggggggggggcagcggtgctgtgcgatagtggcggagacggaaggggacgacctcggctccgacggcgactggagatgacgtcgtatggggaagaccacggctccagcacagcagcagtacacgcgaggaggaggagcgaggagcacgactccggaggcggatggagaagaacttggctctggcggcggtagcggtggagtcgcgcatatagagggtgaggcgtagtcttcgcacggtctttgcgcgtagagggagaaatttctgcggtggagatggagatggttaaatcgcggaggacggtatggatcagcgatctacagatggacggtagggattacatctatcaacatgtaggattggagggaggtaactcatcctttttatattagtatagatatagattagcccaatcaatgactcatccgcacgggaagggggaagaccaattttatccaggtagcgttcggcgggtaggatttttgctgaaaataaaatataataagtataatcttaaaacaaggtttataattaggatcgtttatacaattttacctttaaccaaactaaattttataacttcagaaaaatataactggatttttgccgagtcaaacagttgacgatttttgcgagaaaaagaaaaggtttaaccctgttttggcttgagaacagtttggtgaaccctgtctctgagactgtagcctgtaggctacttcggggtaggatcacaacgggcatttggtgtactgcctctgtttcatattataagtcattttgattttttttgtcaattttttaaattttgattgggtttattagaaaattttggcaacatttgaaactttatttaatctaacattgaatatattttaataatatatttatttcgtgttaggaataccattacatttttcataaacttgatcaaacataaaagttttactaagaaaaaagtcaaaacgaattataatataaaacgaaaggaacatgtatttgtattttacttatgtgcatgatactctgattaattatcgcctacgacattatgctgtattgatactagacaataacacgtggagatggaattgatggagcacgacggtatatactgtacgacggtatattatctcctacgacatttcaaatggtttttaaattgatggagtactcaattgtaagatgaaaaggctgaaagcgtttactgatcgtgaatcatgtggcaaatccattttccaattaaaaaccatttgaaaaaagaaaaggcggttggaacagatggacgagacgctgttggaagacgacgggattgttcagagttgtgggattcacctcctctgttcgctgtgcttgctctgttcgagaggaatgtggtcagcaacatagcacagcacctgacaggctgacatgcttctttatacttctttatattatacatgtagaaaatagggtgacatattagcacataattaattaagtattacttaaaaagtaaattaatgtggtttttaaagcaaattttttatagaatacataccgtttagtaatttgggaagcgtacacgtaaaaaagagaaaggtacggttaagacctattactatcaaagatagctcaattccagggttggtatatagctgatcctcaaagtgcattttccgttttatatgtttgagaggagaggaaaagataagattgagaatatacgcaaaacgagatgagccattagtgcatggttaattgagtattaactattttaaattgcaaaaatagattaatatgatttttaaagcaactttcctattaaaaagttttaaaaaacataccatttaatagttcaggaagtgtgcacgtgacaaacgagagagaaatcttctctttcacctgctgccgaacgcagttacaagaggtgcaatttcaactttggtgtgtttggataatgtgaaatgaggggtgggattgagattgggaaataaataaaatgttaggattaaatgggtgagagagaatgaatggttaggatttaagatgggtaggaaatcatttgccttagacatttgccaaacactgccttactggaataagaattttgaagtagaagctctctgtatcgaccgtcggccggccaggataagccatcctagctcaagctgtcaagtgattgggcgaggctagaaggcccagcaaccctgccagtcaactgggccgataaattctgcttagacataattgtgtatctgtgctcaaagtctaaaatagaaagtactcctataatgttttcaagggaagatgcatgcccaaatgaccaaaatgggctgatgaaattcaatgaactagcagtattttaaattcagttttcaagttgtggtgtggcacatccattttaaatcctttttttttacctacctcaccactcaacctttttgccctcaggcctgcaccaggtgtggctgctggcctgctaccccaaatcatgtcttcctttgcttccattgcaatgcaagtcacacacacacacacacacatggcacattgctcattgatcttagctatctccttagccatggcatcattgtatttgcagactcttgcagggtataaaaacccttgtttactctctgcgactgcaccatctccatgacagcttagttagtttctctggtttgctatatagatttagacacagatggcgtgcttatccttgctctccggcgttcatcccctaccactactcctgctcattactctcttaggtactccttcgttctagaataagtttacttttcaaccctccgatttatcataaataaatttatttttagtcattattatattggagtttgtaaaattaggagatggatacattaagagtagataaagcaaaaaataattgtatcaggatttgataaagtgaagatattttagtcttttaggttttaattgatatgtggagaataggaaaattgaacttattgtaaaacggaggaagtagatcacatccatggcttttgtatattaaattagttccattaaaatctacaataaaatatgtctgatttatttgaaactgaaattgctagctatttttataaactctgttaaagagagagaataaaacctacgttcttttaatatgaaatggataccgtaaatcacacccacctacgttctttttcttttggcaaaatttacttttcagcattggtaatttccatgaattttgttgtgctgctgtggatgatgatcaggaccggtggcgctcgtgcgcggcgtcaccttccgcgtggtgaacaagtgcccgttcccggtgtggccggcggcggcgcccaacgccggccacccggtgctcgccggcggcggcttcctcctcccgccgggccagtccaggcgcgtcagcgcgccgcccacctggaacggccgcttctggggccgcaccggctgcaacttcacctccaccgccaccaaccaccacggcaacgccgccgcgtcctgcctcaccggcgactgcggcggccgcctcgcgtgcaacggcaccgccggcgcccctccggccaccctcgtcgaggtggacctccacgaggaccagagcaaggggagctcctacgacgtcagcctcgtcgacggctacaacctgccggtggccgtgtggacgaagccccccacccccggcgccgccgccgccgatcgcaagtgcgtcatccccggctgcgccaagaacgtcaacgcggtgtgcccgccggagctgcaggtgacgacggcggcggcggtggtggcgtgcaagagcgcgtgcgtggcgttcgggacggacgcgttctgctgccgcggcgcgcacggcacggcggagacgtgccgcggcagcgcgtactcgcgggtgttccgggacgcgtgcccggcgtacgtcagctacccgtacgacacggcggcggcgaggtgctacgcggaggtgtacgtgctcacattctgtccgtccagatggggcgcgggggcagatcgtgtggcccaggcttgacggatatgatgtgagacgtatcgagtagacgagtaacactccggcatgcgtgtatctaagtaggagtagtatgtactatatacggagtatgtatttatacgtgtactattacgtatttacattcattatcgggcgaacactttcgttatagggttaattaagtgcttcctcagttttaaaatataaatatttttagctacaaaatctaaataaataattatctatagatacatagctaaaatgctcatattttaggacgaatgtaataagttgttaaagttcagtagttctctgtaaaaagaatatcacgtacgtacacatggcatttcatagtcgcatgcatagtagaattaaaatgcctattatatcctcacctataccatagaaaaaataaagggaaaaaaaagcttggtacattaccatgcaattaattaagtaattactataacgaattaaaacactggatttgatagatttcttatggaacttatataaatattgtctacatcaacttttatattgactagttagatgcccgtgcgttgcaacgggtaaaagttataaaccaatttaaaagcacacagtaagataatgttaaataattattaagtgtaattcctttataataaaaattttaatatagcacgaataataattatatcacatgtttatagttttcatatggtagtaatacaaatctacaaacaacgaaagttggtgaataaaatagcatgtgagttgtatcagaaaataaaaacatttgaagctaataaagttcacgggttcacgaacaacattcgggtgaaaatacttgtagttttgaatttgataatctgatcgaaaaaatagttaacaccaaaatcctttcccaaaaccatgagctagacgattactcttgctaactccaactatacaatacaccattttctggaactaaatattgacactaccatcctttcacaaattaataaaaactctacgtattgacactaccatcctttcacaaaataataaaaactatacataaaacatgaggttgattgcttttcataattccatctatactatacaccattttctggaactcaatgctcattcgtttacttcttccggatgcttctcactggtcaatatgaaatatgttatacttgaccaatatcgtctgaatatcgagcaccttgtcttcatcagctttattgagatggttaagctagcagtcagcagtgaattctcagataaaacaacaattaagagctaaacaccaatagaaaatcagaaagttctatactacttcatacttcagaatgaattaaaaaaacttcaaattttcaaccagcaagcttaatgctgacttgaatgacaataaagggatatcatctttaaaagttttgttgttatgaaaacagggaaatgaatttctagattaacttgcagtacaatcacatccaaatttattaaataacatccgcaagagtagttggcctgaatttaagattaaattaaaatacagttaaaacttaggacaaatatgagtggcacaaatatgaaaaagagctcgagttgatcacgtaattttacctttctatttgcctataggaccacaatttacaaagattcatacatgcaaaagtggctatgaaagaggccatgctagctaggtaaatcctactcgtaaatgttaatttgcaaacactgaataccttgtttcatctccaagggaatatcaatgccacacattcatatgcattttgcactaaaaaagatctaaaattcagaggcaatgcaccgacaccaacaaagaatgtttaaataaatagataaaagaacgaagtgtttatagtagcacctttgcagcataaggatcacattcacatacattgggttttgcatagcaagcatagagtgcatgcacccagaaagaaatattgaggggaacatgaagaggcttccttgaggtatagatattgtctatagctggtgcctggaggacgagaggaactaccaatctgcaaggcaaacatattggtaaaaagacaattttccatcagatatatgattctctaattttgattcaagcaaatggattctctaacaatggacataaaattgaatttgtgtatcacatatggttcccctgaagatacatataatatttcttgaataaacaacagatggctatgtgggataattttctctatacaaaatagtttttgacctctaggctctaatattaccaatacgtaaagcattttaaagcaccaaaataactgtaagagaaatcgcatgtgcatgtgcagacctatttgtgcagaggaacaaacaccacctaaaaagaatcaacaagtagccgacaatgttcagtaggaactattttatactccctccatcccaaaatatttgacgccgttgacttttttaaaaatgtttgaccgttcgtcttattaaaaaattttagaattattaattcttttcctatcattt

SEQ ID NO: 11771 - DNA, 6494 bp, Oryza sativa
cgtcaaacatttaggaaaggagggagtaataaacatgaatagcaagtcgatcataaaggtgagtgattctttatcttggttataatctgaaattccaaactgtgatcttctcccaaacaatatgcttacgtgttcactttcatttggtggcactattctgctgcagcagttcagcaaaaataggaaacctcggcaaatagcaatttcagaatcactgcattatagccaatagcagtcatctgatcatgcacacgacacatgactggatatttgcacatatggtttatattgtgatcatggattatttaattaaagtaatcagaaaacaatggtttcaaacacatgactggaaattgactgcaacttaagcccagtttttgcaccaattaagcactgcatccaactcagggccagtcaggacacaatttacccaataaaactcaaataatgacttgacacaaccaaatgacaggaaaaaatggaagaatatttgactcataaaactcaaataatgttgccgcctcgtaagataaaaataccgtaactctaatcaagtcccatgtcacttttttatctgtgtacaagttactcatttcaatttatctgtttgagatcagtcacagatcaagcataaaaaaaatacttactttgctggattcaagggccattggagcatttcctaaaacaagatatgtgtaagtgcaactcgatctgtcaattaacctgacagaaagaactgaaaaggttacttggaatttttaaagaacataagcaagaaattcgaagcctaattataacattatatataaggcagatcttgctctaaaacataacaaatatcagaacattgcagcttgcaactatctgtagccaaatccctgtaacgtaaaactaaatagcagtctaggagtgtttcttgcaaccacctgagctgaagtcatcgtaagtgagcataatcaagagattagagggttggataaggaccaatgtctaacacaaatcagtggtgcggcactgccaccaccaaacccaatctgctgaacattagagggaatcaccaataaaaaagttcaggagcaagaattggaatcgaattaccagcctgatccattgtatgaaccacgatatgttatgatgttgttactgatgcagcaaagcaagattatagggagtgcgagacacgtcggcctcgggcgctccggagaccagtgacggcctgaatggtttgtggagcaccatcgtcggcgagtcgcgggtgaggaagagccgacggcggggcagatgccactggtggtcgcagggaggcagagaggccgacggcgctccgctgtttttgtggatcaggattcaggagcagatggggaccgcgataatagggaggatatacgcagggcaaccgtcagtggtggagaagcagcagcggacgacgtcgtctcgactcgggatcggcagcgcccgcgcccgtgccgacgcctgcaacgacgacgatgcatggtgcttgaggcggtggattgaacggcgcggtgtcaatctggctgcggagggggcgaggaggcaacgccgtctcgactggggagggaggcggtgtggtggatgcaggcgagcaggggcgacggggcggctgcgacgatggggaggggtgcggcatggaggagaaagggatgggagtgccggggaggacggcagcgacggtgaggaaggaggaaagagggagagaacggatcggggatgcgggcggttgagggggttgcggcggcgtggatcggggggttgagggtaggggagaggagagagcgatcgagattcgagggagacgcgtgcgctggatgcgtaggaagagaaaggcgatctgagccgttcgattaggctatcccacgttctatatttcgcgtgtttggagtcaccgccaccactacggaacttttaagtagtagagatatccccaaaatgaaaagaaaaaatgactccacaactaattgggccggaatcacacggagctttgggaccaagataaggaaaaagtacgccgaaggtccctcaacttgtcatcgagttacaaaattgttctccaaccgtaaaaccagatatttgacgtccctcaacttacaaggtcgtacgctttaggtcctttagtggttttgacctcggttttatccgacgtagtggctaagtcaacgtgagacctgcaacgtcattatctcttttccccacttctctcccttcctcctccctctctcacttctctgtgcggcgggtggggaggaggctggcggggcgaggcgggagaggaggagggcgtcggtggctggcgacggccaacgcgacagtggtgtcagtggccaaatctgcgcttcttggctgccgccgtcgccgcacgccctagtccgcttcactagcggcttctcggtggtctgcaagggtggcgcccgacagctgcgatggcagcgacgcgttcaacaaagccacgaccagcaacaacaagaaacggcagcaacaagaacaagaaaggaaaatcaaacttttttctttcccctagtactgttctcgattcattgaggcttcgaaggcgcacacagagaaatccacacagaaagccacaagaactttccaaataagatcaaaacttacaatcagttgattagttcttgtaatcaagaagaggaacgagtcaattagaaaatccaaacaatcactagtggagaaatcgtttttagtcccggttcgtaacccccctatagtcccggttttcaaaccgggactatgaatccgggactaaagataggcccgggactaaagatccctatctttagtcccggttcaaatacccaggactaaagatcgatctttagtcccggtactaaagatgggagtgggcaatagtttttttttcatttacttactatttaatctctaatttattttctcccaaattaggtgggatgcgtaccatcccaaatacacaaatcaatcatatacactacagattatacatccgaaatcaaaccccaaatcaaagaaacatcccaaatatacaaatcatacacaaatcatgtacatctcagatccatacaatgagattccaaaaaaaaattatacatctcaatccatacaatgaaccacagattcttcatctcaatctacacatggatcacaaattctttgaaaaaaaaaagaaaaaaaaacgaagcaaagccgccggccggctgagccggccgccgcctcccctcctccccggctgccgccgccgccacgcggccctccgcgccggccgccgccgcgctgccctccgccggccgggccgcccaccccctcctgctgcgcacactggatcgagttgggaaggggagttgggaaggataagaagaaaaagagataaggaggaagggaagagataagattagagatggagggagagaggagtgggtgtggatgagaaaagagtggacgaaaaaagaggataagtaatagggattatatagtgtattttgatctttaatcccggttcgtaactccaaccgcgactaaagatcctggaggggcctgacaacacctgacagcatgtgaaccgggactaaagatcatcggtaacaccaacctggactaaagatcacgtagtctcgttctacttataaaccgggactaaaaaccatctttagtcccggtttttactgcatccgagactattgtggtttttggtcgaccggacaatgatggtttctccactagtgaatgaagatgagcgaatgggtataagagactgggaaatttaactatttgccactattagatttggcaattatcaaaatgcccttcttatatttgtacatacttttttccctcttaagtggtggttccttaactattcgttacttttgcccacgtggcatgccaacatggcatataggtctaaacgggctccaactcgctccatgtgctgacatggcatgacacctaaaacaaattcggagacctaaatatgtattttgggagttcaagaacctggatgatacactcgcacaagtttaaagaataccgtgtacatcactcaaaatataaattgtcgtcctcctctcccaatcgtacttccccacacaaaaatcaaactgtttcaaaaccaacctaaactataaaaagaaccattattccgacgagaagatttgatagacaagtcgttcgtattgctctaaatcacattgccacgcatggacacgttggtactaaggataaagataagggaaaatgtacgaattacccccccaaccctccgaactatcacgttcgaccgaattaccccctcgacccaacccagagcggttttgtcctacgtggcaatccggtcagcattttattttttaaaaaatggtgggacccacatgtcataccccctctttctctcttcctctatctatctctctctcagtcagtcactggcagcggcgcgcacgccggcacgcatggcatggcacggggacgagcggtgggcaccggcgcgcgggggcgagccggcggtcgaagtgcacggcggcacgcggggagggagaggtcggtgcgcacgacggccatggcggagaggcgggcaacagccggaagtgtcagcgaagggaggtagagggaatgggggtgagtggaggtggatggggaggtggaggaaatgcagggagtaggccggcagtcggcgcacacagcggcggccatggtggagaggcgggcggcggcgctcgccattgtggcgctggcggagaggcgaaggtccgcgaggaggcagccacgcgacggcctccgcctccatcgccgacctttcggtccgtctccgtctccgcgagctctgcctcagccgaccgcccgggcgagctccgcttccgccacctccgcctggtccgtccctactcggtgactccgactcggagcaggatggagaagaggaccgccgtccacgctgaccgccctcccccgtccccacgccggcatgcgcgcggcgcgccatctcgcgtcgaccagagatccgctggcgagcggcaagagaagaggcgccggtggagatccgccatgctcaccgcccgtagtggccttccggccgtcgccccctgtgcccccgccatcgccgccggccgctgcgcccccgtcacgcccgccgcacgccacacccattgctgccgtatgcaagagagaggaaaagaggaagaggagtatgacatgtggatcccacatttttttaataaataaaatgctgactggattgccacgtgtacgccacgtaggacaaaaccactctggattgagtcgagggaggtaatttgtccgatattgaaagttgaaggtgaacgatgtttggttttcgggttagggggtaatttggttgaccacgatagttcgggaggggggtaattcgtattttttccaaagataatacacctatatgtttccattagcccaatttcctagtgatcaaacccattgtacatttgtacgttaagtctattgtgtgatttaattttcacgttcctctcagaacaaataaacaagatcaacaagatgagaaacatttctttctcagatcacttcagctcttttctcacagaaaattgcaaatcaaacataaaactaatgcgctcaagaaaggccattaagtgcttcttgccgcgatggtgcaaactctatggtaagcgctggagccaccatgtatcatatcctattttgtaacatatcctattttattataaagttgacgtgtactgactactaaagtttaatatgcatgtgcgccacatcatcatgcactagcaattattatctagagtattttaaatatcatgtaaatatgacatatcattttataattttgttgtatcttttaaactcagtatgcaagcaatgtcaaatcattatgttcacatcgtttttacattatttaaacatataaatctatcatttttataaggaaaaagtacggattaccccccacccgaactatcgcggtcgaccgaattaccccctaaaccacaaatccggacattcctgactcccaactatgtaaaccggacgaattacccccttgactcaatccgcggtggttttggtttacgtggcatacgcgtggcagttcagtcagcattttattgattaaaaaaatgtaggacccactctcttctctctctcactctctgtcttctctctcactcttcctctctctcacgcgcatagcggcgaggacggcagcacgcacggcgcggcggcgcgcacgcacgcggccgggggccggaggcggcagcgaggacggtggtttgccccgcgcgctccatcgacctccctccgccccgcgcgctccgtcgacctccctggctacctcgatctccgggctgtgctttcccttccttcctttcaccttcccctccattggatcggtgctgtcgccgcaggagctcaccatcacatggcccgacgactgacaactccacctctgggaaggcgatgtcctctcagccgtgctccccgca

SEQ ID NO: 11772 - DNA, 1613 bp, Oryza sativa
tctttagtctcggttggtagcaccaaccggggctaaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgtttacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgatcggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtattttcctataataccacggctaaggcgtttgttcaggaacaaggggaatgctagaatgt

SEQ ID NO: 11773 - DNA, 249 bp, Oryza sativa
gcgtgcgtgccaccgtcctcactcccgtgcgcgtctcggccacgccgccgtcctcgccaccgcctccagcccccgaccacgtgcgtgcgcgccgccgcgccgtacgtgccgcaccgagactaaagatcttaactttagtcccggttggtaataccaaccgggactaatgatggtagagaaaccatctttcgtcggtcggccgatttccacaatagtcccggatgcaataaaaaccggggctaaagatga

SEQ ID NO: 11774 - DNA, 357 bp, Oryza sativa
accgtctgggtctatcgcgacatccagggataggggatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagc

SEQ ID NO: 11775 - DNA, 670 bp, Oryza sativa
tcctgcagccctgatgttgatttactattggagacgaaaaaggttttgtcctcgaatttcgatatgaaagatcttggggaaccccatttgttctaggaatagagattcaccgggatagaaaaaaagggttttagaattatcgcaaaaggcgtatctggaaaaagttctaaataaatacagtatgcatgagagtaagcctacacctgctcccatagtcaagggcaatagatttgaaaaattttaatgtgatgaaaaagttgaaagtttgaagaaaaaatttcaaactaaactcggccttaatttaaattttaggggttcaaaaattccaaattgcgttcggtataaaatactattcatggtttattatctaataataacaaaaatacaaatcaaacaaatatttcaaataaaacacacgatcaaacttggaaaaaagaacttttgactatggttaagggccctttgaatcgcaggattggaaaaacgtaggaataggaaaaacgtaggattttgataagaatgtaagtgtaaaacagaggattgcaaaacgcatgaaaaacccaggaatgaccgtttgattgaaccgcaggaaaaacgcaggaattagatgggagagatagactcaaagaaaagttagcaagaggttgaagctcttgcttaatttcttcca

SEQ ID NO: 11776 - DNA, 345 bp, Oryza sativa
tgcagcccttttggactgttggggcaaaatccaacgattgagtgtgggttcttttttgtattcgatgcctcaatcgcgggcaacgtttacatatttatacgagagtgtacaaagggaaattacactgctacccatattatcaactaatctaagtggctggctagtgggccagcttgtgggctctcgggtaattcccctagtgataggaggactgcgcccattaaggaagcagcgccgattcctgagggcgcccgctattactcgggtaatgccgtgctccggataatagcatgcaccgtcttgccctcgtcaacaatgtcaaaggtggttggcaggcgtgcagtg

SEQ ID NO: 11777 - DNA, 551 bp, Oryza sativa
  unsure (1)..(551): unsure at all n locations
attcaaatcaagaagcctgcaaggtatttatcaccagttcaatgactacaaacatatgtcatgttaattcatactgttgccatcaataaactgtgacagtcgcacatacgtaacagtgatttttcaaccatatctggtaattttttgactnnnnnnnnnnnnnnnnnnnnnntccacagatacatgtcgaatgctaaacaagagcgctacaggttcagaattatatgcaaattatcacattccggacaagcatcacacacctactagtcaagagtttctagtagcacgagtggtaagtagagataacatatggcaatgcaagctaacctcggtgatgaactgatgatggtcctgttcgacgggccctacacggcactgttaatcctccccaataatcacgagaagagactcttccggctctgcatccacaaccacacacttcagaattcacgcatccggaagcttccaagcggaaggagactgaagaggtaggaagaggagacgcgtcttacggtcatcggggtcctcggcgatgcgcttgacctgggcgg

SEQ ID NO: 11778 - DNA, 5899 bp, Oryza sativa
tgattagtagttagaataggaatgggaacaagatgagctgactactcgttacagtaacatctcaggtgaacaattcagatgtggccaattagacatttttttcgtgttagtacaactacacatccatgacagccaacagcactcaaacaaattatatggaattagggcaaatccagggtgaaaagatgtgctggacaggtacataggtgcttttgcacttcctggtgtatattcattgttatgtatgcatgtatgcatgtaaaagtactaattgcagataagaagcatgtgaattttcctcaaaaaaaaaaagaagcatgtgaatgaatcatttgttgctctcgtcttatagtaaaactaatcatagaaggaaaatgactcaaaagtgagaaaaaacttgtgccaaccaaaatcatcaaaaaaaagcataagtaatatccatattcaactaatcaggaggtttacttcagagcaaaataaagaaacagagaccataggcatttcgatcccaacaataacatgttgggaacatatgcagttagcataacataaaacgaagtaatttaaggcatgaccatgtaatcttgtaaaaacattgcatctataaaagaacttgaggaaatgtatttaggaattaggtattgtgacataggtcgctcagtgacacatgtcttgatcagtgtcaagagttcttgtatcccatagctagccagatagaaatgtgcatgacagtaaataatcatatttgtagtatgaagtacaaacaattgaagacatgattatgctagcagcatcaacaaaatatcaccttagcagacttatccaaggagcctgtttggaaaggcgatcaatctgaagatttggaaagtgaagtaattgttttctgatgtccttgttccttgtctgactccttcaggcattgtccagtctgtacatgcataaaccaaacagaatgtaaaagcatcccatgataaagttgatggaaaaacctgttcattcccatacagttacaaagtcagcatgtttaataaaaggtaaaacggcaacaaataaccagcatgcgttatgcataaatgtagcatgtttttggttagtgaacagacaacacaaactaccattttgtcatttgcactatattgccagactcaattcaaatcaagaagcctgcaaggtatttatcaccagttcaatgactacaaacatatgtcatgttaattcatactgttgccatcaataaactgtgacagtcgcacatacgtaacagtgatttttcaaccatatctggtaattttttgactatcaaacaacttcacttgtcagtccacagatacatgtcgaatgctaaacaagagcgctacaggttcagaattatatgcaaattatcacattccggacaagcatcacacacctactagtcaagagtttctagtagcacgagtggtaagtagagataacatatggcaatgcaagctaacctcggtgatgaactgatgatggtcctgttcgacgggccctacacggcactgttaatcctccccaataatcacgagaagagactcttccggctctgcatccacaaccacacacttcagaattcacgcatccggaagcttccaagcggaaggagactgaagaggtaggaagaggagacgcgtcttacggtcatcggggtcctcggcgatgcgcttgacctgggcggtcgccggtcggcaccttctactccatgaagctgtcggtggtgatgacgacgaggccatcgccgatggcgaactcgtctgagcgcgctcttcgccgccgggcttgtgcttccctgcgccgccggggaggaagggtggtaaactggtagggttagggagagaggatggggtgggggatctggaattctggatcggtgcggaaaaaccctaaccgggccggcccaatcacttcttggtatcatggcctcgtgggccgttgggccagtgtatttacatttcgaatgggaccacctatatatttgtcgacaaattttctagtaaaaatttgacagatgtaattatagtacaatcgtagtgtaattacactataacttgtatgtaattacactgtaacttgcatgcgactatagtgtaacttgtatgtaagtttcacgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgtttcgaataagttcacttgagctctcttagcttgtcatcgagtttaaatcaaattcatgaactgtaatagcagacataacgtgaccttcaaattgcaatatcgtagcattctagacaatattttatccggttttagctatcgtggtgaattcatggatcgtgttttttgaacggttcagggaaattcataagttatttttattttgcaaggacattaaggggatttcagaaattcaaaagttcttaattacacgcactgtactatgcgtgtaagagttgattcaggctgtgtttagttcacaccaaaattagaagtttggttgaaattaaaacgatgtgatggaaaagttaaaagtttgtgtgtgtagaaaagttttgatgtgatggaaaagttggaagtttgaagaaaaattttgtaactaaacacggcctcattttcttgaagaataactcaagctgaaaatatcttaatcacaatagagtaacagaagaccagacgactttattgacttgctggtgcatgggccagagcttgcagaatgtcaggaaggagggaaggtggagcaacatggtaagcgtacatgacaattgacaagttgacagtatacacgcgcgtctccgttcttaccgcgctcagctgtctcggcgaggattaattactgcctccacatcctcctcgacgccattgttgacgagcttgaccgtgtaccggagctcggcgacctgcctccggatggcgtccaccgtcgccctgacgctccggctgttgatgtaccacgcgtcgtactgcacggcgacctgctcgaggctcaggaggttggcgatgcccgacggcgggctctcatggctcgccgggcccgtggagagcttcagctcgaggtcagttagcttcggcatggccccttccttgaacaccagccatggcacccggcaatcgacggacaatctcaggagctcacggaacgggtagatgatgatcccattcttctcgtcgtcgccgtcttcttcttcttcatggatttttgagttcaggggagctctgttgcttctgttttgagagctggacatgaacccctgaccttggatcacaatggcttctcttgggaggaaatccagccccagctcgaggcactccaacctgtgcaaacgtccaagaatcttgacgccttctggggctagcttgcagaccctgatatgaagcgaggagaggtggttgagccctgcgatccaccgcgggacggtgaggaaccgggcgtgcatcgcgacgtgtcgcaggttctgaggcgcgtcttccggcgagaaatcgaggaactccatggagcagccgagctcgcagcggatcgtcagcgacctgaggcacttcaacctctggacgaggaagctcaggttgtcctggtactccttgtcggtgcactggcgaagggatagcgacacggaaagcacctccaggcaacgaagaagggaaagtttcctgacgacgtcggctgagcattcgcgtagatcgacagctgctagtgtctccaacgtatcccggagcatcccccaatcgatccccttggggatcctcgtgctcgccgcgccgtcgccagcgcgcagatgccgcagcgccactaggtcgtcgattcgctccggcagccgctgtatccgggtgcttctcaggtcgagctcctccagcgagcgcagggtgcacacctccggtgggagcttggcgatccgggtgtggctggcgtccaacgtctcgagcgagctcagcatcccgatctccggcgggagctcgctgatacgcgtgttcctcaggctgagatacctgagcaggaacagtttgccgctgctgaatatccgtggcaggtcatcgtctttcagcttctcccagccttgcagatccagcacaaccagatgcgggaacatttcaagagaaataccgtccacttctccagagaccgtgagcgagcgagtgaaggagaacatctcttccatctgcgccgggacctcctgatctgcaggctgctgctgctgctggccatggtggaggaacacccgccgtatctgcaggccggatgagccgcggagcgtgccggtgtcgcagcaactggtggtgacgaaattcttgtccgcggatttcgacgcgaggagctggaacatgaaatgattgacctggtagctgcaagggttgcattcacaatcgcacgccctcctcctcgtcctcgccggacggatgatacaccgctggacgagctgcgagaagcattcctctgctctttcctcgaacccgctctgcaacgtgtgcaccgcgatcagcccctcggccttccatttcctgatgaggaggtgcttgtcgatcacgtaaccctgcgggaacgtgctcatgtacagcgacagtagccgcagctcgcaggggagattgtcgtagctaggagacagcgtgtcctcgacttgcttcagttctctgattccgcttggcaaatatgctgcaacacaaggtctggagatatccatcgtcaccccactctgatctccttcttcgtcatcgtagtcttcttcctgcatctgcttcgacaccaggccggccatggcaattatgagcagcggtgtgccgtcgcataccctcagaatctcattggagactcgtccagaattggctggccgcggccaaccgtgagccactgccgagaacagcctctcggaatctgtcgcgccgagaggcttgacctcgtgcacgaggccgttaggccatgggtgcgagcagcaggagcgagcgacgcttctgatgcgcgtagtgattattatgcggctgtggcatctgttgctcgggaaagcatcccagatgtgctcccagtccgatgttctccacatatcatcgattacgatgaggtacctgcagcaattgtgtgtatgtatcacatcgccagcttaaaacgaacaaactggtttatagcctccaaaaacactgagggctgctttagatagtaggattgaaaaaatgaagaaatagaaaaaaaaacataggattttaataggaatgtaagtgtaaaacagatggatgcaaaacacaggaatagtcgtttgactgaaccttatgaaaaacacagaaattgaatgagagtgatagactcaaaagtaaattttttaagaggtttgagctcttgctaagttttcctcaaactctatatgcaatgagccgttccatcggaattttaagatttggaaagcctcaatcctttgaatcaaatgaccacatagaaaacattaattcctatagaatttgaatcctacgaaattcttaaaaaaaaaattcttttgattcaaagagcactattttggtacttgcgatttctcattaccttaaaaataagtcatataatgcattcacaatataatttagtccatgttggggggatggctccgggtagcggagccagcctccatcgtgtgatgcagcacctaccggagccatccaccctaggagaatgaccggaggcatctacgggctgcagga

SEQ ID NO: 11779 - DNA, 1926 bp, Oryza sativa
ttcttctgctgagggccagccctggggcagtgcgggaagtgcgaccgcactgggcctccaaaaattagggacctctaaaatatgtatactacggtaccaagcctgataggctactttgtgcattgagaagatgctggtaaataagattgttattgacactatcatcactgattgaatctagaactattagaagaaattggtttaaataatctagagatatttttttagtaattagtgtgaaattcgttaatgacaataagtttttaaatattatcttgtatttttatggtgaatcggggcttttatttttttttcgcactgggccaccaaaaagtcagggctagccctgcttctgcttcaactttgttcagtttggtttattgcagaattaatacatgtaaccgacaggacttatgctgtgtttagtttcacgctaaaattaaaagtttgaaaaaattaaaacgatgtgacgaaaaagttaaagtttatgtatgtagaaaaagttcgatgtgacgaaaaagttaaaaatttaaagaaaaaaagttggaatctaaacagggactagtattaaaattaaaactagtattaaaaggaagacagtgtgttgcttaaatagaagggatcgagctacagtacctcttagtttgcaggtattgtttgatgtcgtaagccagcgcgcagtcatcgccgtccaaggtggccgcgtccgcctgcgacccggtgatctgcgacatgatgtgccggaggagcttgtcgttgtgaggcggccttgcggagagcctggccaccgcgcggcactggaactgcccttcgatctggcggaagacatccatggccagtgtcgtcttgcccatcccagctggtccgacaacagagagcaccttcagctgcgcctccccatcgtcggaggccgtgagccatctggccagcttcttccttgggacgtcgatgccgacaagaatactgggagggccaacgtcgacgacgacgtcgggcgctgccggcggcgcgtcggtcacaagcagaagctgctcgatccaggcaaggttcagctcccggagctctgtctcggccttatctggtgcgtagccatcgatgaggtcatcgatccatctagccagatctatcaagtaggcgcagtggttcacggtctgggagtcgacatgccccggaccaattcgctcggccgatgccagcagctgccgcagtgctgcaacaaggctgctcagctccgtctccgtgaagacgaagccacggcgggcgaggacggagaggccggcgtgcccacgctccgaccggagcagatcggatatcctaccgggaagacgatccatcgcccttagtactccctccatctcctccttcgcggctgccgccattctggcatctcgttgtctctccaactcgcgcgctatcctgacctctctctttctcccaatctctttctccctcctcgacatccacccgttccaagcatcccaatcccgatccccctcaataacatccacctgacgagaaggcgaaggaaaacaagggaagccgactcctctccccatgaatgtgatgaacagcagttatcatacactaagggcccttttgaatcacaggaatgaaaaaacagaggaataagaaaaacgtaggatttttgtaggaatgaaactgtaaaaacagaggattgcaaaacataggaaagttatgttactagccctttgaatgggtataggaatttcacaggaaagagagtgtcaggaagtgtattaatacatgtcactttggccttatccacaatatcacaatgtatattttcttctaaaagaacaacaatgatgcatatgtctgtcatttatctccatcctacgcacacatgatggaaaaaagaggttacggtggatgttttcttttcctatgttttccctgtaaatgggg

SEQ ID NO: 11780 - DNA, 1222 bp, Oryza sativa
ataaagtatatgcatacatgtgtatgtatatatttttgatatgtaagaaaatataaacacgtatacaaaattagtatacgtatatctttacctattataaaaattaaagatgattccgtactaatagagtgtttcatccgtctttcttcccatgtttccaaagtcaacgttcgtccatcaaaagctagtccgcatcggtcacgagcaaacgagagcacatcttccggtatttttggtcttttttttgctagtattgttcccgatcactttctattttttcttcttcccagtggtggagccaggatctcgatacgtctgggctcaaattgaaggcttgtcaggactatgaataccacgtatctaatagtagttgactaaatttcggcaggacctaccacatactatgtcttataggagaagttccgcataaagaatgatgaatagagttctacatataaacgacaaggacttacgccaagacaagcttagtagtccccatacggtacctacgactaccgtcaggacggatctagcgctatctttgatctcgccggacatggattcgaggaggaagactaccctgttgtcgattacgtgttagcacttcagaccgccatattgataacagatagataggctaccccaaatattgtactggtgtgattataatgaataagagcaatgaccggcttcggccaacaggagtagggttattacctgacaatttaagagctcgaacctgtataagaatcctcgtccccatctcttttacctcagtctcgcatataccttggtgccaactatccccatactacgcaaaaccgtagtcgtgacatcaaacgtcgacagtagcgcgccaggtagagggattttggtgcttcaggattttgacgagatgagttcaagagatggattcttcaacagcaaactactcaacgacttcgtatgttgagtgatatgacctgaacgaagtacgttctccggtggatcgggatctttgtcaagcttcgccaagtcgtcgtcactatggattttttgacaagggatacttcaactattttggatctggtaagtcaaacccaaccagagtacgtgccccgacaagatcggaaccatcatcgtcaacaatttggtctatcgagatcatccaagcctcaagatacgcggcgtaccaaaagacgtcagatcgtatgatgtcgaacgagtacccagtaaggtaatt

SEQ ID NO: 11781 - DNA, 3482 bp, Oryza sativa
ttgatgtcagagattgactcagacaaatcctatacgatgcccgcacgaggctgataagggaagtctaacgttatctctgaactcagcgataatggtcacgtgagctcgataacagttattccgaggtcttcgaattgggaatatgaactcgttcatttgcgttgaagtcagggctactgtcaggattatggataccacatacctaatagtagttgactaaatctcggcaggacccaccacatactatgtcttatacggaaacaaccttcggatataggaggagttccgcataaggaaggatgaatagagttctacatggaaatgacaaggactactcggattgtattcatattggtttccctagttctacttggactagggtacacctataggtataaatacaagaccctctaggaggagaggggacatgaaacaatagatcaacatacaagccaacatacgccaagacaagtgactggatatcaacatcggagataagcttagttgtcacaccctgaagttcttctcccaagcctaaattaattaataaatggtctcgagaaattacctatgtaaaagtaagagagaaaccctaattgaattaatgcaaataataatcggaaatggcatgtgggatttttcttgagttctacatgtcaaaatatgctaacaggatttttagaggaattttcagagctctacaaataattataaccaattaaaaatgagcacgagcaattatttaatccctgaaaattcatttcccctttttctttttcttttttccctcgttttccctaatgggtcgccggcccattctctttccccctccgcctccccgctgggccggccgaaggctaaggcccagcagccggccgcccgagcccctcctcccctcgggtcaccgacaggtgggcccacctgccgggcccgtccccaaacctccggccggcgcggcccgcgcccgcaaccgccgctcccgcctctcccgtgcctcccgggccacgccgcccacgtcgccgccttccccgcgcctccccgcacccactcactctctctagcccacacccgcgccgaaacggccgagattcaatttttgaatcccgccggccactccctctctccacctccccactactccggtgaaatcgagccactcctagcttccccgagccccctcttcccctatttaagcaccactgcccctccctctctatttttccccatttcgcagagctcccccgtgccctcctccgccctagcgccatcgccctcctctccgtcgccgccgccaccgctccggtcgccgctagccgccgcgccgagcctcgccatcgccgccgtcgggttcacgagcccaagggccacgctgtccgctcctccgccgccgatttctgccgccggagccccgttcgcaccgcacgccggtgagcttcgccatggccgccaccttcagctggcgtccccgccctctatgatctctctctctccctctctaatctttcccattgtgttccttaggtgatcccgaatctcgaccgctcgtcgccatcatcccgccgctcactgtcattgatcatcgccggtgaggaactcctccccttcctctctctctctcccacgccgcttagccgccgcctagccgctcagccgcccgcgccgctaccactgcgccgccgctgcgtcgagccgcgccaccgcgcgccatggccgccgggccggcttgagctgggcccgtgcgtgccggccgcgtgccgccccctccgccgtccgatccaccccgagtggattggggccatccatccggccgcccgcgtggtcgccacgtgtgcgccacgtggtggatccctcctccccggtcccgtggactcagtccaccgtggactggcgcccttgagcctatgacatgtggggctcgcatgttggcgccgcccccctctctccagggtttaattgttgcacaataaatcaattaaggatttttctgtttatagtaaaaacatagtgaatcttctaaaattcatagaaaattcatccgtgctccgtttaagcccattcaagtctcagtaaatcaagaaaaatacaaagaatccattaaaaatggttttattctctgtttcagtagtcttatagcctgtttgtattgtttgctttgtatatcgcatagattccggctctcccgacgctccagtgtactttgacatagtcgctgagtttcctccagccgcagggcaaggcaagtcatgcttgtcacttgaacatgttgatcccatattgcaaatgctctattgttttcctttaaatacaacattgttttacaatgatatcatgggatgattaccttctgtctcagccatactatttgttaccttgttcctttgttagcttggggatataacatgattagatgttgggttagggattgcttagccatgcttagttcaactagcacacaatgggggaactacattaatgcatagttttcagattctagtattggtgttggactagaaccattgctctggtgttggttaactaaaatatactaaatggtggactgtgggtgcatggttttgatggtcgctcccatggcaattaaggaccggttcgcgggatgccctggaagaacttaccgtacttactacatgccagtgtgggcaacggttgggcttgtagtgtagctttcctctagctgacgcatccaggcaagggtgagcgtgatgaagttcggatgggccctgtgacggcctatgcggctttcagattcacctaggcacgagaggggactgcccgctgccttgcgaggagtgggggtgaaacctgaggtgtggtgtgtttggttagagcgggttatgcgaagggtcctgtcacggcctctttccggtatgtcgtgttggcatgccggcgcacggtaacgtgtcgtggggctgtgtcttgtgggtacagttgaacacctttgatcagaggaaaagtattcgaatagccatgcccgcggttatgggcggtcaaccagattcaccgtgattagtctcaccctagcttagtctaatggaattgattagttcaggtggttggttggtcctgttgcaatgtggtgtagcgttggacagtggatggttaatattaactaattattacaactattttactgttttcaactactgtttataaatgctagctttatgcaaatgatcgaaagcaatattaaaaaattgaaaacaaagaaagcaatacgcatgtgcatcttttctagtatattgaaaaactgaaaaccaagtggtttcattccgtttgtcacgctagagacgacaaagaaaagggtaaggcgaacagatagctcgccgacgcattgtgaagaagaggatagctagaagatgcagcttaaggcggaggcggagtgcagccagcttgggagaggaaatggaaagaaagcgacgtttccggtgggcgcagagatgagtggataagggtggggaagagat

SEQ ID NO: 11782 - DNA, 2012 bp, Oryza sativa
gagtgggagcccctccatgagagtatctctaagctgctgaagggtggacgcatcaccgacgcccgcgaaaggcacagcttggcattcatggagatggaactgggcgtcattgtcgcatacctgaggatgccgctgccaccacacacagattgtcctggtgtcgatctcatcgataaccagatccagtaccactggagttactacagggatgtcgtgatatctctgtataatcagtacggagaagaagcacctaatgcggggctgctgcgaaaagccatgcggtgcttccgccgccgaaggtctttagagtataacattccgaggacagcgtacagtctctaccgtgagtgctccagtgatccacgcctcgagctcccaagctcggagctcatgccatcgccgcatcaagcagcccaagttgaggctggtgccctcaatgatcatcttgttggcatcgacagcatggcaaacgagatgctcagatggctcatggccaccgacaagggtctccgggtcatggccattgctggacccgccggcattggcaagaccacccttgccatggagctccaccgtcgactcaggtgccaaactcaagaatattatttccagtgccacgttgtggccgctaacttcccccggaggccttacaggagcaagcttgttcttcaaaccatcctgaagcagatcatggagcaactggatgcaccatcaccaaacagctcggaaatcaccatgtccatgttggaggacaacccggagctgttgactcgcaacatatcagaacacctcaaggataagaggtaaacagcattcagctgctatatgtatacagtacttatttaggacttctctaccagtgcagcatcagacctcggattcttttaatattttctcttcgtattctccctccagatactttgttttgattgatgatatattagacgaatcagatttggaaataatcaagggtgcatttcctaataataactgtggtagtagaatattgtttacggcacaacatgagtggatagctgggtggtttttgtctaattataatggggttgtgcataagatgaagcctctgaatgactcggattcagagaagctacttcgcacaaaagcttttagttccatggatgatttacttccagacaatcttaggctattatgtgatgaaatcttgaacaagtgtagaggaataccattgttcataactggtatggcagattggttgaaacaacagcaacacggcagctctgcagttcttagggtggaacaagtacgcctactgctgaaacagtttgaatactggctatcatttgattacagttatgaattgagcctatcgtcactctatctaagcatgtttccacagggatatgtgtttgataaggatcatcttgtcatgaaatgggaaaacgatggggtgatccgtatattggagtctagttcagaatatggagagttgtatttctctgagttggtcaacacgaacatcattaccccagtaggagagaactatggacccaatcttgatgaagatgaattgtgccagtggcaggtcaatcctttcgttttgagttttcttgcctccagagcagccgagaagggtcttgtttttaccagctcaacactcacctcattaccaagctgtggtggcaacaacactcggataaaacggcgcctagctctccaccaccctgatccgctactccccgaaatgctgcaacaaatggatttgtctcatactcgttcactactcatatctggtgcagtcgacagaacaacagtccctctagacaagtttggatatttggtgtttttggatcttcaaggctgggagaatttgaaggatgaggacctactgcagatatgcaaaatgtttatgctgagttatttgagcgtcaggaacacaagggtcagcaagctcccaccgcaaatcaaggagctgtgcaacctgaaggcattggacgtcagccaaacccacatatttaagatcccatcagaag

SEQ ID NO: 11783 - DNA, 713 bp, Oryza sativa
  unsure (1)..(713): unsure at all n locations
ttttagtgagaacaatgatagtgtagatctcctttacaaagttatttttttctgttcaagaataaggcgcctatatttttttctttagattttgcaagaggaaattggtgttaaaggccattttggaccaattaacgtgctggcatttaatcctgatggatggaggtaatattcttaatacatctgtctgcattattgtaagaatgctatatttaagttttacctatgtacttatgttctggattagcttttgttccatattacttctgtgtgttttctgctcaaggattataagccatgttatgccatcacaatatacgctattctgaatcatattaagatgtcataaacattatgagagcaggtgtctattttctatgttactcagtgtatagatttatagtacattgttgtggttctactggctatgttcccatgggcatttatctccttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11784 - DNA, 4237 bp, Oryza sativa
taaatttataaatctctactacttaaaaaataagaggggcttccatcgtccgtcaaaaaaaccgtgtaaaaaaaaccgggcagaaaaaaccaggtttgtccgataaaaaaaccggaacggaaaaagaagtccgatccagaaaaaaaaaaggggcgaaaaaaaccaaaaggcaaaacggacggagtccgatccaggaaaaaaaaggcaaaaaaaaaccaaaaaaaaaccggacagagtccgatccaaaaaaaagccgaaaaaaaccgaaaaaacaagggacggaaaaagccatgtttgtctgataaaaaaacaaaaaaaataagtctgactcctatatccttaacagtaaaaaaaaaagtttgactcctatatcaaccaaaaaaaaaagtctaactcagattggtgaaaaaaattgatgtgtcggattgaagatctgtttgcaaaaacggaatctacatgtcgagagcattccatttttatatgattttaatttttggatttgtaattttatatttgagtccctgtaatttttatatttgcatttgagtccctataattttgcaacaagctacttgaggttgtttttgttaaaaaaaataaaagagaaagagaacaaaggccgaaaggtgcataaaaagaaaaagaaaagccaaaaaaaagtctgactcagattggtgaaaaaaattgatgtgccggattgaagatcggtttgcaaaaacggattttacatgtctgagagcatttcatttttatatgattttaatttttagatttgtacttttatatttgagtccctgtattttttatatctgtcatatattctcctgtattagaaaaaaaagcaaaaaagaaccttcgaaaaaaacaaggaaaaaaacgtgcgagaaaacaagaaaaaacacacgagaaaagaaaagcaaaaaaaggagaaaaatatggttttcttcgtaagtgaaaaaagcgaaaaaaaaacatggtaggagaaaactgttagaaagaaatgcgccttttcagaaaatggtttgagaaaatcgcgcaagaaaaaaaacactgtttataaaaaaacaagccgctcattaaaatagaaacattgtcattgacatgattatgcatgaaaaacgtatattattattagaatttttttacccgttgcaacgcacgggcatttttgctagtatagaaaaaattatgaccataccgataccattttcataaaacaatgaagaaaataatactgtttttgatcatttctaaccgttttcgtccctagcttagtgaccaagatttggctatatatgctcatttcatgattttatcattatcactgcacccaatccatattatttccattactataggaaatatgattatgggaaaaagaagaaactgaaaaaatgggtaaagcagatcaaccgaacctacagggatctgctaattaattggcgcacgcgccctccactgtgccacgtgtcttttatttttcacgattttatttcagcgcgatttttttccttttttggtgcgatttttttttcactattttgacgttcctcccctcggcgcattttccatattgatcgcattcttttcgattttttaaaatctgaattgaaagttttcaaatctcgagctgaaagttttcaaacatggacttgaaagttttcaatctcaaattgaaagttttcaaatctcgagttaaaaattttcaaatctgagttgaaagttttcaaaatttgtcttacaaatttaaattttgagttgaaaattttcaaaatttgacttaaaagtttaaatctgaagtgaaagttcaaattttgagttgaaaatataaaaaattgtgtttagagtttcaaattttgagttaaaagttttaaattttacgtgaaagtttctttcacatatagatttcttttcaatctgttagtaaaaaaatcttcccaaaaaaaataaaatattttcttaattatcgtcattattctaaactaaccgagttagttacgttgattcctccggaatcgcgcgctggcgcacgcgttagcttttccggaacctcgatagatatagattaaccatcaacgactcttcatcttatgtccatacaatataggttaatcatcaacgactcctattacgtttcttggttatcagccgcgattttgaattaattctaaggttgttatcgtatttttttagcattggattttaaataacacagatataattttttttgaatggtttatcaagtataggccaaaagatccgcgccgctggatccgtcgcccccatgcctcccctccgccagatctgcaaggggagggaggggaggggccgggcgccgccatggtcgcccactgacgccgctgtcgctgcccttctccccgtctgcagccgagggagaggaagggaggggctgccgccgctgtcgccgcccttctccccgcctgcagccgagggagagggagggaggggccgccgccactgctgtcgctgccggccggctgggagaggagaggagaggagtgggagagagggagagagtgaggtggcagagaatatcgagcagtggtcgcccagtgggcgcggagggcgaaggatatcgagatctggctagtattttcacgtgcgcagttaacaggcccgcacgtgaaaataggtttattttcgcgtgcaggcctgttaagtgacccgcacacgaaaattgattttcctgtgcggacgatagactagcgccggtttccccatttttctgtgcagttccacttatggatcgcatggaaacaaaattttgggggaggggggcggggcggggtccagaaatatcaatcatgtagtagtgaaagaacattatgttttcccaagaacattatggtttcctctgggaaaacattaggagatatgcactccttaggaggacacgatcagtgtataaaattgtttcaagtgatttacacattcggtttatgcagggaagaaaaagtcaacaatcagaattgactgattcatcggctgataatagttttcaactgcaaataaaggctggcactaattgagtttgtatttgctattcagcagcactttatcatcttgatcttttttgccctagagaaggctgcctccactttttttcttagctgcatagcgtgatttgcagtagttatcttctgttagttttagggcatgttcaatggcagatacgagtatgatcttttaaacaatataagattatttagagaccgtgtctttataattgttgagacgacaaaggctctaatcattaactcaaaaaatattccttttgttaatattctttccatctttttaccttcatgcaacaatatttccatattgttgtgattaagagtcattgttaagctgttgttatgcatgacaacgatattttgtctctcctctttctttttcttccatgtcaataagtattcctaattagcaacgctaaaagaccactattgacaactattgtacatgcccttatgttgcagcataaaaaacagataagtttattacatagatttgttaactatggtaattaggatagggatctcttgtatgcaggaaaagcatgcccttgttgggtatataagggggaagggcttatactgcatatataatgggaaaagtttatagaacaaggctgctattcacattggaaatttgcccttttttactttggggtgttcttgaaaaattgatttgattatccttgagggtcgtacaagatggattcaatatttggtgcttgaagttgatgcatttgttagtgttttttgaaagatctagatagcacttgatcattatttccctttttggaaccattatcctaggtaagactaatttcataaagtatgcttccttgctgtcaatattccaaaaaatgttccccccgacatgatgcttgtagtttacggagatttcgaaggtggtgcagaatgcttttataaggaaaatgcatttagcatgatgcgcactctaaggaaaaggcttgacatggataaaattatgacaaatattttcaatattttaggtaattattgtcgtgggtaggtttctgcatcgtctgacatgaaagacagatcaaggtgttaacacagtgaattgatagtgttaccgctaacatatagcattacccaaattcatgtagatgttagaatctaaacatatatgtactaccagacttaggaccaaccctgtaggagtgaaaccgtcagaaggggtgcag

SEQ ID NO: 11785 - DNA, 2913 bp, Oryza sativa
tcaaacatcaaaattcaagctttcaaagcttacatgaatagtccatccaagttcagtaccaacaaattcattcaaatcagagttagtaatacatgtacaatgtgttcagttactcaaggaagttcaatgtgttcagttacaattgtattcatcaaatacatgtacaaggaaattgtcttccagcagcaatccaagttttgtggtgcttcaaccttggccatgaaaccaaaaaggttttaaaaaagaggttcagttggcataattttcttcatcattacaaaataaataacaagcgagcaagataaatttatctgtacaagcatgaaaaatgaaatacgacacttgaaatgataagtggacctcacaattattccagtagtactctgccaattcagataagacatgaatgctaggatcaaactcattagatattggatgagaggcataccttgatttttcatgttgtacaacgttctacagatatttaactgcggcatttaagctgcaagctaaggtaaattataaatggtttgtacataataaaattttaaaaacaaagagactgaaattaattttgtttagatggcatgtatatatccaacacatgtatcagtatgtcttgccaaaagatatacatggatttagacgtgtgaagtatgtatatgcactaccagagtacaagagactggaaagcactaatgtattcatacatacaaacagagctaaataaatgttttgtttgttcctgaaacagagaaagcaaaacactatagtgttcatcattcacacaatcattaccatgaatgacaaggcaaaaatagcataagaaaagcatctgcatctgcattctaactagatttatttttctagggaagatattaaccaacatctaaattctaactaaatgtgaccaataaaagcatagtctatgataaggagtaaattctatatccaattctataaaaaaagaataatatccagatatattatcctttaaaattatcataaagctagtatcataattttctaagccactgataggttaattccatgtcaaacaaatcaccgtttcctagttttgcatgtagatctcaacataagctgcttcaaaacagcaaaataaaatgggggtattctgagtgagaagccaaaaataaatttacctcacattaatattccttggtctttcacccatccttcatagtgtcctccctatgcactatgcatttcagtagttaaatactctcctaaagagatggaaagacatcaactggcaggaagctcacgattcgtagaaagaactaggtctaatttgttcagctagcatagaaattgggggatttgtagagtatccaaaaacacaccaaaaaaaacttcttatgctaagaggtctaacaaggaaaatagcaacagatcttagtgatgcaccaactcagatctggacacaaggaaaggcaagggcggcttttactgaccactaacctgattaaaagagatgaggcagtgactaccgaggatcgggtggaaggggaatagctggcgcctgctctccccatggcaggtcgacctcgacgacgcggggtggtgtgagggacggcggaccgcttacctcgaggccggatctggagctggtgaagctagggtcgtgggatttggagtacccaaactcgggatggttggatccgcgacctccgagttcagggtgtccggatctggagcacctgagtccatggtggctaggaccggtcaccggaagggggagggtcggcggaggctcgtcgtcgaccggagatgagcagcgacggatggcagattgacagggcctgtggatggcgcagggcagcaacgtggttccccgttcatcggaggcgccgacactaggaccggcatcagggagaatagagagagaggaagagtagtggcggcgagccactgggaatgaggggaaaaaatttaggcattgtttcgataacgggattgggaaatgatttctcacccatcaaaaggtatctttaaatcctaaccattcattcttcctcttccatttaatcataacccttcattcattttccaatcccaatcctactctccatttcccattatccaaacacacccttagggcttcggttggatgagcaagttttatacgatggttatatggcccaccagtcagcgctgatttttctgtgagtcctagccacaaccgacagaaatataccaatttttctgtaggtataagtaaaccttcacaaaaactcattatttctgtaggtcgtctgcgggaccgacaaaaaatatctcagcccacaggcttgccctcaagtctggtaatggggtgtctaaaatcattaacatatatatgaatgtggacaatgctaaaatgacttatattacgaaacggaaggagtattcatttgtataattgtatctgttcgcagttgtgttgtcgatacaagttcataaggtctatgtatttgacatggtttcgattacttgtttcttaattggattggtcattacctatcatgtggtattaacttatatgcgaccttttaaacctaaatgaaactaaaggtgatcatttgatcagcaacagctagcacgtgttttttggttgctttgattaagacatactgtgtgcgcaagtgtggtattaacttgtatgcaatctttgtaacctataaatgaaacaaaagatgagcatttggttgacaacaggtaacatgtgtttaatgcttgttttgattaaagcatgttttgtgtgcagctgtgtgcgcggcgtgtcgtcgcgtgttcgcgttcatttctatttaacttactgttgttctttctaactaacaaacaattattcttactatcgttaaaaaaaagtgcgagaatgctcgatgtcaggcgcccggcgcgtggggggag

SEQ ID NO: 11786 - DNA, 5163 bp, Oryza sativa
  unsure (1)..(5163): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttcgtaagaaaactaactttgcttggcattttctttgtctcatgtacaggaaggatttgccttttcgcattgcaccacttgtaaagctccttactatttgagggttcatgttcacactgataggaaatggcgaacattgaaatttcgtttcttcgttactagagatatattattcatctttgctctagtgcagtttgtaagtccctctagatactctttgttagttgtcgattgtctttattataatgaatgataaaagagtttgttttttgttatttatttgttcaggtcatatctgcattagcgtatttggtgcatgttattcagcgcccctccccctatgtgcctatacagggctcacttacttctctcccattttttcacaaaaatgtttcatctagtgtatttacaatgtttcactatttataaatgtaatgttgcagtgaattaaaatactcttttacaataaaaacccacatattttagaaactctctattaaggaaatttggtttattttttccaccaaaaatgtttcacccactatactcacaatgttttattatgtatagatctaatgttgcagtgaacgaaacattccattgcaacaaaaaactcacatattttggaaaccccctattaagagaatttggtttatttttttgttccaccgaaaaatgtttcacccaatgtactcacaatgtttcactatgtatagatataatattgcagtgaactgaaacattctttcgctatttactgaaacattgtttttatataaggtgaaacaacacccgatttaaacgagtgaaacattttcgatcttagtgaaacaattctgatatacctagtggaacatcgtgcaaacaatttaaaaataatacaataataagctactgtaaaaaaaaatttcgtcggaatacatccatgtgtggtcttgttttgaagatttaattgcaacgagtttaatggtgcaatcagatcatgatttggacaagtaatttaagagaaaaatcagtttaaaatagttttgtacgtaaatcggacgctgacgtcccgatttttgaagttttcgatcggacgaccgatccacagtcactcccaaaaaagtgtcctattttcctttggaataccacctgactcatctactcgattatatattgctgtattgtagcatttcatttagttacttttaaaacgtgcacattaacgggcgtggcgtgaagccgcgcttatactgaacgctggaataaatctctcgttcccatgcggtactgctaaaccaaatcgcaacaaatcgggttcctaggtgagaacgcgatctacggatgattcggtggcagcggcgatggcgagaccaatcggcgactcggcatccacggtgtagtccatcagcaagtcggagctgacggcgagatccttcgacaactcggcgtcgacggcagcgattcgatcgacgtccacgggcgccgtcgctcgatcgcgattgatgtccacggccacgttgcgatccatcgatcggcgatcgatcagggtccatgcgtgcgtggcgcagcccatcggcaagcctgaggcgacgacacgatccatcggcttgatgaaatcatacggcaacggcagcaagcggcgccggcgacatcacagcactgcctacagcaccggcaacggcaagtccccctccgatcgaagatcacggcagaccatccaacgaatagcaggatttgtctggtagaaacacgcgcttttccattcgttgtgatttcgtttcagattatagtcattggtatgtgtgcgtgtattgatctaatttgccatcatctcttcttaattttactccattatcgtcataattgtactctatttaatctgctgttgattactgttactacgagatcaactaatttcatgtggaaacaagaaattgtttcaaaaattcagtgggttacttcccgtttgttacattaattatagctacaataaagttgacccggttctttacgtaatgaaatcattttgttaggaggtgcatatgaggttactaacttaaaaaacagtatgtactttcaaaaagtatatattgcttcatgggtagtatatactgaaaaaaatgggtatatactcctccgatgaggattgtagtatatatatactacttataaaaagaaaatagcacataccacttatgaactctaaatggtatataccggctctatttcaggtctaggtatacaaccggtctatttcagtatgtggcttacataaaaaaatcaatatatcataccacgtatatgtgctttgcttaaaatttattgttttgtgtcatgacaagtacatactgctactaaataaaaaatatacttctaccgaataaaaaaggtatataatgttcctcaccaataaaggtatataaaaaaacgtataccttcaaaaaaaaaaaggaaagatgaacatcttcaatgcagtatatactgctactaattaaaaaaaaagtatatactgctattaaagtatgtacttcaactaactaaaaaccggtatatactgctacttaaaaaaaagtatgtactattactaacaaaaaaaacagtatatactgctattaaactaaaaacagtatgtactgctatcaaactaaaaaacagtatgtattgctatactaactttaaaaaacagtacgtgcatactgcttcttacttaacatgggcggaactgggcctagggcagcttgggcgcaagccccactcgtgaaaaaaattttagtggactagtaccttgacttttttcagatttccccaaatccccaaggcccagccccacacatggcctgtttcagccccacatccctcagcccaatagcagcccatcagcccaacccaatagatgcacaaaccctaatcccacctcctctctctctcgcatcacgccgtatcccgcatcaccgagcgccgcttcgcattctttctcttctctcacgttctcagctctcctcatctcctccctgtctctcacatcaccgattgccgattggagagtggcgactgcgcagggcggcgagcggccggccggacatgcatatttaatgtggtacttgatcaaattattgttgagttaaacaatcgttttgctgaaaggtctactcagctattgagatgtattgcttgccttgatccaaggaattcttttgccaactatgatgaagataagctcattgaacttgctaagatttatgcagatgacttttctgaatatgattgtttagtccttagagaccaacttgacacatttatctctaatgtgagatctgatttggatttctcaagctgctctgaccttggtaaacttgctgctaagatggtccaaactgatagacacacagtttttccattggtatatcgcttaattgaattagccttgattttgcccgttgcaacggcaacagtggaaagagccttctcagctatgaatgttattaaaactgagctgcggaacaagatgaatgatgaatggatgaatcactgcatgatttgctatattgagcgggatgtttttactagcattgaagatcatcagattatagaacattatcatgctttgaggacgcgcaagcacaaattacctagaggtatgtcatgcattgctttgtaacctacaaataattaagttctcataatttgtatcacttacattatataatatcatttttcagatttagcttcaggttctctaccttctgttgatgaagagtgaaaattatgaagacatatcgcattaggtattctaataaaattttagtctagtcttgtactttttctacacttttacagtacttcggtgcatatttagaaattgtattctagttttgcattttttttagttcttgtactgtatgtacttccttgtacgaattgacatggatagttgttagccttgtcgatgtctgatgtcatgactatggtatttgccggtatttgcatagtacggggatcattggcaccagggtatatgcgagactgaggtaaaagagatagggacgaggattcttatacaggttcgggcccttaaattgtcaggtaataaccctactcctgttggccgaagccggtcgttgctcttattcatcataatcacaccagaacaatatttggggtagcctatctatctgttatcaatatggcggtctgaagtgcagacacgtaatcgacaacagggtagtcttcctcctcgaatccatgtccggcgagatcaaagatagtgctagatccctcctgacggtagtcgtaggtaccgtatggggactactaagcttatctccgatgttgatattcggcggcttgtcttggcgtatgttggcttgtatgttgatctattgttgcgtgtcccctttcctcctagggggtcttgtatttatacctatataggtgtccccttatccaagtagaactaggaaaaccaatattgatacaatccgagtagtccttgtcgtttccatgtagaactctattcatccttccttatgcgaaactcctcctatatcctaaggttgtatccgtataagacataggatgtgtggtggaaaactgttcaaagggtgacatgttataatatgtatggaaaactgaaaatgaattaaatttacagaccaatgttttgtgtacgagcgtcttctcttttaccgacttcgatcagtcagtttgttgagtcatacactctccctagcccccatccttgttgtcggagaatcattttcggaggataaggctcttggacccttgacctgccttggttgaaaaaacacttaccctagcccctagccgtgaagttgcaaaacccaatttccgattacacggcttgattaatacgcatggtgagaactcttacatgaccagatcgggctgcagg

SEQ ID NO: 11787 - DNA, 602 bp, Oryza sativa
tcgttgagtagtttgctattgaagaatccatctcttgaacccatctctcaaaatcctgaagcaccaaaatccccctacttggcgcgccactgtcgatgtttgatgtcacgactatggtatttgcatagtatagggatcgttggcaccagggtatatgtgagactgaggtaaaagagatggggacgaggatttttatacaggtttgggcccctgaattgtcaggtaataaccctactcctgttggccaaagccggtcgttgctcttattcatcataatcacaccagtacaatatttggggtagcctatctatctgttatcgacatggcggtctgaagtgctgacacgtaatcgacaacagggtagtcttccgcctcgaatccatatccggcgagatcaaagatagtgctagatccctcctgatggtagtcgtaggtaccgtatggggactactaagcttatctccgatgttggtatccgacggttgtcttgacgtatattggcttgtatgttgatctattgtggcgtgtcccctctcctcctagggggtcttgtatttatacctatgggttattggtgcgtgtcccctctcctcctagggggt

SEQ ID NO: 11788 - DNA, 1349 bp, Oryza sativa
taagctatatgtaaaattttatgatatatatatatatatagacgctaatttttcttgcaaaatgaaaacaaatacatccatatataaatttaacatgtctggtaattattgataaaaagaagtcgaccaaaataacaatatatttgtacatgggaactaatatcattatcttaataaagaaaagaacccccatcatatccattgcttctcatgaaaagaaagttattcggacatttcttgatgcaaaatcatcaataacggtattaagatcaatattgtccaaaatatccttctcgatagagcacatagctaagccatttaacctttcttgcgacatagttgatctcaaatagttcttcaacaacttcaattttgagaaacttctttcagctgaagctaccgtcacaggtatagttaagagaattcgataggcaactgaaacatttcgatagcaatctgcatccataacaaacttcagaatctcaggcacggatatcgaagaatctggcaaactcacttgcaacacttttaattctgaataaaaatcattgatctcaacatcggataagttctcatgagtaaatatttccacaaaaatcttgcaatgcaaccaaagatctacttcatctaaggattttaaattttcagagttgaacaaaaacccaaaaacattatcaaatgctttcatctgctcaaatatattagtcagtgaagcaattgcagcatcaatcataactaggaagttctataaacaagtctataggaggacgacactccaactcctctcgtctcgacgtttctgcttctaggtaggccataggcaggtactagactactagtattaggtgttggtcctcaccatcatgagcccccggcggtcgcatcggttgcataggaccagggccggccctggctgcagctgctaaaagctcctcctaacagacccttagatcctatgcatatggtgatggggtggtagaattactactcacaccacaactattctcctttaaaggagtatagagtgctagggtggaggggcccgcacatctgtcggttacatcgaccaacttaagtagtttaaactattccaagatagttttttttatcaagtattcctcgatattttggacgcataggattgtgaaatgacaattaaaatatttaagaaaattaaatataaagtgcatatttgggtaacacaaaacagacccttagatcctatgcatatggtgatggggtggtagaattactactcacgccacaactattctcctttaaaggagtatagagtgctagggtggaggggcccgtacatctgtcggttacatcgaccaacttaagtagtt

SEQ ID NO: 11789 - DNA, 1382 bp, Oryza sativa
aatgctgagggctcgctctattttcttccgtataaatcatacttgtttacggtttacataatgcctgatattaaatctgctcgttatgtcatgataataatagaagattcatgcagttttctgagtacatactcaatatgacctgctatatgtcttgccttctagaaaaaaaatttcaggaacaattgagcactcgagtaggttgtggtcaaacacacacattatcgagaacgttatcgataaatgtggagttgtcgcacccaacctaccaacgaagaccgacgacctatctcatagcactggccatagctgggctatttgagaaaaggttgttaacggataattcctcgcgaacgttgtcggcttgatcacccgacataattgcacatggatatccggacatgctataagttgggtatgtgagtcatgctggccacatgagatgcacatgtaataaatcaactttagcgcccctataggtgattgagagacgcctactcgctggttctcaaccagtcaatcgtagcgatctgtcgcacctcaacttcaatcggtcgagagactcctactcctggttctcgaatcagtagtaagtagcgatctctcgcgccacgacttcagatggtcgaggtacgactacggcaatagcgtagcggtcctcgcaccacgacttcagatggtcgtacctcgacatcactctgtcgagagatgaggctactcctggttctcgaaccagtaggccgtagcgatctctcgtacctcgacatcactcggtcgagagatgaggctactcctggttttcggaccagtaggctatagcgatctctcgcacctccacttcaaatggtcgagttaaggctacacctagttctcgaccagcggtgtagcgattctcccactatttccacttcaactggtcgagttaaggttacacctggttctcgaccagcggtgtagcgattctcccactatttctactttaagtggtcgagttacgactaccacctggttctcaaccagcggtgtagcgattctcccactacatccacttcaagtggtcgagttatgactacccgtgatcctcgaccagcggtgtagcgattctcccactacctctactccagcaaagttgatatcaggtacacaacatcgccaagtgttttacccagagatcccttaccacgacaacacctagagttgaaaccaatcctactgtccctttacgccgccctggcaaggcctccgaggaacctaagggaacttcggctggggacgcccagagtggataaggccttgtcaggtaacgcagagacgaacgatcatgtaagatctggtcatgtaagagttctcaccgtgcgtattaaccaagacgggctgcagga

SEQ ID NO: 11790 - DNA, 728 bp, Oryza sativa
attcctgcagcccgtttaagttttcccaggagtctatttgtaaaataagttttcaaaaaggaccaaaatgtaaatatttcaggagaatttcatcactgtagttggtggtcactggctcacagcaatgccgggtaacaaggttcgacggttatccctacacagtagcaatccagagcatgcgaaggatgccatagaaagaatgaactcgtcacatgtacgatcgttgacagcattcgagagtttagaacaatttcagtcttttacattcaagtttgggatactgcaggtgttggatcttgaaggttgcaagggcttgactaccagccatctggacaaaatatgcaagatgtttcatttgaagttcttgagcctgcgcaaggcacacgtcaagaagctcccgtcagacattggaaagctgcagtatttggaaacgttggacataagggagaccaatgtgcaggagctgccaccatcagttgcagatctcaaacaaatggcacatctacttggtgggaattagagatggcaacgggtgcatacccatcgggttctcttgccccatacccacacccacgatgtctaaatactcccacttaaatacccacaccaatcgcgggtacaaaattgtccccatacccacacccatgcgggtaacgggtttccaacgggtacccatacccatataattgacttgtaatatttatagttttgtactataattagccata

SEQ ID NO: 11791 - DNA, 537 bp, Oryza sativa
ctctattgaccttttcatcaacggtacccaaatagaagttaatcaggctggtgaggagaaggcagagagtgcaacaagattcaaccaagtcaatccgccagaggatgttgttcaggcagaagatgaggcggcactgaggagagaaacagagtttcagagcgagaaagaagatgaagatgaagcagagtgccatgcctagctcctattgaaaaggtaatcactgttcgcgtctagctgtttatcaatattgctacctgcaactaactccaaatttagttgataaatttcttgtcaattacttgttgccgcatgaaatgatgtccgcctctcctgacaatacatctcacagaacagtgagataataactcctgcatcacgtggtcgcttctgtattgctgttggtcgccgtgtacatatgtggcccgcaatttgcgggctaccatcgttatattttctttcatatattaccatgtatgaattatatggttgttttaagatatatatatatacacacacatgtaaataggtgtcaattaa

SEQ ID NO: 11792 - DNA, 13124 bp, Oryza sativa
tcctgcagcccttctgcaacttcttctgccgtctgcccatgtttgtcagtaacgaacccttcagcaatccatcttcttatcaaacatttcctgctaatattgcggcccttcggaaacgtactcaagtagagcaaacatgtcttaaggtcaggtggcagatttttgtagcagtggttaattatccgcactacttcagtggtgagattgtttcccaactctgcacttaaagccttctccacttcaatcaatttctgatcaacgtctttccaatctttgatttcagttcactagcaatgagccctgatactactactatggccaaaggcagacaaccacacatcttcacgacaatctcatcattaatggttcgagtgggacacagaccgttagcagatattatttgaagaaacaatttgttggagttctctggatctagctgtttgagcttgtgcacatgaccattttgacggcggcaggcttcagctacagagttaaacctggtagtcacaattacgcaactacccttatcattcttaggtaatgaatccctaatactttcccatgctgatacagaccatatgtcatcaatcaagatatggtacctgttcaagaattgtttagaagtaagtagttgtaaatagagtgtgcttttaaggtagttgtaattgtaaatagagtgtgattttacggtacttgagaaggtaccgtaaagttcctctctaaataatattttatactaccttcttagtttaatatttttatggggaatatcttcctttaatatttgaacttaaaagaacgaagggagtagtactcatcccaggcacaaaacatattgccaaacattttcaacttgggtatcaatattttttccctattatattctgcataaagttattggactttataaatactagaaaaaagatgcccgtgcgttgcaacgggaaacactaacgttattaacttagtaaaataataaaaaaatgagctcttatgatctagaaattcacatgttaaaaaataaggagaactcattgtagaccaggactctttcattttgtttttttttaaatcgcattgcccaatcgaatatgtacataaaacaacttaatataaagtataaattataaattagaaaataaataatattggatgaggactctagaatattctccaaaagaggctagggtgcatataggaatacaatttagaaaaagaattaaaattcaatatacaaaatattgaaagaagagtttagagttcatatatagaaatacaattagaaacaataaaaaaataggaatatttgaagaagaatagagaccatatagaattaaaaaataattgatattatttaattttagtctaaatttaaattttgtatcacgacaaataaataattatatttttagtcagaaaataaatccatatcatgaggaaaacaatttagttagaattaaaataataagtagtcataagcaattataatgggcccttttatggcctaatgggctaataggcctatagaaccaacgagccatcaagcccagtaggcagaatagactggaggcccaatagtgtggcggcccaatgaaggagaagccggggccgtccgatcgaatggacggtccaaattgatcccaaactatatatatactctgcagcaatccctaaccctaaaaattcattttccccctctccgcgcctctaatcccctcccccccccaccccaacacacacacacgagcggctgctgtggcgccctcgatcccctgtctttgaaagcgacagcggcgccctcctcccccctccccgagcggctgcggcagcacttagcagcagccggcgagcagtgacgggctgcggcgcctctccacccctcgcctcctctccctctccatggggccacggcccacgggagggctcgaccgtggcgggcggtggcaggcggcggcgctctccccaggaaggaagccgacggcggcctggagtccctgcgacggcgacagcggcggcgacctcattcgatctaatttttggatatatttgggtatatgctttctccaattttatttgtatgactgaattttgattgggattttttttttaggggggggggtggattgaattctgattgggatttggggggttgcgacggacgaaaaatttgcgtacgtttgaggtaacgaacggaaaaatacgaatcttttaattagttaagatatacaataaaaatgttgttgaaaagttgtgttttgtagactatttgtatccaaaacgactgttacctgtgaacggtgaaagtacaatttatccagatcagtaactatcataattcaaattcggtattgctatttaattactaaaaacttgtgtgagacttatccaaagataagttcaagtgctaaaccagaaaagtcaaggaaaactatgaaggaatgaaataaatactctgtattactccctccatccctaaatatttgacaccgttgactttttagcatatgtttgactgtaagttcttattaaaaacttttgtgaaatatgtataactatatgtatatataaaagtatttttaacaatgaatcaaataatagaaaaagaattaataattacttaaatttgtcgaataagacgaactcaaatatattttaaaaaaatcaacggtgttaaatatttagagacggagggagtatatagtaacaaagccaaaatctatacctcttgccttctagttgatcagctagcttcttcttgagctcttcaactccccattcctcaattccttggagagcatcctgagaagcgccgacctgcttctcatggaactggctaacaaggcttcttagaactgttgggagacgaaacttctgcgacgcgagcatgaacgctctggaattaaactcatctccaaacttgcggtaaaatgacattgcgagtgtggttttgccaagcccaccggatccgacaatggcaaggtaactgatttggctctgctgctggctgttgtgcttcgagaccatgaaccatctttgaaggtcgttcatggcgtcctccatgcctacaggttcaacggtgccaatcagccgggggagagaaactggatggtctctgggatcgccggagttgttgttgcctccaccatttgcgtttgctaggaggttctccaccccgtacctcgtgcgccgctcgctgacatgctgcgccctgaccttgaggttgccgatgtcggcggcgatgcagcggcgctggtacagcgtggtgagcaggtaccaagccctccggagggtgactagcttgccggccccacggggctcgcggccgaggcggtggctgacgtcgtcgacacagtcctcgatgtcgtaggcgacctcgcgcacctgcttcatccagtcctgccgctgctcgtcgtggttgatgtcccgcttgagcctattgaggaaggcctgcatgctggcgagctcgtcgttgatgtactggatgtcgtcgtggacgccggagatgagggtgtactcctgcgcgaggaggctgcccagcttgttgacgagggacttcacggcgccgctcgaggcgccgacgaccagatccataatcagctcccgtttcagtgaataggtataggaacctgagaaagtaagaaacggtggataactttttttttttctttttgattcgaacgatggagaattggaaatttggaaccccaggggcagggatgggtcatgggcagggttttaaatcttcctctatagctatttgagaaagactctagttatttattctcatgtacaatttagctgctatagctctatttagcctattatatatagctgccgctatagccttttgagaagttaaccgctaaatgtcttaacccgttatttaaaatattggtcatgggtggtccagccgctgggagtgggattgaccgagtggggcaatcatgatgccataatgaggcctatgcaattatctaattattttaatacatgattttctttaaaatttgttaaacaaccatcatgttgtgttaggattttttaaaaaatcaagccttattgtcatcaggtttataattttacagtttttaaaagtcacagcaaccaccacctcttacttctttcctccccttgattccccactcgctatggctttatcttttatagtttttaggaatatcgtctaatgccgccatactagtacattatggcgtgtctgctgcccattccctttattatcgttaggatttaaatatggaataagtttatctgaggtcccttaacttgtcagcaaatccaattttcgtccttcaacccgaaaaccagcccctcaggtctcaactatcaaaaccgatgcaaaataagtttcaagacggtttggatagcggtttcagctgacgtgacgtctacgtggataatttgactcagtcttcatctgaggtggcattaacatggtgcttacgtggaaatttgatttcaaaaataataaaaactatgacaccacaaatcagttatataaaaaaataatataaaatggtggggcatgtcattctcaccctcttcttcctcctctctcccctccactcttcaggcacgacggggaggaagcggcgcgcgacggccggtgggagaggaggggcgcacggcggccgacaagagaggagcagtgtggcggtcgggccgacctaaggccagcaacgacgaggctgttggaatgtaatctctttcccttcattaccaactccccttccttctcctcccgatcctgtttccataaatcggttgagtgagtatggaaagtggatgcctatacatgtaatgctccgtgatcaattcattatcgcgatgagtcattcctgtctaacatggaatcaatcactcatcgatccttcgcttctgcataacccgccggcgtcgctccgccgccgtgcgtccacttccgccggtgcaccctcaccggccgtgcgttcccggcgacatcatgtcgtcctcttccaccacccctccctctccgaaatcgaccgcgatcgattctactgccggtgccgtcgcagacgctgttcgtgcggccttcgctgttcccgtcggtctggagatcgaccccactacggcaaacaccgttgccgagtctgcggcgacccgcgcctctgacgccacacgtgaggccctctccgtcgccctcagtgccctcgtcttgtcaccggttgccacggttgctgcgacctctggcgctctcggcgcgacggccattgccatgcccgcggcgacactccacgcgtcgtccctacccactgcgacgatccacgcaccgccgcccgcggactccacaccgccggcccttgccaccctgtttgcctaggcacggctcacccacggcgccgcggcgccgcccgttggtcacatccggcggccggccacgcatgcagccctagcagccctctatgcccaagccgtcggcatcctcaacatcaaggccctcgtctccgtcgtgctcgacgtcgccaccgccaaccacacccggtggtgtggactgttcttggcggttctcggcaagtacgcgctaacggaccatgttctctccgactccttccacttcgaccgtgccgattgggtccaaatggactgcgtcatcctcacgtggttgttcggcaccatctccttcgacctcctgcaagacgtcctcaccaccaacaccactgcccgtgtcgtttggctaggcctcgagcaccatttcctcgggaatcaagagcaacacgccctcaacctgacaaccgagttccacattgcaacaaggcgacctccccgtctccgagtactgccgcaagatgaaggccctcactgatgactgtggcgacctcggcaaacctgttcgtgaccgtaccctcgtcttcaacaccctcaacagcctctccgacaagttcaaccatcttcagtcgccgatcctcatgcaacgcccgttcccgatgttcgccgagctttgctcccttcttcgcctggaggagatctccaagtcaccgcactccaccaccacttcggccgtcttcctcgccggcacctccaacaacagtggcaagacctctaatccagcgcacaccaccggttttggtgcagggaatcaaggcaacaaaggcggcggcaacaactccaagaatcgttgtcgtcgcggcggcggcggcagtggtggaaacggaggaggaggcggcggcggcactccagccgccaacaatggaggcaacagcgctaagtcgggcgctggcggcgcccaacagtggctgacgccacacaacccgttggccggcacaatccacatgtggcgtgctcggcccaaggccggccgggcctcccttcgctggggctgcgcttgccggcccagtcggcgcccacccggcccaacagtggcaggccacctagatgcatggggcgcagggccaaccagcccaataggtggtctcccagccacccacccccatgggctttcaacagcctatgggttggttcgccggtgctccctatcaatgggatcaagcgtctctcgcgggctctttcaacaccacgacacttcagcagcccgccacgaacgaatggtacatggacaccagtgcaacggcacacatgacatccgactctggtaccctctccttcacacaacccccaaactctacatccccctcccacatcgttgtcagtaatggctccactattcctgtgtcgtccatagggcaaactgacatacatcacccgaagcgctcctttatacttcgagttactctttgctctccacttattatcaaaaacttgatttccgttcctcggttcgttattgataattggtgttctgtcgagtttgatcccttttgtttctcagtgaaggacttgcgcaccaggaccatgattgccaggttcaatagctcaggtccgctctaccccctccaccaagccttgtctccatctacagccgccacagctctagccaccaccaccaccgacacttagcaccgtcgtctcggtcatctcggccatgaagctcttgctcggctctcctccgttgtgcccatggccaaaggtggatcccctagagtttgccatgcttgccagcttggacgacatgttcgccttccttttgccacttctgtcactagggcttctagcaattttgagttgatacattgtgatttatggacatcccccgtcattagagtttcgggtttcaaatattatcttgttattcttgatgattgttctcactatgtttggatttacccacttcgctttaaatccaacaccttctctactttgccccacttttttgcctatgttaaaactcaatgttccaccaccatcctcaacgtccaatgtgacaatggccaagagttcgataactctgccgcccgcacttttttcctcaccaatggtgttcacctccgcatgtcttgcccccacacctctccccaaaatggtagagccgagcgcatcatccgttccctcaacaacatcgttcgctccctactcttccaagctagccttcccaataccttttgggttgaggcccttcacaccgccactcacctcattaaccgacatccaaccaaaacacttgaccaccgcaccccttttttgccctttatggagtccatcccacctacatacatttacgtgtcttcggatgcaagtgttacccaacctctccggcaccaccacctgtaaacttgcaccccgctccaccatgtgtgtcttcctcggttatccactccaccacaaagggtacctgtgttttgatcccgccacaaatagagtcatcatctctaggcacatcgtgtttgatgagggttcgtttcccttcgcgactacaacgacaagtgccactaaccttgattttttggaggattctaccacccctgtgcaggctcctatcggcgccaaccgacgacctgcagctcccttgccagccgccccaactccaccacaggctgcccatacacctgggtcagccaccgctgcatcaagctcaagtccagctccctcggcctacaggatgacgctctctcggtcggctgggccatccgtgccgcaggccacccactcacctgggtcatccgccctgtcactaggccgacgcgcgttgctccacgatgggccgctgacacatgggccacgctccaccgagccatctccttcgactggcccacgacaagactactctgctgggtcgtccaagtctcctgggctgaccgaagcagcacaagccgagccagaggttcttgcacccccatgcccaagtctgcttcctccatcgcatgtctccattcccacttggccaaggtctgctcgtgtggccggcgtcccgaagccaccatccatgctcgacgcttcccctgtcgtcaacgaccatcacatgtccactcacagcaagcacggcattcacaaggtccccgaccggctcaacctccatgtcgacacgctctccccgctcccgaggacgtacagggccgccctcgccgatccgccctggcgctccgccacggaggagttctccgctctcctcgtcaatcgcacatcggagcttgttcctcgtcctcccaacatcaacgtggtgataggaaagtgcattttcaagcacaagctataggccgatagctcccttgaccgctacaaggcttggtgggtccttcgtggtttcacgcagcgccccggtgtcgacttcgatgagacattcagccccatcatcaagcccaccaccgttcgcaccgtgctcagtttggcagtctctaggaggtggcctattcatcaactcgacgtagaacgccttcctgcacggcaccctacaggacatggtctactgtatccagcctcctggctttgtcgacaccacccaccccgacatggtgtgccagctcaacaagtccctctatggcctcaagcaagcaccccatgcgtggtacagtcggttcgcctccttcctgctgacgctcggcttcgtggaggccaagtccgacacctcgctcttcatcctctgccgcggcattgacaccgtctacctgctcctctacgtcaacgacatcatcttaaccacctcctccaccgagcttctccgctagtccatctcggctctgcagtccgagttctccatgaaggacctcggcgacttgcactacttcctcggcgttcgggtctctagcagtcctctagcctcctgcttagccagcgccagtactgtctcgacattcgggatcgggctggcaagacaaactgcaagccctgcaccacccccatcgacacctccgccaagcactccgccacagatgatgctccggtcgccgccccaacggacttccgcagtctcaccagggcacttcagtacctcaccttcacacgccccgacatcgcctacgccgtccagcaagtctgcctccatatgcatgatccaagggaaccgcacctcgctgctctcacacggattcttcggtacgtccgtggcatgttggacctcggcctccacatccagccgtctgcagcaacggaacccgtcgtctactccgacgccgactgggccggttgccctgacacaaggcgctccacgttaggctacgctgtcttcctcggcgacaacttggtgtcttggtcttccaagcgacaagtcacggtgtcccactctagtgttgacgccaagtaccgcgccgtcgccaacgccgttgccaaggtcgcatggctacgtcagcttctccacgagcttcactcgcctccgcccaaggccaccttggtctactgtgacaacgtgagtgcggtctacctctcgagcaacccgatgcaacaccagcagaccaagcacatcaagatcaacctccattttgtttgcaagaaggtggcggttggcgcaattcgggtccttcatgtgcccacttcctcacagtatgccgacatcttcaccatgggacttccttcgccgattttctcgaagttccgttccagtctcaatgtccactagcatgacgttgcgactgtggtggggtgttggaatgtaatctctttcccttcattaccggctctccttccttctcctcctgatcctgtttccataaatcgattgagtgagtatggaaggtggaggcctatacatgtaatgctccatgatcaattcattatcgcattgagtcattcctgtctaacagaggtgaatgtgcgacattgagcttgtggttggacggcgacgggagggaggatttggaggaactggcagggctatgtcaaagaacgtgagggaggacgagaaggactgtggcccttccttcaccgctcgccactgctggggagaagcaatcgtcacgcgggggtgggaagatgggtgttcgtcatgctcaaccctgacccagggagaacatccaacactggggttggggagatggatggacgaccgatgactctagatctgaatgatggccggggactgtgcactctatccagtcacggcggcgatactgtgagctggtgggcgcaggcggtttttttgctccgggagtccagggaggcaacgagcaagtcagcaaaaggaacatggaatgccggcggcggttgactttttgctccatgtcgctcactgttgaggctgatgtgtgtctcgactctcgagtagattaacgcggtccagcaggctgcaacaccgacggcaacgacttattgtgttggtggtggtgcgccgccggcatgccacgaacgtcttcgtcggcgtcggtcttcaccgccgctgtcggtccctttcgctgctcctccagcacccgttgcccagcatgtgatcgccggaagtcgagcgacagcaacaccgacggcaacgacttattgtgttggtggtggtgcgtcgccggcatgccacgaacgtcttcgtcggcgtcggtcttcaccgccgcagtcggtcccttccgctgctcctccagcacccgttgcccagcatgtcatcgccgtaagtcgggcgacagcatgaggccggtaggcatgacagacttgtgagctcgacctccaccaccctctcggtctccggcggtgttggtggcggcgcaggcgacgacgaggagaatggggagaggagatgagatagagaagagagggaggagagaagagaggggatgaggtggaggaagtggggtctcactatttcctaatcttattatttaactgacatgtgggcccatatattttattttacttttaaaattgttagattttgcttcatatgccacgtcagatgaagaccgagtcaaattagccacgtaggcgccacgtcagctaaaaccaccgtccaaaccgctatgggatatatattgcaccaatttcgacaattgagggacccgttttatctggttttcctgttgaatgacgaaaatcggattcattgacaagttaatggatctcagatgaacttattcctttaaatattgaaccttatcattgttggagtttctatttttagtttctacaagcctcgtcaatcgttgtcaccctactcctttacggcctgtctgtggcccttcctctttattatcattatgattttagaaatcaaacttaattattattgggattatgttttatagttttagatgtcccgtcaattgccgcaatgctactccttgacagccaacgttttgtccatcctgattttaaaaattgaacctgatcatattggttttggtttttttattgcttagtcctttgccatttctcggtttgtcctctcaatgatataatagaattttttagtctaaattttaattaatctcttgttgtattctagatgacctcttctttttatattccttatcattttatttcaaatttcagttatatctaattatatttctacttgaactctcattttttctaattttggattttactttattttttattttgaaattaattaatcttttgttgtgttctggatatagtattctttcaatattccaaattttagacatttttaaattttattcctaattgaactctatttttttcattgctccaatcaatgtgaaattttttattcaagattttagttatttataaattatatttctactggaactcttttttcttttctaattttataatttactttattttttattttgagttttcattaatcatgttgtgttttaggtagcctgtgcaatagcgtggctagcgccaattgaaatatactttataacacaaaattatcttttcttaacacattgtcatctttttttaagaacttcatggtcatctttaaagtttgttaaatggacgacctatcttgggattaaaaaaattgatacttatcatcatcgtcgccacgctcccaattttatttcttcaactctcaccagtgtcccccgtgctactcctttggcgcctctctacttgctggcgcaccacaccttatatgtattgtccttgagaccagctgagttcgtttctcagggatgctaacctctctcctttgttttttacgagcgcgcttttcaaactgctaaatggcttgttttgtgtaaaaaagtttttatacaaaacttgtttaataaaaatcatattgatctatctttttttaaaaaaatagctaatatttaatcaattacgcgcgactggactgttctatttttttcgtgcacaggacatgtgttaccaacattcagcttgtcttgctgcgattcctttttatagctttttgaaatcctgcccgttgcccctcttttccttatttttaaaagttccgccagttgttgtcgatctactccttaatttgttgccattcagcttgcctccacactgccgaagaagaggatagctagaaaatgcagcttatggcagaggcggcatgcagccagcttgggagaggagatgagaagaaagcgacgtatctggtggggggagagatgagtggataagggtggggaagaaataagatgttccctgctttagttgcgcgcaaacattagcgaaataaacttactcgcctagcttgcatttggcatgcatctgcaatcagtacagttgtttgttgcaataattctgttctgtcgtgctgtaccagctagccgtacaacaaaagaatagaagaaaacaatgggttttcagcccaaaacctgcaaagaatt

SEQ ID NO: 11793 - DNA, 6261 bp, Oryza sativa
gattaacttcatacaaattacttcttccgttggcgccgaattgcttgcgagcccggagtgtacctacatttgaaaatccaatgtttaaaacattttaaaaacaaaataagggaaatcaaataacatttgagaatggtaagttcattttacctctttttcgctgcccgagtggatcgcaagttgtattgcgtgggttgcgtcccctgaggcgcgtcgggaagctgtgacatgtctatctcctcggcgtctggtgtgacatagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttgaacgcgcggattgaggtagtggtggtggtagtctccccggttggtacacgtcgtccaatccaaccgacctgcaacctaatcttgctacaagtttccggcacctttgacgaactttctgcatttcaaaaaaaaagaagtttgttaggcataactcaagtaatgcaaagtgctaaataaattttacctctaaaacattgcggagcgtgttctccgtgtcctcaccacccctcggagcttggagggcatgccccatttcattcacactcctaaggagctctctcgactgaaagcgttaaaagatatatgttagggtctagggtgcaaatggaagtaactttgacaaatgcaagaaaacttacgactctgtctctaagtggggcgtgctccatttgatatccaactctagtccggacatcatagggattccattctgcttcttcttccccccttgcccctgctcaatgttcagtggaatgccaaacagctgctgcacttgtgcatgccatccaggagtctctgtcctgcccgtcacagcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttgtcacgcccagaaatttagcccaaatttccagactattttgtgtattaaatccctgtccaggaccagccagggtacacaaaacgacaagtaatatacagttccaaacgtaaataaagcgtaaaatacttaaagaggcacttagtcctcgcaccgaaacgaaaacagcagcagcggaaaaaaggcgatcctagcggggcttcagctccactccacaggcaaaactcaactggggtccgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacgttttatttagcaaacagtaaaactgttgagtaattaaagtaacattaaaatctccactgatcaacgctacaccacgttgaacaggcccaaccaacccacctgtactacagtgcattgggtcgatttattaaggtgggactaatcacagtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcactttgatcttccgaacttttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatggattttagaaattttgagccatttaaatgaatttctagaattaaactcgatttattgcgcaattattatttattttctcaagggaaatggcactcgctgacgtcagcaaggggcgccggcgccgacaggtgggcccaacacgtcagcgcgtcaaggaggtgcgggcttggaccgggtccaccaaatgagcgggccccacgcgtcagtgggcaaaaggatctagcccaccgtggaccgagtccacggtagaggtgcaaggcggaggggtgggttggctcgccgaccaacccgaccagacggcggcgcgtggccggacggccactggcggcgacaccggcggcggcgcggcgcggcgcgacggcgacacgcatgcggcggccggcgggcaaagagagaaaaagaaagggaggggaggaggagggagatgctcaccgacgcgggaaggacgacgacgacaacgggcggcggcgacgccttctcgggaagacggcgcgggcggcctcggcgacgaccggcggcggaaaggatggcggcggccgggatgggaggcgacgggaacagcgttccgacgacgcccggccacaacggagccgcggccgagggccggcaagacctggggaagatattggagcggttagggagggaagagccggcacggagcgaccaaaaacgacggccgacggcggcgatacggagtggagctgaccttgactttggaaaagcggctcccgtggggttctggacggagtggagtggcagccagggtgcggtggagcgcggcgacgctgcgcgacgacggctagagcggtgagaggcggcggctggaggcggtatagttgaggtggctcgggtggacagcggaggtggaattttggtgggagatttagggaaaagaggtgtaggacggggtggagctcggcgcggcgatgccgacggtggcgacggcacggcacggcggtggctgaagctgcgagaagaggcggctggagccggcggcggcggcggaaagaggtggtgcgcgtggctgcggcgcttcgaaggtggagaggggaaatggagcggtggacggggtgcgcacggcggctgcgatgccggggagggcgacggcgcagtgcggggtgaacgagagcggcggcgcggcgcggctggagttcgccgaggagcggcggagctgggacgcgcgcggggagagcgggaaaaggcgccgcgggctcggggaggagggggaaacgggagaggaagccccggggatgctctttataggggaggggaggcgggatcgagcccgagaggggtggaaactggccggcgacgtgggaggagagagaggtgcgggaggcggcgacgtggcgatgaccgcgtccacgcacgcgcaggagagggagtcccgcgggagaggcggcgacgtgggaggatttggcggccatggcggcggttggggatggagctagaggtaggagatgacaggtggggccgcgggtcccacctgtcagccagaggaagaggggagaccggttgggggaggaaaagaggactagagggagagggaggggaggagctgagccggcggcccaaagggggaaaagagggcggccgggccggaggggaagggggaagggatttgggccgagcccgaaagggtggaaggggaagattattttcttttctttttatttaaattgattaaatgaactttatattattataattacttcttgagctccgaaaattcacagaaaaatccggagagtattttaaggcacaaagaatattacaaaatattcccggccaatgatttttaagggaaaattttaattctcccattatttcacttgattaaattgcttaactttttattcaatttctaggaaatgcattattaaatgatttttaatcccgaacgaaaatcggggcgttacagcccttaggtacgggatgtacctatcgtcgaacactggggggcatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgtgatgacgggcctcgtagtacgcctctaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacccgagtccatttcgttcttgaatcgttttgatctcctcttccctcttgttttaatcttcaaatttgggtcagcaacaaattcttcaccatcgtacgatggccactgtgtggggtaaaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgtatgtctttttctgcttatcgaaacaccttgcagtgtgtttgttccccttactttcttgcaccttcatcttactggcaaccttggtggaccaacgctgccctaactggactcgcttcaaagcttcatcatgtctggtcacaaagtaatcattacacttcatgaacgtaaatgatacgatggccgtcactggaagcttaagaacaccaactagcacgctattgaactgttcggccatgttgggtgtcatgtaaccccactggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgcgcgcaccggccttgtggaaattagcactgaagtgcctcatgcaccaccagtggtgaaccgatggcaatcctggaacaggagtcatcatggcatttattataccagcatgtcgatctgagataatacaaacctccctatgcggcccaaccacaacccgtcagaaaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcattt

SEQ ID NO: 11794 - DNA, 1608 bp, Oryza sativa
taagtggagggaatggacggtcatcatcagagtcttcagcaaattcaacatcatattgctcaacacttgcctcctcgtcaacatcatctctattgacttctactgagacagaatcgtgaccaccactcaattcgacatcaaagtaatcatctggattcacatattggcctgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttccccctccaagtcttctcgtaccaactcactcttacttgcaccccctccacgacgagaataatatgtcacaaaattcttctcaacgtaatgataagaaggagatttgtttagatccaaattttctacggtacgaactaactttgatgcaaacacctctagagatctaaactgagatcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatggtcttcaatgacatatcctcaaactcaacatgtccaccaacataaggttccaccactctaccaccgtagtaaacacgaacaagtctatccatctacaccaaaaaatcaaatgtaactttgcaacaaaaattaaatcttcattcctaaacgtagtccaaaccgacatattataaccaatgcataacttaaattgtcccaaagctactactccaaaaaaatatttaatccacctacaactatcaacaagtttactactgcattacacatcgaaatattacaaatactttatcatacagcccaaacctccgtcatgcctcaaccataatttttcatccatccatccaaccaaaccatccaaaaattaacattaccacatatatggttaaaaaaatcatgacaccaatgagtacattgcaaacatgtagcactacaacaagccaatcctaagaacaaatgctaaaaatcacaaatttgggtaaaaaaggggttctagggttacccaccgatctacaaattcaaccaataaaaatgaaaaaaaaagaggggggaatgaaggagtctacctttctcttcgatttccacaaaaaatcccgcgaaaaacggcttcaaattaagtggatttgaggtggagaggtgagggggagagagagggagaagaacagcagctcgctgctcgggctgggaatggcgaaaatgggagtggggaggagaaaggtggtggggcccacggggtttaaggcacagaggaggggcgcgccagctatgctggcgccgtggtatgagaggcggcgccagtgtggctggcgccccctttctgcccagtcagcacctccacgacagccctagtgccacggtggcatgggcacggcgcc

SEQ ID NO: 11795 - DNA, 1745 bp, Oryza sativa
ctactgatgagctcattaaagtagtcgtcagcaacctcttcgacggtttttccatgcttctcaacaatgaaaccttcagctatccatcgcctgaccaaacgcttcctgttgatgctgcagccctttggaaatatgctcaagtaaagcaagcagttcttctgatcagctgacaaatcattgtaacagagattgagtatctgtgttactccttcaggagtaaggtggtgtttacatcatggacttaactttagtccctgtctttagacactaatttagagtattaaatatagactacttacaaaactaattacataaataaaagctaattcacgagacaaattttttaagcctaattaatctataattagagaatgtttactgtagcatcatataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacaaggcctaagattcatctccagctctgaacttaaaagaatcttgcacctttgtccaatggctctttgaccttgggtctctggccagaagtcctgccaccgcaactattgccagtggcagaccaccgcatttcttcagaattttgtccttggtttccctgaactcgtccgggcatgaatcatcaccactaaagattctttcattgaacagtcgttttgatttctcatctgaaagccgatctagcatgtggatgtcacctgtttgctgatgagtgctggcgtcagctacagatttgaaccttgttgtcaccactattctactgccattgttatttttgggcaaagatccccagatgtattcccatgaagatacagaccagacatcatctactaagaggaagtacctgttggagcaacatgcacaaatcaaatcaggatcattatgacacaatgatgcacacatcacaattgtttttcatgataattcctcttcttacacaatgaactagtaaggtgacccgcgcagattgcgcggctagcgtcatttttttttcacacatgaaacatatattttcatattttatttttaaaagatagtaaaatgggagcataactctactcctcttataatatttattatttttttaaattccgaatttacattttatattttttttacttctacatggactcgaaagataattgttaggaggtattgttaaactaaaaaagagattgttttgatgttagaaatggttggctaatgtgttttaggccctgtttagttcctacataaaaattttacacccagtcacatcgaacgtttgaacacctgtatgaagtattaaatatagggtgaataataactaattacacagattgcgactaatttgtgagacgaatcttttaagattaaatgcttcatgattttataatttggtgctacagtaaatatttgctaataacgtattaattaggcttaataaatttgtctcgcagtttactaacatattctgtaattagtttattttattagtacctgaacaccccatgcgataccgtatataatacccgatgtgacacgcaaaaactttacacccctgtatctaaacaccccctggaaaaatatgttttttctattgaaaataataaatggataactcaaaagattattggtttttactattttgaaaaaaaaag

SEQ ID NO: 11796 - DNA, 9393 bp, Oryza sativa
gtatgacatgattaaaatttagtgctgatcaccttagtcattgaaatatttattactgaaacttgtatgtttttagaccctatgagaacataaaaaaaaaatacagatgtacccttgaacttctatgacccacatgtcagcccaacccttctctcactgattcgcttctctcctcccccatcgaacacatcgatgcggcgccgccctctcttccccgtccgagcggcgccgcccttttcccctccccaccgtgtccccttctccggccgccagcgcgcgtccccggcaccgccgccggagtggatcgaggcggctccgtccccggccgccaccgtaggtgcggattgaggcggctccctccctggacgccatcgcaggcgtagatcgaggctgctccttccccagccgccgacggcgggcgtccatggccgcgtcgggtcctgatcttctatggagcttatgcacgcgctagcatcgacgcatcctcccccaacagcctctcaactcctctccggatggtgagcgcttcagtgattattttttttatttttttaatgatttttgcatttctggaatgtcggcttaatctaatcctgttggacttagataggatgtgccagtccgtttttcttttttttatttttttaatgatttttgcatttctggaatgtcggcttaatctaatcctgttggacttagataggatgtgccagtccattttatttcgcggaccttgttctgcatgtacggacttcatccattaatagcatatcaaaactcataatctcatctgttgcaaaatttaccgattcctacattctcaatatcgctttgattctccatgtttgaccttttgttgtcaactcactaatcttcttgtatgccatagtgattccagcaagaacaattcctgggtgcctttttgattgacgaagtggattccggtgagaacttctggcttgcagatttgtggcgtgctggcgagaagtttgaacggcaagaacccggtgaatttgctaatttgtggcgtgcttgttgatgatcacggcgacggtcactgcaagaagtttttttttggcttgttgaagatttctggtttgctttggttagcttgttgaagtatttattgacatgacaagtacttatacgattcggaaacggcaagagtttgattagagtttaattaggattggtttgtctttcaatgtttctaaaagtggtgtgaacatgcggattcccaaaacattgtcagtttccaatgtattgtatgactcggttttccttattttcattttgactgattgtccgattaatctttttttttcttcagtttttaactaattctaatcctaatctagttctatttttctttttccttattcttttggattaatcttattttcgttttgactgattgtccgattcatcttcttttctcctttctttagtttttaactaatcctaatcctaatctagttctatttttcctttttcttatttttttgattaatgtgagaatttctaggttgtgagagcgaacatggaggcttctttttctattactttaaagatataatagattagtggacagacagaaccataaattttgaatactaggaagtacttcatttgactgtgcttcaatggtgtcctagtactaacaattccgaaagattaagcggaatgctgaatttcttgctcatattcatatatggtggagaatgaacttcaaagttggtattcatctccattagttacgttagttgagaatgcagttatcattttagaaatggtaaattgcaacttgggtttagccttaggcatgtatggtagacacagaacatcagaattcacaaatcaggatcaatctgctgtagtggtagcctgaagttattttgcagatttgctaataaaattgagggcattctagcaacttttatccaaaagaaaaacatgattaataacacattaccatggcaggaaatataattaaatacataattacgaaatttttattagaaaaaaagccagagaaaaactgtgtttctccacatttagttatttttctataatggatagaaatcggacctctatattctccgcatttaatcattgactggattataaaagtaataactcagcactaaagaagtaaagatgatagcaaactatgtatagtagtatgctccctctgttccataattccaagttttggacaataacacgatcttcaaaatatatatgtttgactatgtttttttaataataatatatataataaattaacatatttttacttttattataatactttgtaagataaatctatatatgtgttgatttagggtgtgtttgcaagagcaagttcccaacactctcctctcgttttccgcgtgcacgcttttcaaactgctaaatagtgtgttttttttacaaaaagtttttatacaaaagttatcaaaaaaattcatattgatccatttttgaaaaaaaaattagttaatacttaattaatcacgtgttaatgaaccgctccgtttttcatgtataggagatggtttctaacacctatctccaaacatagccttaagtgcatttaaactaaatagttttaaagttataaaagtttgatgactttaatattatccaaaacattaagaatcatggagccgaagggggaaaggagtacctcttttgttccaaatgtgctgtgagcttctccttaagctgcttgtctgtccatctctcgatccctgcaagagagtctccatctgtgctctccttgtcagggacctgaggcatgacttgcctgaggatgcttctgagcagcgccgcgagattgagcttctgcgacgcctgcacgcacgcccgggactcgaacttctccccgaacttgcggtgcagcgccaatgccagcgtcgtcttgccgaggccgccgaatccgacgacggcgaggaccctcaggtcgggcagcccctcggtcagccatgccccgagcttgccgatggcgtcctccatccccaccgactccgcggcgccgacgagctgcggaccaggctgggggcggtcgttgacgtggtaggaaggggcggatctggcggccttcccgttcccggcgtccggccggccggggtccttcacaccgtacctcgtgcggcgctcgccgacgccctgcgcgcggttcttgaggtcgacgaccctggcggcgatgccccggcgctcccagagcgtggccacggcgtacctcgcgcggcggaggccggacaggaggccctcgccgcgtggctggccgccgaggcggtggctgaagtcgtcgatgcagtcctcgatgtcgtaggcgacgtcgcgcacctgctccatccagtccccgggtctgctcgtcatggtggtggccggcggcgtggccgaggttgaggaggaaggcgtgcatgctggccagctcgtccttgatgtactggatctcgctgcgaacgccgctgatgagcgtgtactcctgggccaggaggctgccgagctttcccagcagcgacctcatggcgctgtccgaggcgcctacggcgagctccatcttgttctttgcctgcccctcaccgccggcgacctcgatgacgagacgagatgaagctacactacggcactacgcccaacccaacggacgctggagtgcactgtagcctgcagaggactccatggggacgagcaggtataatagcaggctcagctatacatatactctcttcgtttcaaaatgtttaacaccgttgactttttaagtacatgtttgaccattcgtcttattcaaaaaatttaagtaattatttattatttttatatcatttaatttattgttaaatatactttcatatacacatatagttttacatatttcacaaagttttttaaataagacgaacggttaaacatgtgctaaaaagtcaacggtgtcaaacattttaaaacggagggaatatattttaaagagataaagaaagatagagaagagcagcgagctatggatctgtagccagctgcagtacggactctaagatgtaatgtgtgtgacaggtagaatcaggtattaatagtatagtaagcaactattgtataaattggctattatattggctatactattaaagttggtttagttgaatctatgccactgtaaatatatcaatttagataaatatcactactattcatttattcctatatgcagaaaattctatccgtgccactaccgtcatcttttccgtcgtaaatgcagaaattctatccgtgccactactattcattttctgcataaattcatctattcgtatatgcagaaaattcatttatgctctctctcctcatcccaacttgatttgatttagcaaagattgttgtgtgtttgcttcgcagcttcgctgcttgtttcagtgatttcaggagcagcgcaccgtcaatgcgatcttgttgcaagaaaactactagcatctatccaacttgagtagagagccctttgttagttgcgatctccagggtgcgtgcgttaggactgatcgggaaacctcgtcgaacaaatatgagtagactagatctattgtggtggtaccaaatacgaagttctccttctcattgaaaaacaaggtgtgcctgtaaagcaagtgcccctaacaagaccaatccatattaccgagaccaatctcgctagccgcaagagagaggcctatgttcaaggaatgaatctttttttataggaaggctggtggcatacgaagagagggcgacagaacatttgcattccctttctttgattgagagaaggataaagcaggggatcgtgaaaccgatccccactccgcctcacgcgccctgatagggggcgcccgccgttcaatggctgtgggcccctctcacgaagtgccatataaaagagggggagctgttggcgcacgcaaacaaacgttcgtcgtcgtgcacacgcactccccacaaaccctagaacccaccgatccgggataggcgctgaagtgaggggaagcctaccgtcgggatcgccgtcgcctacaccgtccacgccaccggtcgacctcaccatcatcatcgacgttgtccacgccgccgaccccgggagcacccacaggcaaagctacattgtcgccatggccgcatcaacctctaagggcaaaggtacgtccctcacatctctctccctcttccccgttcattctctaagtgcatcactactattgccatgagttagtctacctctagatccacacctaggcaaacactaagatctaacaatggtatcagagccttaactaggtgtagatctggtagggttagaaagagaaagaagaaggggtctcagatcccgaagaaaagccaaagaattaaaacaaaagcaaaaaaaaaaaacctacctctcccaccgccggttgtcgccgacgctgcgcgggaagtcctaccgccgccgctagctgtcgccgacaggcgcgggaagttccaccacctccgccggctttcgcctatgccgagggtagtacgccgccaccgccggctgacaccgatgcgcgcggggagtccaccgccgctgccgccggctgtcgccgacgcgcgcgggaaggaagcggggagaggaccgcaaggggcgtcaagggcaccgtcgcaatgccgctcgacgtgttgacagaaaacacgaggcctgggagatctgcttaactccagtgcaggtccaaaacttgccttcatatgtgtgagcgtgccagttgatttgatcctgtaatcaacaagaaataaagacaagagaaccgtggttaaatctataaatgatagccgatcagccaggtgccgatgacatatcatttatatctgagccgatgtcatctgtatatcgatcggcaatcgtaaataagtaaagaagaactaaatctacttgatcggctgtaaatattaacgatatatgattcttatgtcgatgtatacttaaatcaggtgattggaatagatcggtcatcatgccgagacagtataaatcacttagaccgaaatatacatccacaacaggactatatatatatatttatagcgtagccgatcagatagatctagcgtgtatcggctaatactccgatactactctatattaagatattgaagcaataataatatatcaaacaagagtttaacatatttagttatggcagtatcttgacataaagggcagatttaacatattaatgaagcaaataggataactgtagttaaatcagatacgatcggctgaaactctgatgctattctaatcgacaactaggtggcaggctagagatcaatattctaagcacgacttaatagatcaaactcaattgatgcagcattaagtatgaaaagaagaacaatatctagacaatcaagccgctagaagattcatagaatggtagatatcttatataatctggatcaacatcaagatctaacctaatcggatgccttctgcatacagatgttggtcgatagtagattagatagcgatattgctgaagattatgtaagatatatgataacttgacgaattatataaataagattagagtgtcataaagatggaagcactaatcctaataacacgatccgtcataacgaattttaccttttgttgaagatcgaaaccgatgcagctcaacccgaaagcaaaaactcgtcgaaacaaaattaaagtaaaaggatggcgatgcgccggaattgtattgaacgtgtgtgttaaaaattacatagggctcagggtctatttatacccgaggattacaagatatgcccataccggacacgaccattatctctaacaaactctaaatatcacgtctttgcggcagacttttgcccacacttatctataaggaatttacataaaacatcctaattaatagatacaattgccttcccaggactctatccatgcgtggcaatcatcttgaagtacatcaacctgagcccgacgccgtgcacaagtcgtattgtcagaatcggctatatcagcttatttagcttagctcaacctcagccgatcctagccgtagccgatctggactccagccgattcctgctttgttccagaactcgatctccgcctccaactcttcttcgatcaaatcccctttcctgacacaaatgctaccaaatttggttgttaacacgacggtggcgcgctcagcctagggcgagcgtgcgcgccggcgaggggccctgcggcggcgccgccatcacctccagctgccaccgaccgtggccacagcgaagagaggagggagaaagagaaatggcgctagggtttttcggccggccgggagggagggttttgttccccccgatctcggcggtcagccgtccgatcgtaaccctagcgatcggatggctgaaaaaaggcgcttggttggtggctgtgggccgaacgtgccaggccggccaaagtctgattttggttcctcgtggccgaagcaaaaaaagaaaaagaagttagatttggatccctattttagaagcttttattatttatgtttattgaagtatttatttctaagcaattttaaccaacgtgaaaattgttcagggagtaaaaaattgtaagaattgcttctgaacatgtatgtaattttaagtttccgctgctataatgatgtttacaagttttccatgcattagttctatttctgcccaacggtgatgtagaattaatgtggtagtatgttgtatgttttaattttgaccaacgttaaattaaaacatacaagagttttatttgtttcttgatttatttaaatttgctttcaggaacaactaacccacttgtgtatatctcggccgttgagccccttaatgggaataattaaggctcatggcgagagaagattgagatagcacttgcgctgtctaatatagatttagctctcaccgagccctgtcccactgcgccagttgcgccagtgagggcggagggtgagagcgaagatgcttttaagcagagaacgttggaccatgctccaatagtatagaagtacgacactgatcatgcgaagtgggagtcttccaaccgcaagtgcttgatggtaatcaagagctcaatagtggaggcagtaaggggagcaatcccagtatgcaccaccgccacagagtatcttcagagagtggagaatcagtttactatttcttcaaaggcttatgcgagctccttaatcaagagcttagttactatgaagtaccatggcggagatgttagagagtatattttgaagatgagcggtatcacttcaaagctcaagaagatagacttggttctccctgacgacttcctagttcacctcatttttgcctccttgccttcagaattcgagtcatttgctgtgaattacaactcattgcccgaaaactggaacattgagaagttgattgccatgtgtgtgcaagaagaggatagacccaaaactcgtggtgattctgcaaattatgtgaagaacaagaagaggaacaaccacagtcagaatgtcgcctctcccaaagcacgtggaaaggcaccacaggttgatccaaatccacgacaagaagtggagagggacgcttgcaggtggtgcaagcagaaggggcactttcagaaggattgccctgaattcctgaagcatcttttaaaaaagggtgagacatcattacattcgtagatgaatccctgtatgtaagttattcaaaatccacttggtgggttgattcaggtgcgactattcatgttgcaaattcattacagggcttccatacgaggaggatgctagcaagaggagaaagatgcattagagttgcaaatggtgtcgaagctgaagtcgaagctattggagaatatccattaaagttgaataatggcttcacactttatttgcacaatgtgctctatgtaccctccttaagtagaaatttagtttccgtttcatgtttggcggatgatggatataattgctattttgaaccagatttatgttcaattatattcaagaataagtgtgtgggtcttgccatccgagaaggccaactttacatggtgtctgaacatgagaatgcgaatgttgtatgcaatgaagagaatgttgcgtgcaatagtgtgtctttcttatctacgaatgtaagaagtaagcacaaaaggtgcaatgaggaaacctcggcaaaattgtggcactgccgtttaggccacatttcgagggggagaattgaacgattgataaaagaagaaattttgcatccattagactttgcggatacagaatattgcatcgattgcattaatggaaagtatgttaaacaaataaaaaaaaggagccatacgaagtttagaaaaattggaaatcatacacagggctgcaggaa

SEQ ID NO: 11797 - DNA, 666 bp, Oryza sativa
ttacatggttgagttgttgaactttctttgttaatgaggtgttcacaagtgataaagatgaagattaagtatgggcacgcaaaccaagaaagccattaatacatgattaattgaattttaattattttaaacttgaaaaatggattttatcgaatattttacagcaacttctatatagaaagttttcacacgaagcacaccatttagttgtttgaaaagcgtgctaacggaaaccgagggataatctgcccctttcatcacaaacgaacggagaattgggcaagctaggatattcatctgtatcatagccaagtatgtaaagaagtggatatatgatatgcatgtcgtattctccctactgcgtgaattcattgggctctgttacttatattatgaggaactaagatttgccaattgtgataatagatattatgtggaaaattcatatatactcactaaatctgtgggaagactcgctataagattcaccgtaccttctcttgcgcatattagtttaatctggactaaatttgagtattgttcttatggttacaggggcattgctattttttgctttgcttgggttatcaggatgcttcataacttgttatgaccgaagagtacggaatgacctggcacagccttgtcgagagttatgtctttgtt

SEQ ID NO: 11798 - DNA, 2974 bp, Oryza sativa
ttacaggaatatgttgtggaagatgtcgatggcgagcgcgcggattggtgtccgccccctctcccttcggagcatgtccaacagctgaagtctctggggcttctataatctgtagcccatgattataccaatgatgaccttaatttaggacttgcggcactatccagctgtacaggagatgatacaaattaagcggtgaagcaggcgtttcggtttttaagcagccaaatgcacaacaatatcgtttgtctttttttgtacattgtaacaagggaatacctatctgaaaaatgacaacagcatttgatttttatacgatgaatggtttcacagttttatttcgatgagctcatttcttgtgcatgttaggttggtgatctgaacaagggaaaatatgtgcttctggtattaggaaaccttgcaatgagttttgtctggtagggatgcctgaatacctgatgctctgtgtttgatactttggttggtgacagcttgagtagaaacgtagacaaataattctccttttaaaccagatgacaatacggtaaaactgtatttgaatttgaattggtaccagaaaaaccaagaatgcgccttttaaaccagaatagaggaaatttctactcagtcagtagtcttcaaagtgtggtaccaataccgcaactttttaagtggtgcttaaaaaaaagataaccgaaaaaaagataattaacttcacaaaactaattaaattatcgcggaactaaatatttaaaatatactttgattaaattatcgtaaaactataaatttaaaatgatatatcacaaaactacagttttaacaataaatcacgatacatcatcttaaatttatatttatagttttatgaaaggttagtcaatatatacgtagtttgaaagaaaaatactttttttaaaaaaagctggaacagtttgaaagaatttggcccatcgggctttgatttcacctgcacccgcaacgcaacacgcaccacttcgctctttctctcgcggcgccacctgaaccggagccggaggggaggagatctcggcggccgagcagaagcggcggcgctcgccgcggttgcggagggggaagaagaaggcgcggcggagcgtagcggagggagtagcagcgaggcgagcgccgagagggagagatggatcccgacgcggtgaagtcgacgctctccaacctggccttcggcaacgtcatggccgccgccgcccgcgactaccagaaggtgacttctctcactcactcgcggaattggctgtggaggttggtgtcggagccgggcgtgctgctggatggatctcggcaccagcgggggggaatcgaatctcggttcttgattgggagtggggttgacgggcggttgattcggccgcggagcactcggctcagctgtgctgcaggcctgcagccatggattgtggaaggtagaggtaacggggaagatgatctggtaacacgacaatgcgaatttctcgtcttgggaaagggcaggcacatgtatttgggcatttagcaattgggtggtattagcttgatctggtatttggttgggatcatggggaggtttagttcataaaggggatgggttagctccagtcctgtgttgatgttgcagggtttgaagaccagtgtattccatgctgaataggagtatgctgctttatgacacctcagtgtacacaaaaacaatggcgcttctcacgtgtagccaataaacatggatcaatttgagtataatattttggaagtttagaataacaaagagttggagtggatcatgatacatctggccgttcttttacatgttcaaaatgggttaccttcttaggccacgaatgcatgtcatgtaacatttgcaggtaatccttttgatattcttcctagatttacagcaacaaaatgtggtgtttgcatcaaagtgtagaggaaggtataactgtccttcatgcacacacttgattcttcactccttgcaatgtgatttgcaagttataatcttctctgcttatttgtgtcaactgcattttatgtccttgttgtaatgggggtaaaaaactgatccagcgggttgggtcgtgaaattggctggttggtggccgtggagccagtgtgctcctggatctcggaaccagcgcgtgatcaaatcttggtttttgattgggagtgaattgtagtctggtacacctatctttagaacttgtgtctgatttgcctccactcagctttgccacaggcatggattgtggaaggtataaccatagatcaacgtggaggatgatcctggtaacacaacagtgtgattttttgtcttgagaaagggcaggtgcattggatttgggcatttggctatgggagtggtgttagctcacgtgaaaagtcttgccttccagactgctctgtcctggtgttgctgtagcatgatccaatctttggctgggaacattggggtgggggacagttcattcggaggatggattagctccagtcatgtattccaggacaacaaatagagtgatggtgcagggtctagagaccagtatattctatgctggataggagataatgctttatggcacctcagggtacacaaaaacaagggtgctcctcccatttaggcagcctataaatgtggttagattggaatatggtttgcaagtttgcaataatcaaagttgcagtggatcattctccattcgggtgttcttaacttatgtatgttgaaaatggattaccttctgatgccttttgctctctcatgaattcatgttatgtaaaatttgtaggtattcatttttctatcaaaatggcctttctgtatattgacagcaacaaactgttgggggtttgcatcgaaagtatagtacaaaaggatataactgtcctccacgcacatcactcgtttccattatttatacttgattcttcactccttttgatatgattggcgagctat

SEQ ID NO: 11799 - DNA, 9089 bp, Oryza sativa
ttcctgcagcccaattgaccctgatgataattcatggacacctatctaaatcttttctaggatcatggataagcatttgaagacccttgcaccagtctatttgggaactaaattcatcaagcttgatgctgaagttagtatgctatctctattagcatccagttacttgtattttattacaaagatgatgtctaatcttgtaaataactactccagaatgctcctttctttgtcacgaaactaggaatcaaaacattgccctgcgtgatattgttcaagtaagtgcataaactttcatcattttacccatcggatttggataacgtgtgcttaaatgtttggtgctccttgctataaccttttcatcatgcgaggaccaatccaatagtcagggttctgtttttgctctcgaactgaaattttgttctttaggaagggcattgctgttgaccggttagttgggtttcaagaccttggcagtaaagatgatttttcaacaagagcgttggaaaatatactcaagatgaaaggtatctctattacatctccatacacaattctgtcaaaacattgaaatgacaaatatgataacacacaataatgtaggtataatcgacgaaaagaagaaggatgaggacgatgaagacgacgaaaccgatatgtcaatgaacaggaggattaggtcttcaaccgctcaagattctgattcagaatgaacaagaggtgatacactccactgtgtcatcaagtttcttttgcactctgtgtgtttatgtaatatgcattccgagttgtatcaacccagttaggaaacgaggtatttgaaaatgcaatagctatagaggaatttattttgtgtactgtttagttagtttttcattcatactgccaaagtgccaagctggcctatgcgagtcggtacgctttaccccaaacagtttttcttttctggccatcatgctgtcaatgttttacctacaatacctgattggttgctatacatgaagtatcacataaacatgacgagctaagagttgaaaattggacgtaactacacagctagtgatagccagctaccactccatctataagagatactatctacctatatttcaaatgcaattttctcttaaactactcacccgatctacgatccgattacaccgttgtgttcgtaacaattaaatctttacaataagatctcacatgattatattttgatgaaaaatcataaattacttttatgatatgtctaaattacttttagatttcactaagttacttcttagatatataaaagtaaattcagtaaagcctaaaagtactttacatatattatagaagtaacttagagcaaaacaaaggtaactttggcatgtcatttgaagtaaatccgttgtacagataaaaacatgactctatctagaaattaaattaatcagcacaaattatagaattaactaaaaacaataataaaagtaatcacctcagagcattatgaatgtataggaagtattttaatcaaatctaaaagtaagttatatatatgataattatatatatgatagtttgttcaatgaaaaaaaggcattaattaaagttactttccttttgttataagttacttctataatatatgtaaattacttttataatatatgtaaattacttttaggctttacttaatttacttttatatgtctaagaagtaacttagtgaaatctaaaagtaatttagacatatcataaaagtaatttgtgattttttattaaaatataatcatgtgagttcttgttgtaaatatttaattattatgaacacaacagtgtaatcggattgtaaatcggatgagtaatttaagagaaaattttatttgaagcatagatgataggaatatttcccctacttacttaatggattagtaatatagtaaagtaagattcttcaagttaacacatatctggataggggtcgctcgttatgactaaatcgagagtgctctcgatttagattttgcgttgaaaattaccatctcaaaagcaattaaaaaaattgcacagctacgaaaaggaaaaaaaaagaaaagaaaaaagaagcaaactttcgtgcttctagaatctattgcctagacaaaggttgggtgattatgtgactgcaacaaaattgcgaaaacgcttagtatcgtacgtccgataacaacgaaactccggacgcgtagggacccacatcagaaacccatcccttctccaaccttatcctattcttcctcatccaaaaccaaaaccatttcccccatttctctcccctaccatggacttctccggcggcggaggtggaggcggccagcggcagcggcggaggtagcgtcgcgtccgggagggtgcaggcggagcggtgattggagatcgtggggaagctcctcgcggcgagggagttcgtcaggtgcaagcggttcgcagagcgcgcggtggaggtggacccgcccctccctggtgccgacgagctcctcaccgtcaccgacgtcctcctcgcttcccagtcggtcctccccttggtccacgccgacccgctcgctgtcatccagcttccctcggccaccaacccggccgaccacgctgccgtctcccacgcctaccgctgcctcgccctcctcctcaggcaggagaccaacccccacccgggcgccgatgtcgccctcagcctcgtccacgacgcctacgccatcctctccaatcccaaccgccgccctccgcccgccgttgccatcgtcgtcccccacactataaggttggcgaaggtgaggaggcttgtggcaacgtcgacctagctagcgagcattgttgcacaccatatgttttttgtgttgcacatagtgtgtttgtgatgttgtaatccgtcttttctggatgtttcttaaatcagtactggatgttgcatttggtatcttcggatgttgcacatattgggttttgagtgttgcattcaattgaaacatcttcaataaagcgatgaaacattcttcagtgaaagatgaaacatctttaattcatgttgaaacattttttttcgagcgatgaaacattgcaacatttcatttaacatacaatgaaacatcgttcggagatttcatgttgaaacattttttttcgagcgatgaaacattgcaacattcattctacatacattgcaacaccgtccggagatttgcaaatctccggacgtccgatgcgtagcactctccacaaaattgatgacacaatccgaacatctatctatactaatataaaaagcaccagttcatcaaacacctgtcttttctatcccttagatctattcatccaacggcttgtatcaaaatttggatcaccttgcaattagcgatctcccactccgcttcgcgtaaccagcgattaaaggaaaaaatagtgatcggattagcgttcttgccgtccttgccaaaccgccgctcctccccgcgatggcgaatcaggatgtccgctctgctggacgtcctcgacatcaagatatctacaaaatacaagtactgcgaattacgtgctgaaaaacccaaaagggataattgttccgaaacgacaatacaagcctagaatgtttatggcacgaaatcaaaaagtacaaaagaagaaatttactcttcaaatagagaaggaacaatttcccctagatccaccacgtccgatatcacgtcctcgcgtgtgtcattcgctgccccctgcgacaagatctctttaagatccaagttgggctgcgcaagcctcacacacgcaaggagatggcaagccccggtgtggatcccgttggcgatctcatcagacaccttggccgcatgcttcgaaggaattacctccatcgcttgggccagggtgaacagcgaagatgtcaccgaggtctcgtcagggtgctccaggatcttggcctcaactccgcacgcccccgccttctggtgaaggcttgtgaagctctgacagagcgaagcacggatggaagcgaggtggtcctctaactcagacatccgcctttcgaggccttgccgctacgactcgttcccggccacgagttccttcatcttttgaaggtcctcgcgagccacctccagttcctgctcaagctgggccacacgtccatctgctgaggtcacgcgggcgttcgcctgctcgatcacccgagccacccccgagcaccaacgtcgaggaggcgcttcatctcggccatcatctgcgtcaaagtcagtggctcgatagcagctggcggaagaggagcaagtaaggctatgacgacgtcaggagcaggctcggccgcgacaggggcatccccgattacagcagtggcagtaagcacagccgctgcggtagtcgtgctggttgcgacttcacccctgctgtgggccaatgacgtcgaggaggccctgaagacatcacatcgtgtccgtcagaagacaatattagaagggaattcgtgaaggagaaaaaggttccatttttttgctcacttgttcgccgccagctttaccagtcttcttctcggggttggagggaggttgcccgcgtcctaagtgagatggtaaaataagaatctgctcgctccttttcacgacaacaatacaccgaagacgactcacctcggaaccgctcaccttgcgacgagacccagtgccggtgactgtggtcgcccacctcttctgtttcgacgtcctgctgcccccagcagcagcgacgtcggaagcctccttggagactttctccttaagtaaggcggaagcttggtgatccacgagtgggccaatggtgtccgttagaggtagagcctgcaaagatgaggtcatatcgttttctcggaagaaagaggaaacggatgtcaactatgcttacgttgatggcggtagctcgttctgtgccaccttgctcacagagcggggccaggatctcggccgccttcgaaggcaggctaatcatcacttggcacaccctctgggctacggtggcgctgtcaagacctacgataaggaactaaccttggttagatctgaaaaaactgtagacgcagaataaggtaacaacgcgagaacaagtaccccgctgcgagatccgggtcacatcgtccggcccagagtagtcataagcagggtgaacacgggcttgcagcggctggattcgacgacctatgaagtcgacagcaacctcatagctggtcagtccttgtactcgcagatcatctatgatgtccacgaatgcttggagagaagaagtcaagggaggtttcgaggtccactcttgagatcactcaggttggttctcgggaacgacaaggacaggctctgagttttcgatctgaagttaaaaccacctcgatcttcacttgctacgagataaggggtattggaagggaatgtatttcgccttcatgccatcctgaaggcgaaatccgtagcatccagagatcctgctggattccatccaatgaagctcgtagtagtagcagaagagatcgagaaaaggcactaccacaacagagatgagcgaaaatgctcaggaaaataatcgaattggggttgagatgaagcaaagaaagaccgtagaagttcaagatcagcaggaggaattcggaaggtggaggtagacaaccacaataaacgaaatcctctaccactaccatacgacctaagatgggatggggttcagtacctcctttgtcccgctccatggtcccgcggccgggtagagcccccttcttgcagtttcttcatggcggcggtgtcaaaagatgatttttccagatccatggccgccagaagatcgccgggaagtgaacagggaaaaaaggctagggttttttggggacggaggggtcaagagcgccgggaagatggaagaattttctcgcaaacagatttgaaatggatcccaaaattcctttaaataggcgcacaacaacacggttcgtatcctaaggaaaggagagaatttttttttgggcgccccttgcccgaaaatttttctaaagctcgttatgggctgtagtttagacttcaatttaaattcactcacgaccgttgaacttccttcagcattgttgctggctccgtgtctctacggttttataccgggatcgaccaagcgagtacgacaacgtgctgacgagcgaagttgcgcatgacaacgtgagttcatttaagctgaagtcgggggctactgtcatggttatggataaggcataccctctttccttggacttatggaatatacggatacaacataccatcacaaatacgagctatctccgtatgcgttaaggaaattcgccagatgttatggaaaatgtctctacgggacaagcgacggacgaagtcctactcggaaaggatagggtcttactatatcgtacgagatccgatgtctccgagtcctacttggagatcaagatgatccacggtataaaagggacccctgagagggattcaaggcattgaatctcaccaccaacacacctgccatagtttacgaagccggagcacgcagagctaagtcaccgggagatctcgtcgaatccattgactacaatttcatcggtatcgtcgagttcatctattcctattgtaatatgtggtttcttccatataatctcatataaattggacaagggctattacttgataaggggcctgaaccaatataatccttgtctttgtgtttgcttgatatcatactacgtagatcctcataccagcgaaccccaataccctaatcatccggtctacgggtatcactcgtcaacagaatgagcaacatagaaaaaactgcagaactcctagcattgaaaattaaatcgagacactatacaagttgattccaggaaggtatttgtaaatacaatattttcttacggaatatttggatgtagaaacaaatacacgttacaaacattgttgactagaataaaaacggttaactagaattcatttcttgacaggaactaactagaattctagaattactaaaactgaaatttggttaaaaatattttggcagctacttggattagtgaatccttctacaggcaataattaattgtcagggatcattgaacccaattagagactgaaaacagatatttgtttcaagttaaaatttgctaggcaaataaatagcatcattaagtaggcaaatattattagaattggtgaaacacctttatatttattagttttcttaggaaaacagatgacattttttttacactagcagagttttgggagcacagcagacgaaacaaatatgccacagctcaacaaaagaacaatacaagaatttgtaaatagttcagaaaatcataaaaccaaaaagactacagatggagtaggtacaacacatcgatgacacactggttccctccaactatggagattatgtcacgacccgaggccatgacgggagaaacaccaccgaaaagatagccggacggcgttggctcctagagaagagatgtagatttagagtagggagaagagcattattaggagggagagattacactaattgatattcattgcttaacttgagatgaatacaaaccatcccttatatagagatgatatgatttgacccttaagaaactaactcagactaactatatctaatcttatcgtatctcctaccaactgctacagtactcgaggtactgttcatccacttggacttgggcttgtgggcctcggccttctgcccaatgcctatgacactacaacctccttttgagcagcttgtcctcgagctgcaacatatagcagacttctagacgtacacgactccctaaataaaacttaatataattgctgcaactatttgtcccggaggttgtgacccccaagatgcagccctgctcgtcagcatcactccccctcgccaacaacggcgccattgccaggaccagtggaggatcctctggaagcgtaccctgtccctcgctccctggctgttgctgcaatctaatggccacggaccacgtcgacttgaacgacaccgtggagggaatcaccacccatggctggttggggagcaaccccttcttaggtggtcacccatgggtgaccttgatccgcttgcaccacttcaagacttgtggatgtggttgcagtggagaggacagacaacgctgtctgcatgcctccaaacccgccggctgagttggaggtgtagagatcggtgacggcatcaccatgcccactgccatgtcctgctctatggcctcctgcttgctatgccattcctctttcttcaccagtttctcctgaattaaggtcgccaattccttgagaacgaccctcaactcctcgatgcttttaactccttgatcctggttgtggaggtctgttcgtactggagatacaacagccatcgtagatgttgcggccatggaaggctttttgtgcatactctgcatccgcatgagattggaatttaattgaagcctccacatctgttctcatctgctgcatgttgatcttctctgctccataagcataaatgttgatgcgaaaaacatacactggcctgagagatttgcttaactctagtgcaggacctaaatcttgcttttgggtttaagggcgtgccagttggtttgatcctgcaaccaacaagaaacaaacaaaaaaacatagttaaatccataaacggtagccgatcggccacatgctgatgacatatcgtttgtaagttagccgatgtaacgtgaattagatcggcaatgatatataaagcaaaaagaaagttaaatctagtcgatcggctgtagatattaacagtatataatctatagattgaaatatgtttaaaccaagtgattaggatagatcagaccagcttgccgagacagtataaatcacttatgtctaaaagtacttcaatgtaaagattatatatgtttatagcatagccgatgttgtagatttaacatgtatcggctaatactccgacactactttatactaggatatcaatatagatcaaatatattaaacaggaattaatcaagtgttaatgtagtttaacagattaatagggctgcagga

SEQ ID NO: 11800 - DNA, 1159 bp, Oryza sativa
ttcctgcagccccactgaagcgatctcgaggatgatagcgctacaaacactgtcagggattgggatctgcaagagctcagctggagcacttgcagacatgcacaatctcaccaagctgaagaagctcagcatctataacgtcaaagacttcgacagcaagaacctgagtcatgaattgctgtctgccatcgagtacctaactggctgttcgctcaagtctcttgcaattgatgatggtttcaccggatttcttaatctgatggattctctatccactccaaaatacatccacacactcgagctttcaggcgaactacccagagtgcctaaatggatcagtgagctacaaaacctggagaaattgactttatcattgacatcactgagcacagatgctttgtttatcattgcccaacttcccgtgctcttctcccttgcgttttcggtcagtgcagcaagccaggaccacggtgtcatggagatcctgacgaagaacacgatgaattcaggggggaaaatcctcatcccttctgacggatttcacagcctccagctgctccgtttctcggcaccgttactgccactgctaagcttccttgatggcgcgatgccgaagctacagaggctggagctgcggtttaggatcttggaaggtgctcatggtgtggaaaacctagctagcctccagcaggtgcttcttagagttagccagcaagctcctgaaactaccaaggtgcaggtgtctgatatcagaagttcagtcagcttgcatcccaacagacctacggtggtagttgatgaatactacgggtgatcaattatccccttcttattcttgcagattgcagtgttgtttgaacatgtcatttttactgtgcctgaatcatcaaaataaataacaatcctactggtacgggttttctcctttttctagtttattttttgagctatctcatgctgtgacgcgtatttctagatgtctttgactactactagcatcgacatgggagacctggaatacgcggtacttcgataatgacctggaatacgcggtacttcgataatggttgtgtttagatccaaactttagatccaaactttggatccaaactttcaacttttttcatcacagtaacctgttatacatacataatttttc
